United States Patent 7,833,706 (GENETIC POLYMORPHISMS ASSOCIATED WITH RHEUMATOID ARTHRITIS, METHODS OF DETECTION AND USES THEREOF) - sequence listing, part 7

SEQ ID NO: 10717 - DNA, 546025 bp, Homo sapiens
  misc_feature (1)...(546025): n = A,T,C or G, or insertion/deletion polymorphism (see Tables 1-2)
ttgtttgttttgaatcagggaacactgagatcctggtgagaagtgtggacccctcttctctatcccctacctcctcccaagccataattctatctatagtctcagccaaatccctgacacccatacatggcccccagtttaggaatttctgttctagtatggatgttctttaaagaactaaaaatagaacttccattccatccagcaatgccactacttgataattatttgaaggaaaataaatcattatatgaaaaagacacatgcacacacatgtttatagcagcacaattcacaattgcaaagataaagaactaacctaagtgcccatcaaccaaagaaaatacggtgtatatatacaccatgaaatactactcaaccacaaaaactgacaaaataatgtcttttgcagcaacttggatggagctggaggccattattctaagtgaagtaactcaggaatggaaaaccaaatattgtatgttcttgcttgtaagtggaagctcagctatcaggatgcaaaggcataagaatgatataatggactctgggaacttgagggggaaggttgggagggaggtgagggatagaagactacatattgggtgtagtgtacactgcttgggtgacaggtgcactaaaatctcagaaatcaccactaaagaattgatccacgtaaccaaaaaccacctgtaccctcaaaactattaaaaaaattttaagaaagtatttctgttgtaaagctcatgcattttgcctatgtgaaatcccattaggttttgctgtccaaggtgaatcattctttgatagatcaggaggttgaagacttcggttctgttgataaatttgactcttactgctatgacttggataagtttttaactactctaaacttaagttttttcatctataaaatgatgataataaataactgtcctataggataattgcaggatgaatataaaacaacatataagcaaggaaattgcaaatttcagactagaagaacttagcccaaggtccatggacaagggatgagcttcagagcatcagcaaatgccctgatattttcagcaaaatgtgggtttgtgccacctgtgtgtttttcatcagaagtttatgacctcaagaaagtaagaataagtgcttctagcatggactttatgatatcattgttttgcttatttcccaattctaaactacatttcagataggaagagctgttaatttactgacttccaggttagagaggcattaatatgtacttggtgtgcaaaggatcctcagtgaactcagcttaatgaattaactatgatttcactaattaactagctaatgaattaactattagagaatgtgtacccatgtatctgcatagtcatactctgctactttgtagctgatatggtctgaatgtgtgtctcctccaaatctcatgttaacatgtgatccctagtgttggaggtggggcctagtgggaggtattggatcatggaggtggatccctcacgaatggcttagagccatttccttggtgatgagtgagttcttgctctgttagttcatgcgatatctggtggtttaagagtctgggaccgctactctctcttgttccctctctcttgctcccactcttgccatgtgatatactggctccccgtttgctttctaccacaagtgtaagcttcctaagacctcactaggagcagaggccagcatcatgcttcctgtacagtctgtagaactgtgacccaaaataagcctcttttattgataaattacccagtctcaggtattcctttatagcaatgtaaatggactaacaccgttagtgataacatatagttcacaaatagactaatggatgtagatagctatgctatatttaccagtagaatctatattattttaagtaaataaatagattacctgggctaacattcttacttcattaacgaaaataaacaaattggtcttctcagtgtctgttatctgtactggtttcctttcttcaaagggatatcatgaagataaataaagatatagctattaaaatgtttgaaatttcagggaaaattgcaatgtaatgaggatgatgatgaggattagctaattagagttattgtttattgagtatctactaagtaccagactctgttctaggcatttaatacactttgtgtttaattttcaaaacaacatttaaagataggtattattgccctcattttataggtaaagaaacctgagacttaggttaagtaatagatccaagttcacaaagctagtaaatgtaaagctggaattttaataaaagtctgtttgactctacagtctgttattttttttctacagttaatatagcagaaaatatatttgtgactcttaataaggcataacccagccctataaaatgaatttttcttattttcctattgcatttgaaaattgtaatagtcagtctactaactttaaaaaacttaggatgtacctaaaactcaatttaacctttatattaaagttaagaaatgcccttgaaaggtttcaggcagggggatgatatgatcagattagtgtctttggaagtttgctctggctgtagggttgagtgggttgctttggatgtgactgggggcaaggaggccaagagagaggcttttttaacaatagcaatggggttggagagaagtgaatggccttgatgactatttagaggatagcctggataaatcttgttcattgactggatatgggaggtcaggatggttagaaatcaagacagacacccagatttttgggtgaggccttacatcctttctggtattaggatagggggcaggttattagggagagatttataggtgaaaatgacaagtgcttctgggacatactgggtttgaggtgtttgtgaagatgttacaatgacctttgggaatcggttttgaagtttaagagcatgatctggacgacaaacttagttttggaagtcagcatcatattggtggttaagttaagccataaaagtagatgaaattgctcgaggagggtatgtagagtgagaagtgaagagaatttaggcaagaatcctccagaacaccaagatttaagagacaaatagaaggggtagctagagaggtgtggtactgtgttgtcacagaagactgtttcaagatggaagggatgactctaaatatttaccccaaagagaatacatttattcacataaagacctgtacatgaatgtttatagcagttttatttcataattgccataaactgaaaacaacaaatattcctcaagtggtgaatggatagacacattgtggtgcatctgtacaattgaaagctgtacttatcaatgaaaaggacctacctacctatatacacaacatggatggatctcaaaagcatttgcaatgtgaaagaaattgaacatgaaaggctacatactgtctgattccatttatatgatattctagaagaagcaaaatcatgagaacagagatgagaccagtggttgccagaggctggagttaggaggagtggattgactatgaagggacttaaaagaactgtttgggggtgatggtcatgtaatatattgactatggtggtagttacatgattgcataatgtatctaaactcataggcctgtacacctacaaagggtgaattccactgcctataaattatacctgaataaacctgacttcaagtaaaaaaatcaaaaacaaaagggagctgttaaaatgttcaacacagctttaaaatgacataagaagaggactgagacatatccatttggcattggggactttacagggagcagtggcagyggcatgggggaggcagaagccagaacgctaagcattgaggagaatggcaaagattactggttgtctgtcccccataccaattttccccttcttacatgggaatggaggtctcaacttttggataggctcatgactatgcagagtaaagacttctttgtctactctccctggaaactgaatgtagccatgtgactgaattctggccaaggagatctaagtgtcctgaggcagcttctgggagcctttcttaagaggcatcaggcgtgcttcctttacctacttttctttcctctttccacatttatgttggctggaatgcagacataagggctagagccagagcagccaacttggaccatgaaacaattttaggaagggagaccacatatgatagagcaatgttttgtaggagcctggatctctttgctctttcaggagttgagctgataaactggcccaggacagcttatctctgaacttttaagacacaaaagcacatctttttcctgtttaagcctcttaattattcacacatgaacttaatcctatatgcaactggaaagggacatggactgggggagggttttatgatctccgaattcacatagaatttctctgtgaagggaaacctggagttgatacagaatttccttccacaaaacagctctttgaatcttcactgggtttgactttgcatctcactctcctgaggaaaacgaggagcagtgaatccactgagaacattttgcacggttctcttcccagccccttgacatgtggagcagtctcccatctagagccaccatacagagttgactggcaggaaagccctagccctgtggcttgcatatctgagccctctcccctttcaaccccagtccctcaggaaggctttccctgaacacctacctaggcacatccacttcccttttattctccatcaaagcatttttttaaaaaaacacgtctttattaagacataattcatagaccacaaaattcacccagagtgtataattcaatagctttcagtatgttcagttgcacaatcatcaccaaaaattaattctagaacattcatcacagcatctaattacttaatttttatagcaatattttcagcctgtgacgatatgtttatttttgtctttatctgtgctttgcctttctactttaacccgtgagctcctgcagggcagggactgtgatggctatgcttatgcttggtgctgcgttttcagcacctggcagacaccgactcacagagggacccggctgcaagatagaagaaaagcctgaagctgtcccatctactctgtattgtagcaggtgcaggacacctggatgacaaccaggtccctgctctggaaaccgttaggagtagaggattctcagagggggtggaggcagggtgtgcgtactccaggtggcttattaccgcggggccggggccgtggtaatttgggaaaccatagtcaatatagctattgttttcaaatagcagactagggaaactgaccctggacaatgtcttcctggcaggcgggaacacgcagaatttggagtgaaacggaaaggggcatggggtcgccaaggtggtgaaacgccgcattaaggcgcttcaagatagctggagttttgcttgggaaactcagagggatctcgcccggccggcacaatggcgtttctgaacccatgcccagcccactgggggcagtccttgctgcttgcagaggccagacgcttcttgcaacttctaagcggcgagagctgccaccttgccaatgactcaaccgtttgcctatgccctctgggctgtgccaccagccgcagccgccctgctcccccacccacccttctccccaggctccgcgccgcgccgccagtcccaggggagccgccggcgcacctggcgcctagggcgcacggcactgcgcgctggtgggcacctcacccgacgccagctgccagcgcgctccctccccgaaaccctgaagtggggtgtcttgtctagcgcccagcgaacaacattatccaattgcttcccgttttattcgcaggctgggagctgagagagcctgagcattcactttcaaccctccaggggaggagggggtgcgggtggggaggggagacggctcccagctccacctcgcgcgcggcgcggccagtgcactcggctccgggagaggcgagcagcgccggtgagccccgcagcagcgcacccggccgcggagccccgcgatggagtgagtatccccgagccgcgccgccagctgctctcctctcggcatgttgccatggtgaccgcggcggcaggcagatcccgctcgggtccgcgtccaggatgggtgtttaatttcagccccgtgtgtacgcctggtgtttctatagcagccgccgcggcggcaggaggcaaggggtgggagccccgggtggcgtggtttttgcggctgccccttggctagcagggcctggggggcgagtgaggggagtagatgatgttgctaaggacggaggcatattctaggctttcctatctctgccccaagcttccgcttatcggggagttggccgcaatagccatgacttccgattcctaaccatgtcagcattattggactgcagttaaaaaaagagggagggggtcactgcggatcggaagcaaacgcggttcagtgtgaagcgtgtaatggaaggatgagttagtgggtaatatgagccagggctgcaatgtcctggctactagaaaccatcagaagacccaaaagaattgatttgttcctggggtattggagaaataagacaaacatattggcggcagcccggagtggaattacaacgtttggcaccgtgaatacggcatggatgggtggggaagacaagagaggcattaaccagaaaagacattaaataaagggctccggttgtgggtctggtctaggattcctctcttctctgtgtttgcatccctacattgctttttggacactctctcgagctgctgccacagcaggaccactctgacaggcgacagccagccactccaaggaagggtcatttttggagccagctattagatcccgctcacttggtcagcttctcctcttccgttctcttcccacactactccttgacattgaggccgtctgaaatcatatttcaagttagagataaagtcatgttttcagacatcaggaccttcgtaccaaacccaagaaaccttagatgcagcctttatccctctgcgtatctgattgtgtagatgcaatttaatcctcagaaaggctgctaaagcagaagtgagagatggtgtagcattgtaggagtcacagtcatggatttcaggccccacctagcctgatactgctgttattgatttcctactccagcaattgaatgtctctgagcctcagtttccctatctctgcaatggaaacaaagatgttccttactcactttgaagcattattgagaggatcatgtaatatctgtatctcttccaaagggctttgtaaattgtaagatatgtacaaatttaaggaactagtgtcatgtttaagagctgggctctagagtcagattggctggtttgaggcttctgacactttgctgaatgatgttaatctccctgggcctcattttccccatctggaaaatgggaataataatagtaactatttcatgtactttttgtgaacattaaggaagttaatgatgtaaattgatacatacacatataaggttcttagaacagagcctggcataaaataagctcaataaatatcatctattatctatgaatattatctattattattaggttggtgcaacagtaattgcagtttttgccattactttcaacggcaaaaaccgcaaattactgttgcaccaacctaatactacagtctacagcatttattggggtttcggattggcaccaagctattcttcattttagacagggtctcactctgtcacccaggctggagtgcaatggcgctatcatggctcactgcagtattgacctcctgggctcaaacaatcctcccacctcagccttctgatgggactacaggcatgcacaaccatgcccagctaatttttaatttttcatacagacgggattgtcctatgttgctcaggctagtcttgaactcctgggctcaagcaatcctcctgccccggtcttgctgggattataggtgtgagccaccatgcccagtcttttttttttttttttaatttataaagaaatacatggtgtggtggttcatgactgcaatctcagtgctttgaggacagaggtggtaggaagtcttgatgagcccaggagtttgagaatgcgctgagctataattgcaccactgcactgggtgacagagcaaaacctcatctcaaaaaaagaaagaaaggaaggaaggaaggaagaagaaaaagagaaagaaagaaagagaaagaaagaaagaaagagggggagggagggagtgagggagggaaggaaggaaagaaagggaaagacaatgcctgaagggcaattgagagtaacataattcccaagataccactgttgatgtgagaactagcaagaagccacagcaggcttggatatacggaacagactcggcctgatgcacacttcattcttgttcctcactgtcattttcttagacatggagactgtcctttacaagagactgaacatagatctagtcctctcactgggtagcgctaaaggagagcctggtcatttgccagggcagcaactttcatctttatgctctcacatggataatctaatatttgatatgtttctcccagacttagcacttgggtgctcaataactggaacagcacacaggattggtaagtttacaaaggtcctcagctttttcccacattccctctgagtctcctggctaaggtttcctccaggtgtgctaagctcacacctggaactccttgtgaacaaagaccttcctcatcacattcttcttgctccacaggatccaaattactgcctcaattagcctccttctccctaatcaacttggcctcagctttcccattcccaagcaacattccaaagttctcacttcctggttaaccttcccaatttccaactctgttttctgccctacttcgtttgcttccttaatgtrttaggctgttcctgcattgttataaagaaatacctgagacagggtaatttatgaagaaaagagctttaattggctgatgattctgcaggctgtatagaagtgtggtacaggagtcagctcagcttccggtgaggcctcaggaagctttcagtcatggagaaaggtgaagcagaaggctggcaagttgtatggtgggagcaggagcaagagcaaggggtggcgggggtgtcacagactttaaacaaccagatctcaggggaactcactcactattgcgagtgaacaccaaggccccatccccaggattcacccccaggaccaaaacacttcccaccaggccccatgtacaacactggggattacatctcaacatgatacctggagggggacatccaatctacatcacttaatatagtgagctttttctttcttttttcccttttagaatatcatcttttcctgtccctccttgggtctcacaacatttcccttgtgccaaatactgcccctacccttcaatctaaacactccccaratttcatccccggtaggaaagcccactttgaatatgagtgaaatagggactccattccccttacttactgtaaccaacttatatttataaacatttattaaaagagggaattaaattcacttcttttatgttttaatttaaccaacaaaygtttgttgagattagcactggtcaacaaaacagtcatgattctctttgtctgatgagagatagatgttaaatcagtaaatatgtgtgtatactgattgaatttctcctcagaaaaggggtttttcttttctatcacattktcaggctgcaaattttctcaacttttatgctctgcttcccttataaaaccgaatgcctttaacagcacccaagtcacctcttgaatgctttgctgcttaggaatttcttccaccagatgccctaaatcatctctctcaagttcaaagttccacaaatctctagggcaagggaaaaatgctgccagtttctttgctaaaacataacaagagtcacctttgctccagttcccaacaaaattttcatttccatctgagacctcctcagcctggatttcattgtccatatcgttatcagcattttggtcaaggccattcagcaagtctctagggagttccgaactttcccacattttcctgtcttcttctgagccctccaaactgtttcaacctctgcctgttacccaattccaaagttggcttcacagttttgactattttttcagcaacacccaactctactggtaccaatgtactgtattagtctgttttcatgctgctgattaagacatacctgagactgggcaatttacaaaggaaagaggtttaatggtgaactcacagttccatgtggctggggaagcctcacaatcatggcagaaggcaaggaggagcaagtcacatcttatgtggagggcagcaggcaaaaagaaagcttgtgcagagaaacttcaattttaaaaaccaccagatctcatgagacccattcactatcatgagaccagcaagggaaaggcctgcccccatgattcaatcatctcccaccaggtgctttccaacacatgggaattgtgggagctacaagacgagatttgggtggggacacagagagaaaccatatcaccaaggtttccaatttaaaatgaaacctagtgaaaatgaggatacatagtcatttttttcacaagtattgttggttttagtaaaataagagcttcttagtttaagaaaaaaaaaaaaaccccagccataaaagagaatgaaatcatgtcctttacagcaatgtggatggagctggatgccattatcctaaatgagctaactcagaaacagaaaaccaaatattgcatgttctcatttataagtgagagctaaatgatgtgtacacatggacataaagatgaaaataatagatactgggaacctcaaaacagggaagggtgggaaggcacaagggttgaaaaattacctattgagtacagtgttcactatttgggtaatgggtacattagaagcccagtccccaccagtatacaatatacccatgtaacaaacttgcgcatgtactcacctgaatctaaaataaaataaaatttacaaaaggtctatcttggaaaagaagaaaagtctaatttccaccttaagaggctagaagagcaaactaaatccaaagcaagcagaaaaagaaataaaagaaagaaagaaaaatctaggtaataaacaagaaaagagggtactaactgattgaagttaaaatttttcttagtgacatgctctgtactggatgtgtagaacagagaagacctactggaaaaccagaaggtagggttggtgtcatgttctgtaccatgtcagtgttcttgtgtggtacatgaaacatcaggcaatggcaggtacttgctgccctcctgggtgggttgggtatgagatccatgtgtttgyaggaatgcactttaacacctgcagttattaatttgatgccacacctatagattttgcctcacacttctctggaatggtcttcaaaacagtatgggatccaaaaggcacaaagaacataacacgagaactctaagttgttgcgatccctgtaagccctggggctctgacaatgtgggtggcagccttggaccagaagtggcattccccatcaccagtcagatgcctgttatcacatggacttaggcttatagcatccagtggtgatcatgaaacatctgaagtttgattctgcaaatgaataaatctaggttcatgaaagaataagtgcagtagggacattaagttacagataacttaaggttcttaacatatgccttcattcattcatccagtaactcatttagttagcaaatatttattgaatactttctatgtatgaagcactgtgataggtacttgcgataaatggtgattaaaaacatcccttaccctgtcttcaaggagcttacggcttagtctatgtgtgactatggatactttgtgagtttgaactatttttcttgctgaatcagtcttctgatgacacaaaatgtggcatttcgtgtgctcagcatatggtgggcattaaacaaatgtgtttagaaatgtgtaagacttttagaagttaatttctatgatgaaagtaatgtatgctttttaaaacaattcaaatattacggaagtttatgaagtaaatatccccattttccattctctcactcatatctcagttcctagaggtgattaccatgaacgcttgggaaacctctttccagatattttccatgcaaacatcatagagttggaaacacttatatatatatataggtttaaatatttcttttacataaatgaaatcataccacatatgttgttctgcagcttgctttttccacttcatattatattctacatactttttcttatcaatgtatgtcagcctgtgtagctcagtggtaaagcacatgctttgaatatcaatatatacacatctacttcattcacttttataaaactgcttagtatttacttttggaatatcattaaccagttcttcatgatgaagagttagacttgtttccactttttgctactattttcaatgctacaatgaacatccttgtccacactgcaaataaatctgcatacaattttctagaaatgaaattgctgggtgagtgaatatgcacattgtgaattttgttagatattgcccaggtgcctccgaaagtattgtatccctttacattgccattcatcatgtttgagagcccctgtttccccaaatccttgacaaccctagccacattatatattcatatttgaatatttatgtttgactagtctaacttgatgtacatcatcactgtcagtggtcgtggtctgtgctcttgctctgtctacttgtcactttctcagagagccctagtaagccacaaggtgcaawtgttcagaagacagtgaaaatcacttacaaagacaaagcttaaaatatctcattgacttttaaaagtgatcaagtgattgttttacagttcatcaaatttagactttattgatagatttcttaccttaaagttgaggaaatgagcacatgtcacttagccccccttttaccatttgttgcagttatagtgtgatatagtttggctctgtgtccccacccaaatatcatctcaaactgtagtccccatgtgttcaggaagggacctggtaggaggtgactggattatggggatggtttcccccatgctgttctcatgatagtgagtgaattctcacaagatctgatagtttaaaagtggcagtttcccctgctctttctctctgtcctgctgccatgtaagacgtgcctgcttccccttccaccatgattgtaagtttcctgaggcctctccagccatgcagaactgtgagtcaataaaacctctttgtttacaaattatctagtctcaggtagtatctttataatagtgtgaaaatggactaatacttagtgttagttttatgttttcaaagtttttagcatttgcaaatttgaacataattctcttaattcattcaatcgacggattctttttgagtgcccttttcatcctaggcactgctccaagcactgagaatacagcagtaaattgtcaaagaggcaaaggagcttatattgtgttagaggagacagacaatacatatattacatatatactttgtcaggaagcaataaatgttaaaaaaattaagcacattaggagactggagagtgatgggagggttatttttgatagtgtcatcagggaacaggtttctgacttggtaagtttggatagagacttgaacaaggtgaggggatgagacatacagaagaaggaagagcagttgcaaaggtcctgaggcagggccatgctttgtgggctcagtgttagtcttggatctaaatgcagtcagaacaccaccagccctttcatcaatgacatcctcttttttgagcatcttataggttgatttagtgtttagttaaaagggtttgttttcaaacagggccaaagtgtattaaattctaaatgcctgttggttgtttctatgaacaaacaagttgaatgtgtataaaattatagaatcatgtttttagcccctcataattctccaagatgtcattccattgtgttytggcattgacccttgctctgggaaggtctgaggctagactatttcttctttgtagatggcttgcctactcccatccctcccactcctgcaatttttttttttggctttgatgctgatcaagttatttttaaacactgaaagtttggtaacttctctttgatatttcttactgtaagtcattgtgttgttgttttttttttctggaaaatggtagttcctttgttctgaagagtcatattttcctttatttttttgtaaagatattttccctgtggctttcaattgaagaatctatttgttctgttatctaccacagggacatctattacccattgctctccataactattaattctgaatttttctcatttttttcctgatgttcctatgagtttccttacatttaaaagtctgtcatgtagatagttgactctctttttaagcagcagtttctaagtagggctcacttctgaaatggttttatggttatcttcaatttattttctggcttggctagcacattttgcactttttaaaataaagagttcatgtatccaatttttttgaatgtatggagagtagtttatcagaaaattatctgtattttttgggctatttttctgaaatgtatttatctgccatttgctggtaactcatttttataaaaataataactctgcatatagaatctatgcatgttaatggctttgcatttattatccatttccaaatagaggtaattctatccaaacctactatttgcccaagaataggtagaggggatggagacagtgatttgggggagacattagctttggattggatattttgtctcataaaaaattcttacaactctgcaatatcttctgttcaaaaaagttgtgtagagagtgagcagatcattcagacagatcacatatcccagcttactgagtgtgtgtgagttgcgggagggtagacagatttttggtgctttaccactacttgatgacttggtttagcatttatgaagagagtggcagggcaaatcgactacaaaggtaattgctcttttccttctattttcctacatctcttgccttgagatgattcctccatgttaaggttttcagttttcgggttttgcagataataaacattaaggattcacacagtagtgccatcggtgtcactttctccatcagttcactctggtagggaaccagccccttcacacagatgtcccccacgttttgccagttctcaccaccaaacattgggcctttgtgtactctctccttacttagagagaaatttgaaagccagttaagatctgtagaggactatatcaccttttagggttgtccactgatttaataaaaattatactctgtttggcagataattcttatagcttgtgatttgagaattgtagctctttgctagtttcatagtagatcaatttattcatttatttatttgttttttagagatgaagacttgctctgtcacctaggctggagcatagtagcacaatcagagctcactgcagccttgaattcctgggctcaagagatcttcttgccgcagggcccaaagtagatgggactataggcatacaccatcatgcctggctaatttttaaattattttcatttttattagagataggctctcactaagttgtccaagttggtctcaaattcctggccttaagcaatcctcccacttcagcatcccaaagtgctgggattatagaggtgagccaccatacctagcctcacagtagacacaattttccttccaatttttccttcttttagttcatttcagcggctttgagggaagcacagagaagactttaccatatctttgagttaatgaatcaatgaatcttgtgtttctacgaaaataatattagtaactaccaaatgtcattgttattaacaaatctgttgttattatatatctttattctctctcaattccttaggaatgtgtatggcaaaaaaagagttacatgaatgagattgataaatagggtgcagtagaagtattttggaaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggcaggctgaggcaggagaatcaggcagggaggtcgcagtgagccgagatggcagcagtaccgtccagctttggctcggcatgagagggagagggagacgggagagggagagggagacgggagagggagagggagacgggagagggagagggagacgggagagggagagggagagggagacgggagagggagagggagacgggagagggagagggagacgggagagggagacgggagcgtttagtcctggcagataattcttatagcttgtgatttgagaattgtagctctttgctagtttcatagtagatcaatttattcatttatttatttgttttttagagatgaagacttgctctgtcacctaggctggagcatagtagcacaatcagagctcactgcagccttgaattcctgggctcaagagatcttcttgccgcagggcccaaagtagatgggactataggcatacaccatcatgcctggctaatttttaaattattttcatttttattagagataggctctcactaagttgtccaagttggtctcaaattcctggccttaagcaatcctcccacttcagcatcccaaagtgctgggattatagaggtgagccaccatacctagcctcacagtagacacaattttccttccaatttttccttcttttagttcatttcagcggctttgagggaagcacagagaagactttaccatatctttgagttaatgaatcaatgaatcttgtgtttctacgaaaataatattagtaactaccaaatgtcattgttattaacaaatctgttgttattatatatctttattctctctcaattcttaggaatgtgtatggcaaaaaaagagttcatgaatgagattataaatactttgcagtagaagtattttggaaagggtgtatctggtgatgttctccatctcatccttcaaatccattttctacccttccctgcctatgtgcctcatgaggctgtgctttgtgccctgtgaggctgacctctatggactccctcagcttgcctctcttactctttgacttcctgttgagttggctcaatggaaggcaccagcaggagaaccatggatgagagaaaattgaggtcagtgtacggtttaatctatggtttcycttcctacagggcagtgggttggccagggcatctttcctcttctgaaggccacagcagcccttcctactgctacagctacagctctctcccactgctggtagccacttccttcctttgctcctctgggacttgatgtggcgatggctcccttatcactttgttagcccctgggtgcttcaccattgctgtgggttactgtcagctctgcctttgcctttgtaaagcagtctctttattaagattatttcaattatccagttggagtatgccatctgcttccagctgggatcctagctcacacagcatgtgaggatagaagcactgaaagtcttatgagaacccttcttattgccgggatggaatctggtgatttctgtttgttcatacattctggtcattggacctcaaggttccaatatagggaagagatattgagtgttgttatgtgcacactcaaatatttaagaaggagacactcctattccacagatatcaaagtgctcatttacttcccactgaaagatgtcattttcttatatataacttataataaaaattccccaaatttgatgccttagagggaagaccaatctcagttatgagtaggcttaatcaaaattttattttatttaaagaaatgaaatctcatttctcttcattataggaaggaacattcctggtcgaaattctgtttttgtaaataggtctttatagtatttgatgtgctatttaaaaatgtgataatttaacctattaatagtacataaatggatgctacctaaattactgccaagtcaattaagtctataccatcatgtgtaatctttttcacagatagtacaaaagcataaaatatagtgtaatgaaaatgtgtgtttcacaagttctgaataaatgggttataaattaaatatatcacaatccactgacttttatatagtattttgatatagtttggatatttgtcctcccacccagatctcatgttgaaatgtgatccccagtgttggcagtggggcctagtgagaagtgtttgagtcatgagggtggatccctcatgaatggcttggtaccttccctgaagtaataaattagctcatgcaagagctgactgtttaacagagcctggcacctcctcccctctctcttgccatgtgacactcctgctccccttcaccttctgccgtgagtggaagcttcctgaggcctcaccagaagcagatgctggtgttatgcttcttgaacagtctgcagaactgtgagccaaataaatctgttttccttataaattacctagtctccagtatttcttyatagcaatgcaaaaacagactaatacatatctcatacttgaaaagtcagttgttgtttagactgcttgccctacttttaatacttcaatttctctgtcaatcatgtttatttattaattcattcaactcataattattaagtacctggtatgtgccagacacttttatgggtatctgtggtacaaataggagtaagacattgtctttgccttcataggggtcacaatctaatgagaaacatagttggtcaggtaattataataaaacatggcaagtgtttattcaaaggaaaggtttgatggaatactatctgtcagaggcacatagccttggggcaggagcctaaatgaattttaggagtccagggattctaagatgaggtcaaaatccaagcctatttcatagcccttgaaattaatttagcataaaaaaatctttaatgtttggactagtcatcttacaactggttaagtcatttacttaaaaaattagcaacccaaatcctgtattaaaactagtttgaataaccgacttaaccttcaactcttttagtttgcactatgactaatgctgcctccgtgatcatgggtgaggcagcattgtggagaatgcctgcccccttgaggaatcagaaactcagctttcagatgatggtgcaaagtgggatcacaaacaaaatgaaacaaaaaacaaagaacaaaaaggaaacaacacaaaaaccaaaacagaacaaacaaaacgatatgaagatttggtgggcactgctaaaccctttgtagatacttggttttagtcacgtttgctgagatcacatcgaaagcctctgaacctctgaaaggcattaaaagttgtcccactgcacctatgagccatccagagaaacgttaaataagttggtccagaaacmcttttgaagtcctccatcctttcaatacttttcttacttctttgcttctgagcgggaggtgcagcatttaaaatcaaagacattaataataaggtctcatttcctaagacagcatctttcccactgcaatgtgcatatgaatcatttggggtcatgttgaaaagcagatcctgattctgtagatagggggtgtagttggggggttcctgtgttcccaacaagcttcccaggaggtgatgctgatgctgctggtctgcagaccacactctgagtagcaacattctcagtgcaaatatagagcacagggctttatataacacaagatgtgggtgtggggttcctcatccttttacatttcccatcctaagacaatctcatagtaggcgagtctgatgatgaattggagttcaacaatctgtgtgtggaacaagtaaacacacagagcaaaacctggctcttcattttaattggcacaacttagcagttacatgtggataggcaaagtctctattttttgggaaatcagaatggggtaggggttagccaataagtgtatatgagatagataaatgcaatcttatcttttaaaatatgatttgaaaattttgtggtcataaataatttatatcctaaaaatattcttctttggtcagtcctttaatattttaaaagtagtgaatctaattgtttatggcctcatgtggctgtaagccataatatcttggtataaatctctagttatgattatatggatataatatgaatatgatgtgttaggcccaagaagctcgtggtattccattttctgaacaagatcaataaactctgggatccttactattaaaagcaagggaaaagcaacttgttttgtaaaagataattcaaacatgttagtaagttgtgttttcatttatgtgagatgagaattatctccaaaactctttcattgtaatgggagctaagctttataaagacaatgcatatttgttaattagactgcacagaacaaggttcagttatggattcttgattgcttggtaaaatgatggctcttcaaacctaattacatttgggtgagctaaagcacagttctgaaggactcaatatgttcactcccagccttcatcagctgtacaatttgctttcctgttagttttactttagatcttgaaattaaaagcattttgttatatcaggatggtgtgtctatgacttcagtgcaagtagaggaggagtgttctaccctggaataacacaaattagaggtgcctgtatgtatgtgtatggtgtgtgtgtgtgtgtgtgtgtgtgtgtgtgtgtatatgtattaaacttcatgctttttaaagcctccttctaaaatgccatctttcagatgtgcctatctgtgtcttattttggtagtttttcttttctttccccattcaaccgtctcttgggaattagaaaaggattcctaagatcaaaatccccaattttctggaaaagctttggcacttgttactctctccccacattttcctgcttcctaagattggtcaagggcaggggccgggcgcggtggctcacgcctgtaatcccagcactttgggaggccgaggcaggtggatcacgaggtcaggagattgagaccatcctggctgatggtctcagggtttcaccatgtctctactaaaagtacaaaaaaattagccgggtgtggtggcgggcgcctgtagtcccagctactcgggaggctgaggcaggagaatggcatgaacctgggaggtggagcttgcaccgcgtgagccgagatcggccactgcactccaggctgggcgacagagcgagactcggtctcaaaaaaaaaaaaaaaaaagattgctcaagggcagccataggccctctgggtgacaaggaacagagatttatatagtccatcttacaaaatatggataaagggtctctttctctctatatatatgtattttgtgtgtgtggtaaaatatacatagcataaaatttaccattgtaaccatttataagtgcataattcagtggcattaagtacattaaccatgttgtgcaatcatcaccatttccagaactttttcatcatcccagactgaaactctctacccataaaacatcatctccctattctccccaccccctaccccccattctacttttggtttctgtgaaactgcctactctaggtgccccatatatgtagaatcaaacactatttattcttttgtgtctggataatttcactttgtgtaatgctttgaaggtttatccctgttgtagcctgtgtcaaaattttattcctttttaaggctgaataatattccattgtatggctataccacgttttattattcattcatctattgatggacatttgggttgtttcccccttttgggtatcatgaatagtgctgccatgaacactggtgtacaagtatgtgtttgagctttatattcttttgggcataagggttaatagatatttattgaaagcctattatgagccagtacagtattttctagaagttgaggctattgaggaaatggacagcatcccagcccttgtataaacacaagaatgataaataagcaattctagataccaataaaatcctaccagaaaaagaaaatttaaaaatgggttagagtatctgacgttggggcaaaaagtgggtatgggcaacctcatgtaacataggaggaaggagagctccaggcaaaaggaatggccagtgcgaagcctgagctagaaagggcgccatggtggtggaaggggctcgagggtggtgactgggggagatgctgggggagaagaggtcagaggctaggtcagccagaccttctaggccacttaggtccaggtgtcacaaggctcaaagtttatgcaactttgaaggcccttgcagaggaagaataaaaacatatcttccttttgcaaactttacaaaaacatgcccatcccttgaaaacacattactaggtcccttccagagttttcaggggctccaagtgaggggccgtggctcttaagcttcagtgggtccacagtgatctgtctctgagtgctgtagcaagagtctggcttttgtttagatgatgaaaggaaactattgggggattttaagcagaggagttacacaatctgatatgtagtttaacaagatggttatggttgttgtgtgaagaacgggctgtagagggcaaagaggaattaggggatgagaggaggctggagacctgttgcaggtgagaactgaagggtgtgattgatggctgtgccagtccggatggtgagaagtggtcggatttcacaacagtctctgaggagagaattcaaaattggtactgctaatgatggcataatagacaaacacactgtgatattgatgaggaggattcttcctttcctttcatcttagcctcctcaagcctctggtctcaccattatattgtagcaatattgtcaatcatttgagtttaggagctaagaggtccctcccaactatattgaagctgtatgatgttcaccttggctacagtcaacacttatttctcaaatgaagttacattgccttgtggctaaaagctttgacactgaaaaatgtattctctgtaaaagagatgtcagtgtatcatattaaaggtcagagatgccccagggtcagaatctctgtggtcctagccaaacattttgtaagaaaaaaattctcaaccactgtgagattgtttcagattcaggagcaaagcaaccatttgtcatttgcaatttatgatattttgcttcttcaggcaccagcctgatggcctttcatctggaccatgaaatatcatgactgattggttttttgaggagggagaatgttcacacttttcaaaccagcacatctgggggctaagaaggaagctttgcttgggaggaatcagccagttgtttagtgtggtggctttatgttttctgagaacaaaagcaatatggtatttgtgtgtgtgtgtgtgtgtgtgtgtgtgtgtgtgtgtgtaaaatcaatggagggtcttgggagcaggggagacagagggagagaaatacagcggaagagaggatgacagagagagagagacagacagacagagacagaaagaacatacccatactgtgtaaacacatttctaggaaacagaaacggaaagacaggttgattgccttgagggagcgagttggtatagttaaatgatagggtttgggggtttgaatcctcagagaagctcaggtagaggcaatgatagttgggtgtttgctgatgagcagaaggctaggtaactgagtgctagaacctaagctctccctgctcatagcagtttttctttgggtctcaggatgtcaggcaagaagtgaggatggctgggagctagggagtggcatgtcatccctggggagatgagaaagggtcagacttggtgtaagttttggagattgagctcacagatttgtgtgtgtttgtgtgtgtgtgtgtgtgtgtgtgtgtgtgtgtgtgtgtcaggttgtatgtatattgtggcaaaaagagaggactcacagaggaggccaaagtattttggcttgagcagtaggtaaatgatgtgcaatttgctcaaatagggaacccttgtttgggggtgggaaagtaagatttggtttgggagcgtgttaagtttgaaatgcttattagacattcagatggaaatgctgagagggtggttggctgtatgagtcttgtgttcagggaggttcaggagttcaactggggaatcgttagtccatggatggtgtttaaggccatgggatgaatgatatcactttggtattgagtgtaggtagtatagacagagacaagattcaagttgataggcagaagtttctagtattctgtaatcaggttttcattccctgtatcaatatagccaattttataaatatcccttctgacctctccaaaaatcttataaagatataaagataaataaataatatgttcatgtctcaagggaatttaggaataatgagtttagcacatgagtgtccgtacataataaaaaactcttagcaaactagaaatagaagaaagttattttattagttcacttacatactgctgataaagacatacctgagactgggtaatttataaagtaaaagaggtttaatggactcacaattgcacayggctgaggaggcctcacaatcatggtggagggcaaaaggcacatcttacatggcagcaagcaagagggagaattagagccaagtgaaagggatttccccttgaaaaaccatcagttcgtgtgagactttaatatggttgctagatacatgatgaatataaaaaatcaatttcatttcaacagtcccataataagtagaaaatctaatttttaagaaaaaatacaatttcaataataacaaaatccgaaaagtacttataaataaatatagcacaaacttgcaggacctttatgtgaaaaaataaagtttagtacatttacagattgtttaactccatgtatctctacagaaggttgcctttgagagtaaataaagcaaatatcttccaagcaaacatgaactatgaatggaaaagatattaatgctcaatctttcatcattatgtccacctccaaatacatatttcatatcctaaaaatggtaaaaatgctatgtaatgggatttttttgtgtgagaaggagggattgcttcagagaataggttaaaccaaactaagcagaatttttaaacagcttttttgagagatgatttaaataccacacaatgaatccatttataaagtgtactgttcaatggcttttagtggtgtatccacaaagttgcccataaagtccatccacaaagccatgttgcccaggcatccttcatcaaaatcaattttagaacacttttttaagcccaagaatcccccctactcccttacccaccccctcccaataccctatctttccagccttaggcagtcactaatctactttctatctatatagatttttaaattctggacatttcgtataaatggaataacacaatacgtggtcctttgtgactggcttcttccacttagcataatgttttcaaggtccttctacaccatagtatattatcagtattccaggtcttttattgctgagtaatatttcaatgtatagtagaattttataaacatttaacactttgcaaagatgtgagtcagctctaagtaaaatgatgtatccataattataaattagattgttttctaactaaaattcatattgctccactaaaaaactttttatagaaaattcagataaaatgcttacacaaagcatacaactgtgcattaatacaaatacaataagtgcacttcgaaaaaactttttatttatttttttgagacagagtcttgctcagttgcccaggctggagtgcagtggtgtgatcatggtttacttcaccctttacctctcaggctcaagtgattcccctccctcagtatcccaagtagctggaactacaggcatgcactactgcactcagctaattttttgtagagatggtggtctcgccatgttgcccaggctggtctcaaactcctgggctcaaggagtcctcccatgttggccttccaaaatgctgggattataggtataagctactgcacctgrcccaaaaacaactctttcagaaaaatgtgtggcttcttgagatacaaaccctagcaaagtatcttttttaaaattattattatactttaagttctagggtacatgtgcacaacgtgcaggtttgatacataggtatacatgtgccatgttggtttgctgcacccatcaactcatcatttacattaggtatttctcctaatgctatccctccccaacccccccaactcccgacaggccctggtgtgtgatattccccacccagtgtccaagtaatctcattgttcagttcccacctgtgagtgagaacatgctgtgtttggttttctgtccttgtgatagtttgctgagaatgatgctttccagcttcatccattttcctgcaaaggacatgaactcatccttttttatggctgcatagtattccatggtgtatatgtgccacattttcttaatccagtctatcattgatggacatttgggttgtttccaagtcttttctattgtgaatagtgccgcaataaatatacgtgtgcatgtgtctttatagtagcatgatttatgatccttgtcaaatggtaattctagttctagatccttgaggaaaccccacactgtcttccacaatggttgaaataatttacactcccatcaacagtgtaaaagcattcctatttctccatatcctctccagcatctgttgtttcctgactttttaatgattgccattctaactggcatgagatggtatctcattgtggttttgatttgcatttctctgatgaccagtgatgatgagcattttttcatgggtctgttggctgcatagatgtcttcctttgagaagtgtctattcatataccttgcccactttttgatagggttgtttttttcttgtaaacttgtttgagttctttgtagattctggatattagccctttgtcagatgggtagattgcaaaaattttctcccattctgtaggttgcctgttcattctgatggttgtttcttttgccatgcagaagctctttagtttaattagatcccatttgtctgttttggcttttgttgccattgtttttggtgctttagacatgaagtccttgcccatgcctatgtcctgaatggtattgcctaggttttcttctagggttttcatggttttaggtctaccatttaagtctttaatccatcttgaattaatttttgtgtaaggtgtaaggaagggatccagtttcagctttatacatttgactagccagttttcccagcaccatttatttaatagggaatcctttccccatttcttgtttttgtcaggtttgtcaaagatcagatggttgtagatgtgtggtgttatttctgaggcctctgttcttttacattggtctttatatctgttttggtaccagtaccatgctgttttggttactgcagccttgtagtatagtttgaagtcaggtagcgtgatgcctccagctttgtgctttttgcttaggattgtcttggcaatgtgggctcttttttggttccatatgaactttaaagtagtttttcccaattctgtgaagaaagtcattggtagcttgatggggatggcattttgaatctataaattactttgggcagcaaggcgattttcaagatattgatttttcctgtccatgagcatggaatattcttccatttgtttgtgtcctgttttattttgttgagcagtggtttgtaattctccttgaagaggtccttcacatcccttgtaagttggattcctaggtattttattctctttgaagcaattgtgaatgggagttcactcatgatttgkctctctgtttgtctgttaatggtgtataagaatgcttgtgwtttttgcacattgattttgtatcctgagactttgctgaagttgcttatcagcttaaggagattttgggctgagatgatggggttttctaaatatacaatcatgtcatctgcaaacagggacaatttgacttcctcttttmctaattgaataccctttatttctttctcctgcctgattgccctggccagaacttccaacactatgttgaataggagtggtgagagagggcatccctgtcttgtgccagttttcaaagggaatgcttccagtttttgcccattcaatatgatattggctgtggatttgtcacaaatagctcttattattttgaaatatgttccatcagtaccttgttttttgagagtttttagcctgaagsgctgttgaattttgtcaaaggccttttctgcatctattgagataatcatgtggtttttgtctttggttctgtttatgtgatggattacgtttattgatttgtgtatattgaaccagctttgcatcccagggatgaagccmacttgatcatggtggataagctttttgatgtgctgctggatttggtttgccagtattttattgaggatttttgcatcgatgttcatcagggatattggtctaaaattctcttttttttgttgtgtctctgccaggttttgatatcaggatgatgttggcctcataaaatgagttagggaggagtccctctttttctattgattggaatagtttcagaaggaatggtaccagctcctctttgtatctctggtagaattcagctgtgaatctgtctggtcctggactttttttggttggtaggctattaattattgcctcaatttcagagcctgttattggtctattcaaagattcagcttcttcctggtttagtcttgggagggtgtattgyccaggaatttatccatttcttctagattttcaagtttatttgcgtagaggtgtttatagtattctctgatgatagcttstatttttgtgggattggtgctgatatcccctttatcatttttttattgcatctatttgattcttctctccttgtatttgattcttctctcctttcttctttattagtttggctagcggtctaccaattttgttgatcttttcaaaaacaagcttccggattcattgattttttgaaaggttttttgtgtctctatctctttcagttctgctctgatcttagttatttcttgccttctgctagcttttgaatgtgtttgcttgcttctctagttcttttaattgtgatgttagggtgttgattttagatctttcctgctttctcttgtgggcatttagtgctataaatttccctctacacactgctttaaatgtgtcccagagattctggtrcactgtgtctttgttctcattggtttcaaagaacttctttatttctgccttcactttcttatttacccagtagtcattcaggagcaagttgttcagtttccatgtagttgtgtggttttgagtgagtttcttaatcctgagttctaatttgattgcactgtggtctgacagacagtttgttgtgatttctgttcttttacatttgctgaggagggctttacttctaattatgtggtcaattttataataagtgtgatgtggtgctaagaagaatgtatattctgttgatttggggtggagagttctgtagatgtctattaggtctgcttgttgcagagctgagttcaggtcctggatatccttgttaaccttccatctcattgatctgtctgatattgacagtggggtgttatagtctcccattattattgtgtgggagtctaagtctctttgtargtctctaaggacttgctttatgactctgggtgctgctgtattgggtgcatatctatttaggatagttaggtcttcttgttgaattgatccctttaccattatgtaatggccttctttgtctcttttgatctttgttggtttaaagtctgttttatcagagactaggattgcaacccctgccttttttttgtttttcatttgcttggtagatcttcctccatccgtttattttgagcctgtgtgtgtctttgcacgtgagatgggtgtcctgaatacaacacactgatgggtcttgactctttctccaatttgccagtctgtgtcttttaattggggcatttagcccatttacatttaatgttaatattgttatgtgtgtatttgattctgtcattatgatatttgctggttattttgcccattaattgatgcagtttcttcatagcattgatggtctttacagttttgcctgtttttgcggtggctggtaccggttgtttctttccatgtttagtgcctccttcaggagctcttgtaaggcaggcctggtggtgacaaaatctctcagcatttgcttctctgtaaaggattttatttctcattcacttttgaagcttggtttgactggatatgaaattctgggttgaaaattcttttctttaagaatgttgaatattggtccccactctcttctggcttgtagagtttctgctaagagatctgctgttagtctgatgggcttccctttgtgkgtaactcaacctttctctctggctgcccttaacactttttccttcatttcaaccttggtgaatctgacaattatgtgtgttggggttgctcttcttgaggagtatctttgtggtgttctctgtatttcctgaatttgagtgttggcctgccttgctatgttggggaagttctcctggataataccctgaagagtgttttacaacttggttccattctccccatcactttctggtacaccaatcaaatgtagtttggtcttttcacatagtcccrtatttcttggaagctttgtttgttcctttttgctcttttttctctaactttatcacttcatttcattaatttgatcttcagtcactgataccctttcttccacttgattgaatcggctattgaagcttgtgcatgtgtcacaaagttctcgtgccaaggttttcagctccatcaggtcatttaagttcttctctacagtgtttgttctagttagtcgttcatctaatcttttttcaaagtttttggcttccttgcgatgggttcgaacctcctcctttagctctgagaagtttgttattaccgaccttctgaagcctccttctgtcaactcgtcaaagtcattctccgtccatctttgttccattgctggcaagtacccgcgctcctttggaggagaagaggcgttctgatttttagaattttcagcttttctcctctggtttctacccatcttgttggttttatctacctttggtctttgatattggtgacctacagatggggttttggtgtagatgacctttttgttgatgttgatgctattcctttctgtttgttagttttccttctaacagtcaggtcctttagatgcaggtctgttggagtttgctagagttgcactccggacactgtttgcctgggtatcgccagcggaggctgcagaacagcaaatattgctgcctgatccttcctctggaagctttgtcccagaggggcagccgcctatatgaggtgtctgtttacccctactgggaggtgtctcccagttaggctacgtggcggtcagggacccacttgaggaggcagtctgtccgttgttggagctcaaatgctgtgctgggagaaccactgctctcttcagagctgtcagactgggacgtttaagtctgcagaagttgtctgctgccttttgttcagctatgccctgcccacagaggtggagtctagagacagtaggccttgttgagctgcagtgggctccacccagttcgagcttccctgctgctttgtttacctactcaagcctcagcaatggcggatgcccctcccccagccaggctgctgtctcacagatcatctcagactgctgcgctagcagtgagcaaggctccatgggtgtggraggtgcacagccaggtacgggagagaatcaccttgtctgccggttgctaagaccttgggaacagcacagtatttgggcgggagtgtcctgtttttccaggtagtctgtcatggcttcccttggctaggaaagggaaatcccctgactccttgagcttccctggtgaggtgatgccctgccctgcttcggctcaccctctgtgggctgcatccactctccaaccagccccagtgagatgaaccaggtacctcagttggaaatgcagaaatcacccatcttctgcattgatcatgctaggagctgcagatcggagctgttcctattyggccatcttggaaagccctcacaaagtatctttttaaatgcagttggaggtcttttgtgcctctttttgatgaatctcaatttggaaaaacaactcttaaatgctttctgtatttttcattaaatggaagggtataggaagggtataggcccaggtgaatgaatgaaaatgctcttatactgttattttacacagaaaccagagatgatatcacaaccagttaagcttatttcacatttgttgattgtagaaaatttcacttctctcccactctcagttctggtgggctgactccatgctttatgccgttgctcttggttctaaatgtccaggctcccacttgcaatttggatttgccattacaggtgtctgctccttatgggtctggcacccttgttagcagaagccttgggagtcagcagaaggctcccaatgaataaccaagctggattaccagaggaaaaaaacatagcaaaagctggacaaaggtggtgayccagagaagaatcaggcataagagccagcccaccaaagaagcacaacaggaacaaagcagttagatgtgttctgtgtgtgcaggcgacagaagcaagcaacagaaaccagctctgcataacttgtgcagaaaataaatgtttagaaaggatgttggggacctaacagcccccttcctaacagaaggaagtggtgaacatcagtctttggaaaagacagaagcgaaggcaactgyaggcatctaagtaccaggattcagtggacagttcttcaaggacccacagctggaatgaacaacctccaaccatgctcgtattctgagccactcaattgaagattcataggccctcctctggaatcagagggagagtggaggagagagagaaataggagaacaaggaaaatgtaagctatgttgctggaagaaaagagaatgatgacagatagataaaaagaacagctatcccctaaaggaagacacagacaccaccctactgacacccagagatgacctgaacgagtacctagctgtaggctaggccaagatgtttttcaaaaattacttttggatttttttctaatacagaaagacaggacagacctaggcccgaagatctacaccagaggtcatggttcaataattttattctaaaagcaaaacgaaggaaacaaacaagcaagaccttttaaacgaatgtaacccagctgggcgtggtggctcacgcctgtaatcccagcactttgggaggtcaaggcaggtgtatcacttgaggtcaggagttcgagaccagcctggccaacatggtgaaaccccatctctactaaaaaaaatacaaaaataagctgggcatggtggcacacacctgtaatcccagttactcaggaggctgaggtgagagaatcacttgacactgggaggcagaggttgcagtgagccaagatgttgccactgcactccagcctgggcattggagtgagaccctgtctcacacaaatagcaacaacaacaataaggtaaatataaccagaagcctatagctcaggataggttagttgtaaaatataaacaaatgaggtaatatgcatggaattattgggaatacctttgaaaatgatggctttggttttaaagtaattgagctacatatccctctgccaacaactagagagaaaagatggaaactcactactaatctgtttataaaactgtcatttgcatatagaggaaaacttaatttgctgtttctttctagcaggagggcttacaattagctcatcccaaagagaaaggaacaaaacacattcttgttttatcccactggaaaatatcatgctctctgttagaagcctgtcaaagcataactcagacttttagtcagagcacagctgaagcttaatcatatgtattgggagattaattatgtatagattgtgtgtctgggcaaaggcaaagcagagtgcaggatacataaaaggaaaatccattgtctggggcacatagagtctgtctgtctctgtcttttttttatttggtctgtgggcaaactgattagccaaccaacactatcaagaaggtatatgattagggaaggcagttttagttatatgagggcttccagagagtgttgtgatttcaggttggagggtatacgatgttatttgtctgctctctttccattggtgcctccaccttggttagacaaggtctgcaccattttctgattgtgtcttaagacctgtccctagaccttgactttccaggtagcactaaggtgcagattccatgtgatcatcaacagctgggacctatcttgatactctcaaagcttaggtcatcactgattttcattcctaaaattctatggggtggaaaagtataaaccagagatcatgggtaatatcattgcctcaagtctgcttagcactggaatggaagatttggcttgcaatcgatgaagaaaactcacctatactttagggacgtagaggtaagcttaaacacaggtctacatttgtggagggtaaaagaactgcccttttcactattaagtaggattttagttgtaggtttttcataggtactctgtatcatcttcagaatgttctcatttattcctagtttcctgaaagtgttttttttgtttttcctttttttttcaatgaatacatgttacatttgtcatatacttttttctagatctaatgagacaatcacatggattccctttgctaatattctgtcaggcttctttatctatgttcgtgaacaaatattgttgtaattttttttcttataatgcctctatcaaattttggttcagagttatgttggcmtcataaaactagctggaatggggtgtcttcctcttttattttctgaaagagtttaggttgaagtgctattgtttcttccttaaatgtttgatagaaatcactagtgaaatgatctggattgaatttttcttggttgaaaggtttctaattacaaattcaatttatktaatagatatagaactactcagatatttatatttctttttgtattctttcaataagtcgcatttttcaggaaatttttggtaatatcatctactttttaaaatttattgacataaagttttcataatgtcctcttaatctttttaatgtgcataggaatctatactgatgccccctttcattcctgatatttgttttgtttcttttctattaattttaagagatttattaactattccaaagtaccaacttttgtttttattgacttttttattgtttatctttcattttcattcttttttttatttttcttctatgtattttgggtttaattttttctttagctagcatcttaaaaacttaggccattcaaacatctttttccttttctaatattaatatttcaagttatacatttccttttaagtacattagatgcatgccacaaattttgatttgttttattttagctgtcatttagcttgaaatattttatttttttaaaaaaacttttgatttcaggggtacatatgccagtttgttacataggtagacttgtgtcatgggagtttgttgtacagattatttcatcacccaggtattatgtctagtacccattagttgtttttcctgatcctctccctcctcttaccctctactatccaataggccccagtgcgtgttgttcccctctatgtgtccatgtgttctcatcatttagctcccacttataaatgagaacatgaggtatttggttgtctgttcctgtgttaatttgctatggataatggccttcagctccatccatgtccctgcaaatgacatgatcttgttcttttgtgtggctacataatatcccatggtgtatctgtaacacattttctttatccagtctaccattgatggatatttaggttgattccatttctttgctattgtgaatagtgctgaaatgaacatatgcatgcttatgtttttataatagaatgatttctattcctttgggcatatattcagtaatgggactgctgggtcaaatggtgtttctgtctttaggtctttgaggaattgccacactgtcttccacgatggttgaactaatttacacttccaccaacaatgtataaggattcctttttctccacaacctcaccagcatcttttattttttgactattttataatagccattctgaatggtgtgagatggtatctcattatgtttttgatttgcacttctctaataatcagtgatgttgagcctttttcatataattgttggccacatgtatgtcttcttttgaaaaatgtctgttcatgtcctttgcccacttcttaatggggttgtttggtttcttttcttgcaaatttgtttaagttccttatttatgctggatattagacctttgtcagatgcatagtatgcagaaatttctctgattctttaggttgtctgtttactttgttgatagtttcctttgctatgcagaagctctttaggtttaattagatcccacatgtcatttttttgcttttgttgtcttcatcataaaatctttgcctgtgcctatgtcctgaacatattgccaggttgtcttctagagtttttatagctttgggttttacatttgtctttaatccatcttgagttaatttctgtatatagtataagaaagggatcaagttttaatcttctgcatatggctggccagttatcctagcaccatttattgaatagagatttctttccttattgcttgttttgtcaggtttgttgaagaacggatagttgtaggtgtacagtcttattcttgggttctgtattctattccattggtctatgtgtctgtttttgtaccagtaccatgttgttttggttactgtagccctgtagcatagttcgaagtcaggtagtgtgatgcctacagctttgttctttttgcttatgattgccttggcatttttggttccatatgaattttaaaatagttttttttctagttctgtggagaatatcaatgatagtttaataggaataacattgaatcggtaaattgttttggacagtgtggctattttaatgatattgattcttcttatccatgagcatggaatatttttccacatgtttgcatcatctctgatttctttgagcagtgttttgtagttctccttgtagagatttttcacctttaacacagttagctgtattcctaggaattttattatttttgtggcaattgtgaatgggagtgcatttctgatttggctctcagcttgactgttgttggtgtataaaactgctagtgatttttgcacattgattttgtatcttgagattttgctgaagttgtttatcagcatcagcttcagaagctttttggctgagactatgtggttttctagctataggatcatgttgtctgcaaacagggatagttcaacttcctgtcttcctatatggatgctctttatttctttctcttgcctgattaccctgcagggacttccactactacattaaacaggaacggtgaaagagggcatccttgtcttgtgccggttttcaaggggaatgcttccagcttttgcccattcagtatgatattggctgtgggtttgtcatagatggctcttatgattttgagttgtgttccttcaatacctattttactgagagtttttaacgtggatcaatgttgaattttatcaaaagcctttctgtatctattgagataataatgcggtttttgtctttaattctgtttstgtgatgaatcacatttattaatttgcatatgttgaaccaaccttgcatcctagggataaatcctacttgattatgatggataagctttttgatgtgctgctggatttggattgccagtatcgtgttgaggatttttgcattgattttcatcaagaatattggcttaaagttttctttttttgttgttgtatctctgtcaaattttggtatcaggatgatgctggcctcatagaaagagttagggagaagtctctcctgctcattttttgggaatagttttagtagaagtggtaccagctattctttgtacatctggtagaatttggctatgaatccttctggtcctgggcttttttggttggtaggctgtttattactgcctcaatttcagagctcattattagtctgttcagggattccatttcttcccggatcagtcttaggagggtatatgtgtccaggaatttatccatttcttctacattttctagtataggtgcatagaggtgttcataatattctcttggtggtttgtatttctgtgaggtcagtgataatatcctccttggtgtttctgattgtgtttattaaatcttttctctcttctttattagtctagctagcagtctatctattaagtttttcaaaaaaccaactcctggatttgttgatcttttgaatgctttttgtgtacgtgtgtgtgtgtctcaatctctttcagttcagctctgatttttgttatttcttgtcttctgctagatttgggattcgtttgctcttacttctctagttcttttagttgtgatattaggttgttaacttgggatctctctaaatttttgatgtgggcatttaatgctataaatttcctcttaacaatgacttagctgtgtcccagagattctggcatgttgtatctttgttcccgttagtttcagagatcttgactactgccttaatttcattatttacccaaaagtcattcaggaggaggtgattcaatttccatgtaattgtatggttttgagtaaatttcttggttttgatttcaaatttgattgctctgtagtctgagagactgttacgatttcagttgtattgcatttgctgaggagtgttttactttttatgtgactgattttagagtatgtgccacgtggcaatgagaggaatatatattctgttgtttttggttgaagagttctgtagatgtctgtcatttccatttaatcgagtgctgagtttggatcctgagtatttttgttaattttctgtcttgatgatcagtctaatattgtcagtggggtgttaatagtctcctactattattgtgtggggacctaagtctctttgtagggctctaagaacttgcttcataaatctgagtgctcttgtgttgggtgaatatatatttaaaatagttacattatcttgttgaattgaaccctttaccattatgtaatgcccttctttgtcttttttgacctttgttggtttaaagtctgttttgtcaggaactaggattgcaacccctgcttttttctgtttttcattcacttggtagatttttctccatacctttattttgagtctatgtttgtcatttcatgtgaggtgagtctcttgaagacagaataccaatgggtctttcattttgataatttcttttgacctgtgtttgagttcagtggtgtttttcttctgtactgtccagtctgctgttaatttcattcaatgaatttttggttccagatactttagctttctgttctaggatttcttttttgtttttttgttagatttcatatctttcctaagttttcttatctttttattcatcatatccatatatgcctatagattccttgacatacttaatataggtattctaaagtccttatttgctaatttcaatatctgagtcatctgtaagtctgtttcagtttactatttttttctttgtggctacaggtcacattttccttctttatatgtttagtgatttttaattatatgcygtacattaaaaataatatattgaggagacctgggatttatcttcctctgaagactgttgaactttcaggcagttaagttactggtggcctcccttaactttgtggagggttgattttgggctttgttagactgtcctaaactgatgttgctcttaggcttagggtatactttcttctaatgtgtggaccttttgggggtttaatgggaagtccaaggtgttcaacaagtccctttatataggtaattggcaagaacatatgtaattatattatgggggagtcttgccacataggctactttctattccatttaggccctaggcttggcttgtttatttgttttaatcacatatgtttttaagaaacatttataagaatatgaataaaataaatattacctgaatagaggagatcccgcatcttaaaaatcaaatatagatagtccctgactgatgatggtttgacttataattttttttactttatgatggttcaaaagcaatactctttcagtagatatcatactacaagtacacatataaccactctgtttttcactttcagtataatactcaataaattacatgagatactcaacattttgttataaaatattctttgtgttagatgattttgcccaaatgtaggctaatgtaagtattctgagcatatttgaagtaagctagcctaagctatgatgcttgagaggttaggtgtattaagtgcatttttgacttacaatattttcacttatgatgggtttattgggatggaactctgatgtaagtaaaggagcgtctgtattttctgacccaaatagaaaacttatcatgttcaaatttggtgggtgaatgcaagcccactgctctttcaattgctttatgttttatttgtaatattttcaaacatcttaagcccattatctattaaaagacactaagatacttaaattttcttctgaaaatatgtgtatatctttctggctgttaattaccaattttggtgattattgataagctatatattggtaggctaaatgccaatctaatataataattggaaaagttctgagtaggcaaaagttgcctccatacttgtttggccatggttggcatacgtatttagttttttaatcatctctttttctttttactacatattaacaaaatgtctcctcattatgttagcagaatcctgcctattatttaggcacagagttattcagctgtaacattgcagtcaactaggtgtatttctactttagcatccctatcatcattgttttaattataacatttgttcttacaaagatgttcatacatttttgacaggaacattttcccatcagacttttcttagtccatactgtctccaattatgcctggacacaagtgggcattttgcgtacctcttctccagttgtgctagtcaacacttacctatgccttgtccccctttgatgactgtttacctttaccacatttatagaaatttttcaaatgatgatggaaaactgccacattaaatggtatcctaagagctcttaaagaatgctaaatttcttaataaaatatcgaaagataccaaaaacaaaaattttcaacatcccaaattgagacaaatgacctattgttaccttctagaargaattttcactaattatagtcaatggagttgggtagagaaaagtagtcagggtcttaaccatgctctgcttcaggaaaagagaacagcttcacattccttaaagaggtagagcaagagttcctcacttcctcacgctctgctccttcatctgtattattcaaaaaattgggcagctttatctctattcatttcaaggcatgtattctatgatcttgtattatactagaagaaaatagggaggaattattgtttgtccactgtaatcttggagtgtagctaatgagaaaagtagtccaggacgaggaaaagagagtagcgtagatggaggcaccttaatgaagatagggaacatgggatggaagagcaaatttggatgaaatatgattacttcagttttgtatatactgtgttttactgcaatcattgagacttgaggcacttcacattttatcatcgttgagacttttcatatagaatcaggtgaaattattggtaggaacttggccagttgaatagactttaaggtggaagtgatatggatttggaaaacatgtcatagttgaaaccatggatatagatgagaaaagagaaaagggcttgcataaatccccaagatgcaccaactttaaatttaggcaaaggaaaaggagcaggctgagttaaggagggacagaaagagagatggaaacaagtcaaagagagagtgatctctcagaatccaagggagaaaagtgtttcaagaaagaaggaatagatcacagtgtgaaatgcttcagattaagtaggtatgtaagttgtgtgtatgcattaagcaagtattaaataagagtaagtaagatgaatgctgggaagtgcttactgtaattgagtgttatttagtcattgattatctttggcaaaaacatttcagaggaatggtggaggtaggagagattcccatgagttgagtgcatgagagggccgaaataagggtcacaaaagtctttctagaaatttcacttttaaagtaaaataaggggcagtagctagaaggttatgcaggatcaagggaggtttttattgtttgtgagaaagacttgaatacatttatatttttgagggaaggaagcaaagagattgacaggagagagaataaacagcatgttcattctctgaacctagagaggaacaggtacatttattgacaaagagacaacttactctgtgattcacaggacccaacttagagatttttggatccttgagttctcaagtgaaattaggttggtgctagggctcatagagggctttaacgtaaagtttgacttggctatagaatttttgccataccaggttgggcgcggtggctcatgcctgtaatcccagcactttgggaggccgaggctggtggatcacctgagctcaggagttgaagaccagcctggccaacatggtgaaaccccgtctctactaaaaatacaaaactcagctaggcgcagtggcgggcacctgtaatccaagctactctggaagctgaggcaggagaatcacttgaacccaggaggcagaggttgcagtgagcagagatcgtgccactgcactccagcctgggtaacagagtgggactctgtctcaaaaaaaaaaaaaaaagaatttttgccataccaagaatggggttgacttsgtcctgcattttaagacagaggtttcttctgcctcaagcccctaacttcagcctgaaatcatcaacatccatcacagtagcggaacaacctagaaggaattgtttcattctgaaaagactttgaratgattaaaatatgcaatacaaatgggtgaaaagaaataggtgataaaatcaagacaaatgggaaattaagtttgggaatattaattaaagctgggcaaaattagtacccgataaactcatagtacactgttctgttcagctgttacagggagcctgcaaattgcctctaagcttgttagtggcctgagcaaggaggggggaaaacaattggttacaagattcagaatgtctaaatgacgaaaacaaactagtcattaaggaggccacacagcttttcttagtagtgaggcttgagagaagggttctttcatggatgttctgcatttccacaataaatacacaagcaggttttatagggattttcttacaatacccctcactgaaagtggacggcaacatgactgtccacatcactttttgtagaatgaagtgtcagcaagggccatgtaataggtactaaatacttaaaagattttgatcattttaatgggtcttattacttacactgaattgttcctcaaacaacatctgtccagtgttccactcttaattttcattttctttaaaactcctgagatgaagatgattcccatttcactttagaatggatttaaaaattgtctcaatttcaattgcctttctcattgtttaccatgctttatattcaaggtgagcgaagcaaagcacttgttactaggagataacagcgttgggtttcatttataatcgttaagattttcagatagatgctgttttggggggtgcatccttatctaggagaggtgatcaatgagcctttgctagtgcccagcagagacaaggtacagacagaggaaattaaaattctgggaagaggaaatcattgttagtcccaatgttatagtgttgttttcttttctttttttctggccggaggtaagccaaaatttaattacactcctgatggtttgggcttgataagtgtaatggatgataagtcataggtggctgaaaatcaatatgttttttcagcagataataacatgtttgctttggaatattttatctaagtgtgagatacaacgtgcaaaggctttcatattcctttgaggtgagagctctggaaaatgcaatagggcaaaggcaaactcacgtttagggcttagatatgccctggtagacccttgtctttgaataattattttagaaatcttcatgcaccaaaagctttgcctctggttactgggaacaaggtctttatgtgtctgaaactacattagctttctgcttatgctgcttctcatgagttttccagattatgtattgccaggctgtggctgtgcttcctgccgagaacaccaacttaaatgaaagtgtttttattttggagctgtaccagattagagggaaggtattctcagaaatagctgttgcagaagtgagaagagcaaagatttacaaagagacaagtggtatgagaacaagagcagtcaatgtgtagagcaagaagccatcagaagaacttggatctggttccttccctagccagatgactttgttctcttctgttccatggatatagaccttgtctttcaccaggtgggagtaaattgccacttcccttttaagaagagaacccatgtataccttagatcccaatcactgagttttgccatcgaaaactctgacttataatatgatgtttagaaagtaattgaacttctgggcttcagatgcctcttgagtatgatctagactaataatattgggtttttcttaccccaatgggagatgcagagctactcaargcatggaattctaaagctcaaaagtcatctggcttagtctagccccaggtatgtgagctcaggggtatgagctctccatcacaattggacctgygctaaaaaacaaaaacaaaaaaaccaaaactctcctcttctcccctagggtaaagaaacttctctggttgattattagactatcttattggtcttatgcaagtatatgctctttgttataagaaatatggttactggagctggaagtaagataatatagatagtatcctttagtttgacaagatgcttcatttattagctgtgtgacttggtaaattaccttgatcattctgaattgttcatctgtaaaatggaataataatcctacctctctagwttcatgcaaaaggagagagtttttcaactcatatgtgctaatgttactttatatttggttcacatttattctgggaactaaccacttttgatcaatgactcacatttgctttgtggtgcaccaagatatccaggtgcctctggctacatctggggctgtccagttaatttcttcccacctaggatatatatggtttggttttgattcaaatgatgcagattatgtttaaactcctttctctgaacgaagcccgggcacacaggcaggcaggcccagagatacgtacagatgggtccattttatctcatgggtggtcagagcagaacagtcacacgaggtgtatagatgagtgatgtctcacctgctcccaacacatggctgttccacagcaggtaacccaaagctcagctctgtctttggacattaactcaaagaaaggtctcaaatgtgtgttaagaattgagaatactaccctcagggcataagaggtcataaactttttctgtgccatggatctctttggcagtttggtggagcctatggactccttgaatcctataaaatgtctaggattacaatttttttaaagaaggaattatattgaaaatcattaaaatattttaaaaacaaatctgtgytattgtaaggcatgtattttttattcattaactaaatactaagccaaacagcaaatagaataactaatttaaaagctgtggtgtgcataatagttattttaacatatctacaaaaagtataatataatatgaaagtgtctgtggtttccgttggtgacaaggtcacaggtactgctaatcctcctgaggtttgttatctacaattgcaactgagagaaatgctaaaattccattcgagattaatgaaagtaaatatataattttttactatccaagttcatagattcccctggattccatcccaggtaaagatcccagagttagacaataaggaaaacagaagaaaaggtaagtataaggaaaatggaaagtcttatttttcaatgtaaagttatctgacagttaattatatttcaaacaaataacattaaatgtgttccagtttagtgattagcacagctttttacatagttttctctcaataaatatcttttgaagaaattaacaaaaacattgttttgcattgtaattctccatctacttgtctttttcttccactggtctatgagctcattgaggacacattaactgcccacacatcatttgtacagctttttaacatcctgttagataggaaagagagagctctcatgaatttctggtagaattctgttcaatagctgtaattggttatttattataagtcagagatataatgtcatttaatactcacaataagcttagaggtatacattattccaactcaacgatgcaattcaaatgttgttgaggrtttatgtgtggtaagccagggcaggcattgcactaagcacaatgtcacagtggggttgtagagatgaaaaggattcctgcctgcagataacatacaatccagtarggtggaaagacatggatatgcctaattatgagacaaggtaaacaagggcaggctgggggatcagcatgacaaaagacactagggcaggatggagttttcatttttacaatgggtttttcagagaaagctgaatggataggctgaaatttgaactgcagagcgaagtattttagacttattatatgggtagttcaaaaatatcactgtttccttcaaaccacataccaattgtatatctcattccaaatcactgtacactagatgataatgattttgtaggagcctctgagaagaccattatgaattttgatgttttcagattaagtttaatcagcacccctctccccatccctaatgtaagtgttgctcaargcattcaggtgactgggtttctcacaagaacagaagcatttaaatgccttctgttaccaacccaataatgctaacctgaagccctgctttgctgttggattcagtggttaagcatcatagtagtggttcctggtaatttttccaaatcaaaagtttaagagaattaataacatgtagtaatttgatccaactttattctcttggaccagtcaagaccaattaaggagccaccatccatgccatgcctctgtttatcctaatgagaagtgcrtggattgataatgaaggctggcagcttaatgtagctcaaaacataatttgtaaactctaatgaccagaatgttagccataagaatggtataaatggaactgcttctcagaatatattctgttttggtgtttctggatcactttgcttcattcactcaaggaaaaatattgccttgtacataatgcactaggtaatcatacagttgcatcttctactgaaaatgtttctctcagaatcatctgtttatgtacatatttgggttttgcatatgtaaagtcatgggatatttgagtagaaagggcttacaggctctctcatcaaattgtcttattttacagttaagattctgaggcccagagagaaaggacttraccaaggccatttgacgacttactactagacctgggatgggactcaggcccacacatttgttccacactgagtagtttttagggcacttgaccttttatttttttggagtaccttatgttgcacaataacatttttctctgtcaggtttccagaatcttctggcctagtgccattttgtattttgcaccaagtggagagataacgtcgttggcgaagcatcctttcctctcctttgacttcttgcctttatttctgaatatccttcttgcagtgggttgaatagtggccctccaaaaaacatacttatgtcctaatccctgaaacctgtgaacatgacattatttggaaaaagagtcttcgcagaggtaattattgtaatccccaatgttggaggtaggacctggtaggaggtgattggaccacgagggtggatttctcatgaatagtttagcaccatgtccttggtgctgttcttatgttagtgagtgagttctttcgagatctggttgtttaaaagtgtggcacctcccctccccgcttgctcctgctttcaccatgtgaagtgcctgctctttctttgccttccaccatgattgtaagtttcctgaggcctccccagaagccgagcagatgccactatgctttctgtacagcctgcagaatggtgagccaattaaacctcttttctttataaattacccaatttcaggtattyctgtataacatagcaagaatggattaatacagatcttgagatgagatcattcttgatttaatccaatgtcagrtatccttataagagaagtgcagagggagatttgagacacatgagagaaggtcatgtggaaatggaggcagagattggagttctcctgctacaagccaagggacagaaaggattgctaacctccaccagaagcagggagagaaggcaggaatagattcttcctcataacctccaaaaggaccaaacctgctgacacccagatttcagacttcggctttcagcactgtagagaatacatctttgctgttttaagtcatccagtgtgtggtgattagttacagcagccctaggaatcaaatatgcttcataagccattttccttgggccacactgaggactgggcactgtagaggccacgtgtgtgagcattgaggggagctgactcatgttcgtgttcttgctcccacaatgactagagctatgatgctggtaggttagattactgctctgtgactcaggtttttcaactataaaatggggatcattattggttatgataatgtgcattaattatacatgataatgtataatatacattatatagtgtatattggttatattataactgataatgatccccattttacagttgaaaaaaatgagataatgagataatgtatatctcataataagacagtgtatattaatgcttagcatgggtcctggaacacaccaaatgtttaacaatgtgagctgatattattataatgtcgccagcctcttttgcttgcttctttgcttgtagaaaggggattcataagcatttcctagcctgatgaatggcatatgtgctgttgcttgtggtgtggcaaactctgtgtaggaaggtagtcctttctgatacatgggctctgccctcctttctatcagtgggttctcatggccccaacacacccttggccctgatgaaccctccttgagaaactctcttcctgcagcatctagggcagtggtgctcatctctggctatgcgttggaaccacctgtggagtttctaatgcgctaatgcccgggccccactctagacccctctgaatcagagtgttttcaatagaacaggctcagtgaccacagggagaagggctcagctatggttcaggtaacacacctcattggagtttctaatctgagaaactgcrgggggcaggcaaggaaataggagctgtcacctagagcagaatttttctatccaaggtgaattaccaacttcaagaaaatttctaatccatcacagccaatatgttagtaaaatacaataaaaagttgactacacaaattctaccaagtacccgacaagtactcctcataaatgaattacttaaaaaacaaaatttaaaacacacacaaaataaaacctctttttgattattacattaaacagatataaatcattttgtcaaattgctgaaaagaggttaaacatatacttactatatgaactagcaattccattctaggtatttacctaagagaagtgaaaacatataagcatacaaagagttgcacatgaatgtccatggcagcttcattcttaagaatcctaaactggaaatgatcgaaatgtccatcagcaggtgagtagataagaaaactgtggcacatccgtacaataaaatgttactgaaccataaaaataaataaattactgatacacacaaaacatgaatgaatcttaaaggattatactaagtagagaaaccagatctcaaagattacagtctatatgatccatttatgtgcaattctagaagatacaaaattatagtgataaaaagcagattagtgattacctgagtctaaggggtggtcataggaatggagtgcaaagggacagaagggagtattttgtggtgatagaaatgttctgtatcttgaccatagtggaaatcccatgactgtgtatgtttatacacataccgtgtatgtcattgaactggacacttaaaatatatgaatttcattttatgcaaattataccttgaaaaagccgattttttacttgctgtaaaactttctaaatatacacagttatatgtcagagatattgtgagttcagttccagaccaccacgataaagtgactattgcaataaagcaagtcacacaagttttttttggtttcccagtgcatgtaaaatttatgtttacactatactatactaaagtagttatagtatactatactgtaactacactatactctaaagactatagtcttttaagtgtgcaatagaattctgtcatatatatatttacacacatatatataccttaatttaaaaaatactttattgctaaaaaatgtggacaattacttgaaccctcagtgaattatattttttttttggtggtagggtcttgccttgatgctgatggctactgactgatcaggatggtggttgccaaaggttggggtggctgtagcaatttcttaaaataagacaacaatgatgtttgctgcattgatggacttttcctttcatgaaagatttctctgtagcatgcaatgctgttcgatagtattttacacatagtaatttttttttcaaaattggtgtccatcttctcaaaccctgccttgtaaactaagtttatgtaatattctaaatcctttctgtgatttcaacaatgctcacagcatcttcaccaggagtagattccaaggaaccattttctttgcttatttgtaagaagcaactctctgtccattcaagtttgataatgagattgcagcaatttagttacatcttcagacttcacttctaatttgagttctcttgctatttcaaccacatctgcagttacttcctccactaaagtcttgaacttctcaaagtcatttacgagggttggaatcaacctcttccaaactcccattaacgttgatatcatgaatgttcttaatggcatctagaatgggtaatcctttccagaaggttttcaatttactttgaccagattaatcaaaggaatcattatctgtgacagttatagccttataaaacgtatttcttaaacaataagacttgaaagttgaaattactccttgatccatgggctgcagaatgcacattgtgttagcaggcatgaaaacaacatcaatctccttgtacatctccatcaaagtcttgggtgaccaggtgcattgtcaaggaacagtaatattttgacaggtgtcttcattctgagcagtagatcttaaaaatgggcttaaaatattcagtaaaccatgctgtaaacagcagatgtgctgccatccaggctttgttgttccatttatttatttatttatttattttatttttttacttttattttttagagcattaacctttgcaatttattttttttattatactttaagttttagggtacatgtacacaacatgcaggtttgttacatatgtatacatgtgccatgttggtgtgctgcacccactaactcctcatttaacattaggtatatctcctagtgctatccctcccccctccctccaccccacaacaggccccggtgtgtgatgttccccttcctgtgtccatgtgttctcattgttcaattcccacctatgagtgagaatatgcagtgtttggttttttgtccttgtgatagtttgctgagaatgatagtttccagcttcatccatgtccctacaaaggacatgaactcatcattttttatggctgcatagtattccatggtgtatatgtgccacattttcttaatccagtatatcattgttggtcatttaggctggttccaagtctttgctattgtgaatagtgccgatagaacacaggcagagtagattcgcataattcttaagagctctaggatttgggggatagtcaatgagcattagcctcaatttaaagtcaccagctatattagcccccaaaaagagagtcagcctgtcctttgaaatgttgaagtcatgcattgacttctcctctctagctgtgaaagtgctagataacctcttcttctaatagaaggctgttttgtccttatagtgaaaatctgttgtttagtgaagccaccttcattccttatcttagttagatcttctggattatttgctgaagcttctacaagagcacttgctactttgtcttgcacttttatgttatgcagagagcttctttcctcaaacctcatgaacgaacctctgctggcttccaacctttttcctgcagcttcctcacctttctcggccttcatagaattgaagacagttagagccttgatctggattaggctttggctaaagggaatgttgtggctggtttgaccactaaatctttcttgatatcagcaataagactgcttcactttcttattcatgcattcactggagtagcacttttaatttccttcaagagcgtttcctttgcattcacaacttggctaactgtttggcacaagaggcctagttttcagcctgtcttggctttcaacatgcctttctcactaagcttagttatttctagcttttgattcaaaatgagggatgttgtgactcttcctttcacttgaacacctagagaccattgtagggttattagttggcctgttttcaaaactgctgtgtctcaggaaatagagaggcttaaggagagggagagagacaaaggaatggttgatcagtggagcaatcagacaacacacagcattcattaagttcaccatcttacatgtgagtggtttgtagcaccccgaaacaattacgatggtaacatcaaagatcacggatcacagatcaccataacagatatgataatgatgaaaaagttgaaatattgcaagaatgaccaaaatgcgacatagagacacgaagtgtgcacaagctcttggaagaatggtgctgatagatttattcatcacagggttgctgcaaactttcaatttgtaaaaaatgtaatatttgggaagcacaatacaataaggtatgcctgtgttcttgatttctgtatgtatcttgttgcaaatgaacaataaatcatttgtaaacccatactggtctgtgaaccaaactttgagaagcattgaactagatgatggagcgcccatagggtggcattcagagccttgctctatcttgagtgtcttaggaggttattgtcaaggactttagtgcaagggccagcactgcagcctgatccctcagaatagccctgcaaagggtttgaaattgctgctcaggcccatatttggaaacaccaggttggatgtctgcttggctgcaaatacaatccaagaacagacatttaagccccacttgagttacgatgaggccatcagacctccagttttaagaagatatttaattttgacctccctgaaaaggggcagagagattaagcttgcagtatgagtagggatatactttatggaaagtagatgctaacaaataattataggttgaatgaaaggcaaataaatgcttgcttctaaaaagtacataatggtccaattcatcagcctgccaagaaattaggccctgtagagaagataatagaaggttgaaactctcaaaggagaggcaaattccgttgtaatctttttgatgccaaatgtatttttctgcaataatcgattatgtgagtttgagactccagttgttatcgtcatctgggaaagatcctgcagttcttccatacttcgccaccatcagtcagtaggaggattactgttttttcttcagggtggaggtaggctctgaaggatcacattcccataagagggctagtggtaataagaagaactaagcgagttcagtggttgactctgggtcttttaataacttctgatcttcaattttttcatctgtaaaatggaacaataccttcttttttcttttctttttttttttttttttagatggagtctggctctgtcacccaggctggagtgcaatggtgcsatctcagctcactgcaacctccgcctgctgggttcaagcgattctcctgcctcagcctcctgagtagatgggattacaggcgcccaccatgcccagctaatttttgtatttctggtagagactgggtttcaccaagttgatcaggctggtctcaaactcctgacctcaggtgatccacccgcctcggccacccaaagtgctgggattacaggcgtgagccactgctcctggccaaaaacaatamcttctttaaagccttgtagagatcccaacgtgagatgggtgtgatatatatttttaagagaacacaataaatagcactccattacttgcctgagttctgaacacattgagaaataggacaaaagaatcaatagatggaaaatgaaagtatcatcttcatggttaataaaggctaagatgagctcagtgtgagactcacatgaggctgtaaatcccagcctggggaggacctacctttccagtctcaggccacattggaccctgctgtggggacagagcctgtctctggaggagctgggtaaacttcacgttctctatgatctggccaacttccgagaggaagaggcaggattatgcatgttaaatttatgtcaccaagttcaccacccaactgaatgactcccaggggaggagtaagctagaagtggaatgaggccaggaatgtcatggagatagagagtcttccatacagaaagagacatcaagaatggggaagagttttttttttttttcctcttaaacaatcaggactaacccctaaacctgtgcttatccatggagtggttttccccctgccggaggggatcagtgggtcagcagggctgtcccattcccatcctcaggaggctgttccccataccagccactgctcaccagcacagcatcttgccttggtttatatacaagataatgcttgtagtttagttcacaatctagaaatatgtacttttaaaatttctaatagttggtatagatcttgaaagaaatcagctgtaggtaaatatatcttgataattatgaagttagaggaataaatctttttctttttaggatattggctaaaaagggaggttgagaattctctctttttctgtctctctccgtctctttcttgccttcctccaaaggcccatctgttctctgctccaaatttatgtctctcaatcccaaaaaatatagttggctttaaaactctttataattttgaaatggtcttctattttcctatagttgttatagcttaatactatgcaatcaggaagattgcctaatgctcataatttgtaatagatatgcaattgtaattgatcttggatacacatttatgatttttccctcttcaaactgaattcaaagataamattaacctagggtacatggagacctgggattaaatgttttgaagaactaagtatagctgaattagtatagcttacaagtatrtaaattataaagactctctccctttatgtgcacccagtacccttgggaactggttattaagttcggatcacatcctatacctttaaagatgaaacaagatctcaattttacgtgttttttgttctgtgacagcaattctgcttgtctgtgatatgtctcctaacttcagcatatgcacactggccacttctcagcatgaggaatggatgtatatgtttcagaacaaaagctgtaaaaatggatttttagtgccctgtaaagaagcctggaaaatcttgaaagaaacagaaggggggaagttgaaggggcagtggaagaatttgctattggcactaaatcagaggaggctaaaacataatcacagtataagatttgcaaatgttctctttcaaaagtgcttcgatctctgagaggtaccaatgttgcattactttgaattttacacacacacacacacacacacacacacacacacacatgcacacacagcttcatatatcctgcagtgaactgtaatctgtcagcacaatagctgggatggagtgagaatcagtatctgatttaacagtaaagtagaaaatttccttcctgtctttttctttcctctttgaatattctacctatgtttatttacaacatagcctcttggatctttgagagatagaggggaccttacttagaaagacagtctaatttcccagcaaatttaagaatgctctttctagcatttcaaattgtgatcttcctacctgtatttgaacaggtaggaaagggatgctcccaaatgctaaggacaatggtgttctttgtagatgctgctaacaattagaaaactcttatatcaaatttgacctttctctccccataatttctagtctgtggtcttcattcagtcttttggaagttaggaaccaaaaagactaaatttagtttcccccaacccctccttctcacaagactcttcgatgttggaagtaacctctcatattatggtaagcctgcccccacaccacccatgcttatattcaaatactgcccatagcgggaagtggcatttctaggggagaattaacatcttaatatcaattttccaatccagaaagacgatatatatatatatatatatatatatatatatatatatatatatatacacacacacacatatatatatatacacatatatatatatacacatatatatatatacatatatatctccatctcagtattcattagtttgcttcagtaatgcttttaatcattttaatgtgcaggtttgatataatttagttaaatttatctctaagtatttaaatttttttaaattttttaaaaatttttaaattgagatataattcacacatgataaaatttatccctgtaaagtatgtaagtcaatggtttttactatattcataaagttgtgcaaaaatcaccatttcatagttttaaaattttattgtaaatttcaatttccaattatttacatatagtatcatagttggtactacctagatatacaattgagttttgcattttgactttgtatcttgagaccttgctaaactcattaattagttctaataaggtttgggttttttttacattccataggattttctatacaatcatgtcatcattgaaaaatatagtcttaattattcttttcttatatctatcttttacttctttactttgtattattattaaacttccattaaaatggtgaatggcagtggtgagagcaagcatatttgcctcattcctgatcttaggagaaagcatttagtttttcaccattaggtatcatgtagctataggttttttatacatgccctttatgaaattgtagtttccttcaactcttagtttgctgagagttattttaataaatggatatttaattttgtcaaatggtttttctgcacctgttggtattactatatggttttccttttaaaatatgttaatatggtgaattacattagtaaattaatttgaaaatgttaaatgaaccttgcctttggggatgaacctcccttggtcatgatgtattatactttttctatattggtttatttgatttttaaaaaaatttaaaagttttgcatctatgtgcacaaggaatattgatctgtgatttctttcccttccccccacctccatctctcttttctctccttcctttccttcctttctttttcttctttcttttgctaaccatttaatggtggccttataaaataaacttgaaagtgttccctttctttctgttttctggaagatttgtgtagaattggcattgcactcctgtaaatgcttagtagaaattacctagagaaacatttggggcttgatatttctttgtgagaatgtttccaatgctgaactcaatttatttaatagatataggcctataggttatttatttatttatttcttgagtgagttttggtggtttatatctttaaaaaattgccaatttaatctttgtcaaatttgttgtcacaaagttttcttgcaattctctcattattctgtctgtaggatctctgagcagttttctttctttcactgctaatattggtaatttgtctgctcttttctgatcagtctacctagtgttttatcaattttgctgactttttcaaagaactgtaattgatttgctttattttttcttggttttttatttttccaatttctgatcttatctttattacttcctttcttccacttacattagatttaacttactttttaattctggtcccgtaaggtggaagattagataattgattttaaacttatcttctctaatattgatattctacrctataaattctctctagtcgttagtttagctgcctctcataattgtaacacactgtgttatcattttcattcagttttaaatattttccaaattcctttgtgattattttttgattcatgcattatttagaaatatgttgtttaatttttaaatatttgggactttttcagatattcttctaacattgatttctagttcaattccattgtggtaaaatttcagtccttaaacttattgatacttgttttatggtctagactatagtgtcttcgtaaatgtttcatgtatacttgaaatgaatatacattctacattctgccagttctgagtagtgtgttctttaccacaacaggtttcctttattcattccacatcacttataccaccatatgatatgatattatagatttatttctttacttggcttgttttctgctcccccaatctcccccttccccaccgtacaattggaatgtatactctgtgagggcaggagcttgactgttttgtttactccagtattctcagttcctgaatgattaaataaatgagtggatgaattcatgaacttttctcaaaacatcaagaaagtgtatatactagaagttatgtacaggctagaccatagggctcagatgagtactttaaaacttttcctctttggttagaataaaaaatgtgaaaacttacatcatgtacatatttacctaaaaaatcagccattaagaaaaataatttgtatgtgtcacacacaattacttcttaaattcagaattcaagaaaatactaacccacttcatttgtcaaaatttatttatagaattaagaggggaaatataaacaacaaccactataaaatgtaatgtaaaatgatctcatttacattagcaacattaaagaaaatctagtgatacacttaacaaaaatgtttaagatctacatgaagaaatcttcaaaacactattaagagatagaaaagtttaaataaatgcttatttcttggaaaggaatactcaatattatcagctgtctattcatattatattaatctacaaagttaaaataatgccaaaataaatactaaaggtttctctggtgtatcaggaaaaagaaatctgccagagtagaaaggaagattctgaaaaagaagaccaagagtcagtggtaactggccctccatgtgttcaagtttataactgctgtaattcaaactctgtagtacagaatcagacttagacaatgaaaaagtcaatgaaaaagaaagggagtccagaaatacacccaaatacttataggaacttatgctatcccaaagacaccatttcattttagtgaagaaatgatgacttaattaatgcatggtattaggacaagtgagatgtcacctggaaaaaaaagtattttaaaaagttggattcctactttactccttataccacaataaattccagccagatcaaatatttaaatgtaaaaaataaagccataaatttcaagacaaaaataactgaataattttttataatcttggagactttggaaacatgacacaaaattgaaatgctattaaaaagaataacacttgactattaaaatgttttaaattgtcttataaaatgccataagcaaagtcaaaagcgacttaggctatagtgaatagtagctgcaaaaaacatgggaatgaagatgtctcttctataactgatttcgtttcttttggatgtattcccagcggtgggattgctgggtcatgtggcagttctatttttagttttttgagaaacctccatactgttttctatggtggctgtactactttacattcccaccaccatataagcatgctcctttctctgcatcctcatcagcattgtcattttttgtctttttgataatagtcattttaactgtggtgagagggtatcttactacggttttgatttgcgtttccctgatgattagtgttgttgaacatttttcatacacctgttggccatttgtatgtcttcttttgagtaatgtctattcaggttttcccacatgtccgtcaatgaatgaatgagtaaagaaaatgtgttatatggacgcaatggaatgttattccatataaaaaagaatgaaatactgtaattttcaacaacatgcatagaactggaggtcattatttaaagtgaaataagccaggcacagaaagacaaatattgcaagttctcactcatatgtgggagctaaaaccgtagatctcatggaggtagagagtagaacagtggttaccagaggttgacaagggtgggggtgatgaagagaggttggttaaggggtacaaacatacagttagaaggaataagttctagtgtttgataaaacactagggagactatagttcaccataatttattgtatatttccaaataactggaagagaagaattggaatgtttccaatacaaagatcggataaatatttgaagtagtagactcccagttatcctgatttgatcattacacattgcataaatgtatcaaaatatcaaatgtacccccaaaatatgtacaactatcacatatacatagaaaagtcactttgaaaaaaactgtgaatatttttgacaaagaaaggctaacatcattgatgtcatcaagagcactcatgtttcagcaagaaaaaaaagcccagtagccaaattttaaaagtgggcaaaggacacartcagttcattgaaatggaaataaaaatagctttraaacatattgaaaaatattcagaacttctcatagtaagagaaatgtgaattaaagttgcaacaagatgccatcttctgtctatcagattgacaaagattaaaaaatttagtagcatatgttttcagcaagggtgcgaggagacagaaactcatatgttttgggtcagaatgtaaattggagagcaatttggcaatatctatcagaattttaaagtttatagcttttgacctggttatttcgcttctagtcattgatcactcagtggtgttggtacacatatacaaagacatgtatctacaaggatatcagcattgcctgtccttacaaaattggaaaggacctaatatccaatgtggtgttccacctgcatccccttccctgggccagtgcatctgtctcccgccactgtgagtgttggctgctgacggctcacagctcacccttccccagagaattaccctcaactgaccaggaacttcctcacctggaagtagctgggaggttatccagacgaccatttctttgtatattggcaatatacaaagccaatatctattgtatattgtggtacaaaaactcaaaatgttttcctgctgccatgcatgctccagtgctccccatgggatcaggtttgacttgactaaaacctcatctttccttagcttcttccccagcctaacttttctctctggtttctatataagattctcttgaaagcacttctcgataaatcgctggcatgagagtctcccccttaggttgtgcttctagagaatctcacctaagacattcatcaacagggtactggttaaataaatgacagtattccatataatggagtaccacctagacattaagaagagagaagcaactattctctatatactgacatggaagtctcaaaatagagtgaaaaaagcaagttatagattaatatgaataatatattaccatttatgttaaaatggcaatttacaaatatagttgaatattcatagaatatctctttgtatagaatatctctgcataacagtgtttgcttgttgcagaggggaggccaattggggtctatgaaattagaaggaagaagatagagtgaattttgcactatatactttttctaccttttaaatattctactatgtaaataaattatctgttatattatttcaacagtggtaaaaaagcattagtattttcaaatagcttcagtgttttgaaacaaagcattagtagtatcaaatatcttcagtttaggataatatcatttatcagaaatatttcttctgcccttaggaataaattacatttaaaaaaattagcatgtcagtactctaaatgaaaaagtatgtttttgaagtccctagagggtgcaaaaaaactatctcattatctatatcttaagaattatctctgcaattctgttaattttcttagtaaacacttcccttatagataatggcattgcaacttccagctggccctttttaaatgatcacaaattgccatgtatctccatttaaatgaattgtgctttttgttaacctgagtttaattaccattcattttaccgcattaattatgatagatttcctgcctccttcatacctgtggccacatagacattgcaccattattagtgcttttggcatctggttacaaattatacacacacatctgctgtgaattgtggattacattaagaatcaaacatactggatttagggcttcaacacagaaagtgatgtcaatgcacagtcctgaaacatgagaccacacattgtctctgcctcatagaacagaggtcatgactatacaaaaaacctttttgcagctgagacatggttgaatatatttcatacatctctcactgtccatttcatgagaccagggtatataacagcccccagtggccttacccttcacctgcatgtgtgctacattttttttttttttttttttttgagacggagtttcgctyttgtcacccagcctggagtgcaatggcgtgatctcagcttgcagcaacctccgcctctcgggttcaagcgattcttgtgcctcagcctcctgagtagctgggattataggcgcatgccaccacgcctggctaatattttgtatttttagtagagacagagtttcggcatattggccaggctggtcttgaacccctgacctcaagtgatctgccagcctcrgtctctcaaagtattgggattataggcgtgagccaccacacccagccgggttgctaatctttgaggcaggcaacacacatccaaaatgctttaccctaccatctcccctccctgcctctcactcccgccacattggtatatccattcagagacggcacaggaaatgcagagtgggaaggctggtacgaatgctattgtggcagtggtggtcatttatttgttcacgtgttctttcattcaataagcatttaatgattcctgtgatgtgccgggcactgtgctaaaggaaaggacaagccatagtgaatatagtatctagccttgaggggtagagacttacttttgagagtcagagagtaagtaaatgtcttttcaatgtacaaaaaggagagggggaaacactgtgaaatttaatgctatatgcatgtataattatataagtaatttgactacataacatttcaaaattctgtgcacaagaaatagaagaaataaagttgaaaggctaaagatgacaacttgattgcagcacataggacatttttatgggcaagtcgtgcttaaaaataacagaacgacaaatgggcaaaaagaaaaatgggcaaagacacaaacagatgattcacaaagaatgatcacattaaatcaaacacaagataccattttcacccactgaactggcaaaatgttgtaactgtattaccttatgaagcaagaatgtagttgaaaagattcaacacagctgttagtagaattggtacctcttttctgatgcctgtctggtggacaatcaggcagtataaatcaaaagcttgaaactagttcttgccattggagtcataattccacttttcagaattttatattgagggaataatcagagatgtaaataaagatttttgtacaaggatgtttattgtagcattatttataattaggaaaaattgcaagcaatctattccaaaattagatgattaaatttgctgacaaaattataggccagaacattattccaccattaaaatccatattttcagagtaaaaatatgagaaagcacttaaagtatattattaagtgaagaaagcatgacaacacagtaagaacccaaatggacagacagagaagaggaagccaaaatattaagattgattattcagaggtgattgaataagaagtgatttttatttccattttttttcccctgtattttccaatatcaactgtcagcagccattacctttatttatttatttttttttttgagatggagtctcactctgtcgcccaggctggagtgcagtgggcatgatctcggctcactgcaacctccgcctcccgggttcaagcaattcttctgcctcagcctactgagtagctgggactacaggcatgtgccgccacacccggctaatttttgtatttttagtagagacagagtttcaccatgttggccaggatgatcttgatctcctgacctcgtaatctgcccacctcagcctcccagattgctgagattacaggcttgagccactgtgcctggcctactcttataatacattaaaatattgtaccaaatgggaaggaagagatataaataccaccaaattcattctgcacttgatgtggtttggctgtgtccccacccaaatctcatcttgaattgtagctcccataatccccacgtgtcatgggagggacgtggtggaaggtaattgaatcatgggggtgggtttttcctgtgctgctctcctgatactgaacaagtttcacaagatctgatggttttataaagggtagttcccctccacatactctcttgcctgctatcatgtaagacgtgactttgctcctccttcgccttccgccatgattttgaggcctccccagtcatgtggaactgtgagtccgttaaacatctttcctttataaattacccagtcttgagtatgtctttgttagctgcatgagaacagactaatacagcactcaatccaatattttaaatgattttttgctcaaactctttaatgatttcttatgtccttctgaatacaactgccccatgacatctcaaaattcctctcggatagattgcttgttcacaattacactttgttgtctcactggaaagcttgggctctttctaaaaacttactctaaaaagctcttggcatcctccccaaatatttatttgaaaatttttgctgggctgtgtctgtctcacctggagctctttggatgcttcatatccttttaatccaggaaagcagatgtattatttctctgttttctttttcaccactctcttatgttttcaaagtgttcattttaacaccaaataaaattagcctttcactggaaggtcaaacatgagtgtagctggcaaaaatgtactatgtcaataatatgactggaatcgtaacaataacaaagtatgggatattgcatatgataggcatggaaataaaagctgaaatgcaacattttgtagttggaaaagggaatattttaaagaatattttgtattaagtattaaattttaagagataatgtaaggttggggtatatatattatggatacagacaacaaaacaatctacaagataccacggttagaaaataaatccttgggcatgccaaggtaatttatagattcaatgccatccccatcaaactaccaatgactttcttcacagaattggaaaaaactactttaaagttcatatggaaccaaaaaagagcccacattgccaagtcaatcctaagccaaaagaacaaagctggaggcatcacactacctgacttcaaactatactacaaggctatagtaaccaaaacagcatggtactgataccaaaacagagatatagaccaatggaacagaacagagccctcagaaataataccacacatctgcaaccatttgatctttgacaaacctgacaaaaacaagaaatggggaaaggattacctatttaataaatgatgctgggaaaactggctagccatatgtagaaagctgaaactggatcccttccttacaccttatacaaaaattaattcaagatggattgaagacttaaatggtagacctaaaaccataaaaatcctagaagaaaacctaggcaataccattcagcacataggcatgggcaaggacttcatgtctaaaacaccaaaagcaatggcaacaaaagccaaaattgacaaatgggatctaattaaactaaagagcttctgcacggcaaaagaaactaccatcagagtgaacagtcaacctacagaatgggagaaaatttttgcaatctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacacgaaaaaatgctcatcatcactggccatcagagaaatgcaaatcaaaaccacaatgagctaccatctcacaccagttagaatggcaatcattaaaaagtcaggaaacaacaggtgctggagaggatgtggagaaataggaacatttttacagtgttggtgggactgtaaactagttcaaccattgtgaaagtcagtgtggcgattcctcagggatctagaactagaaataccatttgacccagccatcccattactgggtatatacccaaaggattataaatcatgctgctataaagacatatgcacacgtatgttttattgtggcactattcacaatagcaaagacttggaaccaacccaaatgtccaacaatgatatactggattaagaaaatgtggcacatatacaccatggaatactatgctgccataaaaaaggatgagttcgtgtcctttgtagggacatggatgaagctggaagccatcattctcagcaaactattgcaaggacaaaaaaccaaacaccacatgttctcactcataggtgggaattgaacaatgagaacacatggacacaggaaggggaacatcacacaccggggcctgttgtgggggtgggggtaggggggagggatagcattaggagatatacctaatgttaaatgaggagttaatgggtgcagcacaccaacatagcacatgtatacatatgtaactaacatgtacctgcatgttgtgcacatgtgccctaaaacttaaggtataataataaaaaaaaaaaaagaaaataaatccttgggcatgatgatgtaacttttgttttttactttttcttttctttcttttttttttttgagacagagtctcacttggtcgcctaggctggagtgcagtgctgtgatcttggttcacggcaacctccgcttcccaggttcaagcgattttcctgccttagcctcccatgtagctgggagtacaggcacatgccaacaggcccagataatttttgtatttttagtagagatggggtttcaccaagttggccaggttgatcttgaactcctgacctcaagtgatctgcccgcctcggcctctcaaagtgctggaattataggcgtgagccactgtgcctggcctattttttaccatttctaaaagacatttcccatttggttgaattcagaaattcaaatatacatatatataacttggagttgtcttttgcaatattgctgatattcaggtcagtattcccagtaaaatgtattcagcatgatataacttaacataaaaatattttccaggctttatctgaagtgtgtagtttcagtttggtatgtatttctgttgtgactaaagagaaggatttttcttactatctaagttttctatatataagatcctagagtggttctcattcattcaaaatatatttattgcatacccagtatgtttctggcaatatgtttttatgataattctattatgtcctgaaaatgtcttacagtggtattttataatggcaaaatttttggcaagtttcacaagtatgtacttttttcaaaatagcttctttattcaatgccaaaaaaatagaaattggacaaatcatcttgtcaactttaatgactaatttggaatcaccgagaataactgcttatttatgaaaatcagaaataaacccattctctaaaagacagggggatggtgttagtgtgaaagatcctgcagtgtgattgtgtttcatgaacatatataaactttagatatatcagtttaatatttgttaatgatgggcaggtactgaggtaaaaaaattaacctacttgagaatatgttaactaatctacagaggacattagtttatgcagtccttggatataagaaaatttgtattattttatttcctgaaactatgttagactgaaggtcatacaaaaattaagaggtctttcatagtccagacccctggagaaggatccacttgccttcagtccacactggtcacttttgaaaggctccttggccaggttcttgtatcttggacctcactctgtgagccttgcagttttaggacagtggtgaggggacatctctgagagaatagatagatgagttcctggcactgggagcttgagatggagtatagagcagaaaaagcaggtactcaggggctgaaagaaagaacagaagatgcccttcttcaggccggatatttaccagctgggcaggtgggttggtgctcagagaagttctcaactatgaccatgaagtcagcagattcatacttcttccaaatttcccccctttttagcctgtaaagccacagctaagccagtgctggttctgaattacttccctatgcacgatgtgtaaatgattgaaatcagatgagccatagactgtaaattcacttgtataaatgtgtgaattattgacatggatccaattaaatggggaatggtagcaagaagtagtccttggtccttcattgtagggagaaaaagttttagarggaggatactgcagaatggagtttctgatggaaaatgtttccaccctcacagattttaaataactcttctttagggaggtcagtgaggctacagggagccagagggtggcccctgctgactgtttcaaggctgtccttcccctcttctcaggcctttcacctgttggtgtcatttcacatgcgtgataatcttcaaacccagctctgccaccatctaccttccccattgctgcccttctgccccaaaggatttgagaacaacataaaacaataaatactcagctccccatgagctgccattcacttcaacttggctctcaccagtgcttgacacatcttctctccatttctccctggcaggtctccaaaagggctgctttaaaccattcctctctccttagcccccagtcccacatgctgagagtcaagagaacatgtgtgagaacgtaggtgtgggcatcagatggaactcagcactcaccagctgcaggaccttggttgcatttcctaactacatctggaaaagaaagatgatcataactagaacttaacctttgaaggttttatgagcatgaaaagatgwctggaaagaacttagcccaccaggacagggctccrtgaatgtcatctgtgactgtgggtacccttccttcaaatgagtgaacaataccctcctcattgacttggaaaacaagtgcccctagcatgctccttcaactacttgatattaatttccacatataactcactctttccacttaatcgccttttccaaaatgtacctccacccctgtgttactggatgccattgtttgtgcctcaggctccttgttgttgtcattatcccaccttctctgggactttccttggcctttaggaaaactttatactttgaaacaagtgggctgaaattctgtcttctcttggatgacctggcaccatcgctactatgtgtcacttgtgtcccccacttcttcctgtgtcatctcctgtggttcagttcttagtgtttcagtctttgcttttgacccattcactccaagggcttccagaggatgttgaatgggacaaaatattgctatgtgacccacatttgagaagatccaatgacagttggatccaggcacctccctatgacttaccactgggaggcagaactacccagttaaggaaggtggtatttgtccttttccaaagatagcatagtggttaagtgcacagatatttggagtcagactacttgggtttgaatccagcctctgccacttactaactgtatgcttttagttgagtcacttaacctagttgaattatttaacttctctgtgcctctggtttctcatttgttaaatagagataataaaagtttcttactccataggtcaattgaattaactgaatccactattaagaacagcaattatgtcactataattccccaatcyttctgccctgccccaagtcccactaagggaggagagaagaaaagaaggaatgaaccatgcttgcctctaacttcaagtctccccagcaagggatcaaaatcgtgtagaagggaaggggaggggaagaggtgagatttcaatcacatttgagatagaaacatttaactggtttgaaattttaataccttttcaaaaaacatgcctggaaagctatgagatatgttcaagatgtaattatgaactaaaaaggctgtattgcagttttttagaaaaataaaaatgatttcatttaaattcaccaacttgattcctcagtaatactcataataatgatgatgatggtagctagctgaattcaggattttttttttgatattcactaccatggcaaactgtcaaacttaaaaaatcatttataactcatatccactacaatggatattatgaaagatacaaataataacaagtattggtaaggatgtagagaaacccaaatactcatacattactggtggggatataaagtggtgcagccactttggaaaaaagtttgactctttcacaaaatgctaaacatagagttacaatatgagctgggaattctactacctagatatatttccaggagaaatgcaaacatacgttcacacaaaaacttgtccacaaatgttcatagcagcattatccataattgccaaaaaagtagaaacaacacaaatgtctgtcaatggaaaaatagataaagaaaatttggtatgtccataaataaaatattgttttgccatgaaaagaatgacatatttatacatgctacaacctggatgcaccttaacaaacacgctaaatgaaagaagcaagtcacaaaacctatatactgtgtgatcccatttattttaaatgtccagaataagtaaatctagagaggcagaagttagattagtggtttcctagagctgagtgtgggctggggtgggaagtgactactaagggtattttgggtgataaaaatattctaaatttagattatggtggtggttgcacaattattttaatatgctaaaaaccattgactagtacactaagtgagtgagctttatagagtatgtaaaatttatatctcagtaagttattaagaatcagcttattattctccaagttttgaaaacagagtcacagtttccctgaccttgggctttaatctttacaataaataaccttagcctcctctctctgcatggcctctctttccacttggtgatggcagtggacatgtgtcatttttctggctgccagcatttgaatccatttccaagtttagagaactgcccccctaccaccaccatttatgagtcttggtggagtgcatcagccgcctcccattataaaatggaaaacgctggtacctgcttgctaaagtttagaggcccccaccctgccccagctttgaagtcaggcacttcaaatacaaagatacacttcagatacaaagaagtgaggacagtgggaaatccattctgatggcaggtgagcagtgacaacagccaacttggtttccagggacagcgtccgtgtccagtgccaggtagtgcaaggcatggccacactgtgctcagcaggagtgatctcaccacattgacttttggcttgattttgcctgtgactaaatgctacttagtcttctggtcctgcctgtttccaagcctgtttctttaactttcccactaattgtgtgagtttattaatagccttccgatcagttcctttccttccatgctcagtttctctgcttgctcctaagaatcctgtttgatacagtcagcaaggaaggataattttcaccccagtctccaggatctttctttagattctgtaagcatttacttatttagtgactactttgtgccatccaataaatgatctcataatcgcatagtggcaccgataccaatagctcccatttcacagatgaggaaacaggctcattgaaatgaatagcttgtagattcaaacccaggccaagcccagtgcctttcccataagatcttcatggccccttctccattttcactgacaccacatctcgctcattatttacagaacaaaaggtcccactcctctccctccctccactatctttcttctttaaatcgctgtgggcatcattgtcatatttcatcataagagtattgttgattcctttgtacaacagctgatgatgactccctactgtttaggtgatcagacctcaggaaggtatttcctgatcacatccaatgcctcctttgtctctggccacatcttttactaattctaaacaagcccatcacatgctacaagagtaagtcctgttttctcttagtctggctcaacttactatagacagcaggacctcaatcaatacccttaatctggaggctgactaaagacaaaatattgaattcactcttcatrttttcatcataaaccccaaattctatgacaatgatgattttggaaacaataaattaagcatcaagcatcatatggcaaaatctattggaatgtaatatttttggcaggaaatcatttcagagtggaaaatgtttgctaaatataaacactgcaaagccatgtgcaccgccaagactttattattagattctcagggatttttatttagaagctgaggaacttgcgaggctgtacaattcctggaatggaatttaggtttgctttctgaaatcaatccaggcaagcctttttgcacatgagcattcttagaaagtctttgaatgtctattcttactcacttctabgggtggcacaaaatccaaaaataaaattaccatgaggttctgcttgcttcctgctttagcgacactggaaatcctccagggatagctcatgtactttgtaagttctcctttgcctctctcattgccagcattgggtagttgaaacctagactcaggacaagatctgggatggtgtgaacgtcaggaaggctgtgcaggagaattcagaggactgggccacaactgctaagggtagacctggaatgcaagggcaattcacagagggttggtcagcagggatggggccagctatagtggtacttgagcctgtcaaggggctgagcagagaggcctggcctgactcctaccttgcactactcttctctcaaatgggaatactgggggaatccaaacagatcctggccattagcaggagagattgaagagaccacagcccacatcctggggcactgtagcatgttccttttattgctggatctggctgtaactttgggacctgactgtgacaccctgtgtagttatcttgtcaaatccccttgtaaggcccagcctagtgcttggatgcctgacacttgcatcttctttctgtatgcttcttcctgcctcccatgtgactttgtcaagatggctgtcactccatctttgttgctatgagctttgagcccctttggacaactcccctggatgctgcttgctcacctgggccactgcctgttgttcaggccatggctttccatcaacactatcttttaccgtctcttgccaagtcaagcctgtgccctcagggccagtcttccttcatacaactctgtgaacagacctaatttcagaccctgaccatgtgttgacttcaccaggctctactcctcagaggggtagcaggagctgaggaggctgtcaggggcccaggcatgggttaaaggctttggtagcatgaatagaaagaatgggtcagaagcccagactgatggacacaggcatcagggaatgcaccaaggagaccagggcttcattggctcacaggtccctgtgctaaagaggaaagcacatccacagttaaaaaaagctgctcttccttcaggtgtatacaacctgtagcgatttgaatgttggccccaaaaggatatgtgcaagtcctaacccctactacctgtgaatatgatcttatttggaaaaaggatctttgcagatgtaattaaggatcttgagattgagatcatcgtggattacccagatgggccctaaatccaatgacaggtgtccttataagaagaaaagaaacagtgagaagaaggccatttgatgatggaagcagagattggagtggcgtaactacaagccaaggaatgccaagtattgctggcagctggcagaagctaggagaaaggcagggaacaaatgcttcctcagagcctatagaaggacccaatcgtgccaacaccttaggacttctggcctccagaactgtgagaggataaatttctgttgtttttggtcagtttgtggtaatttgttaaagcagactttggaaagtaatgcacagccccagaaggagacatggctttttgggtagagcacaggctaactttcagcccttcctgcccagcagtctggtttctttgtgcaaggcacaaactacaccacaatttatcaaggctctgatggagactgagaaaccagagcccaaatccacagaaagaattaaaggagtcagcatttggtaacaggaaaagaatgaactctataggcagatggaagcctgggattctgacactgtcgcaagttagtatgatgttgagcatcagtttttttcacctgcaagacggggtgggaagggaagtagcacttgttgatcaccttttgggaatgatgattcccttgaattcactggatggctctcaggattggatgacagagtacagtgcttggtttccygtctgtcctcaacagatatttatttcctgtcccctcctctcctcaccttgggtaactggtattagtgttgcaggagcaataaggatacttgaactctgctacaactttgcttaagctcagaaatgtttggagcctcttgaaattgcagccaatggtgtctgccattggctccatgggccttgcagggagaatgaagttgatataccttctggaaaagaaagagcagggaaaaagcaggagctacagtttataaattctgtttctccaacgtggccacaatttgaaatctacactgcatgtttattctgtttgtagcactacatgcatgcaaaactggttgaagacagtttccatgatgaacacaagcattataattgccatgttgatctccataggaattcaagtggaaaaaaggttctttattccaggatgcccatatttggacattgttgcccttgccagacaagagggaatgaccttgttcttaatttaaaaaaaaaatggaaaggtggtggtagtagcctggtagtagccttggttaaaagattatgggttcacacttttctaccaagtggaatctgtctggctattctgaagcatagagacattctatgtcttctgaacataaacaggagagtttgttgaaatacaatattaatatgcactactgagaagattttgatggttcataaaaccctcatgaatcatggatgagagagttactggagtctcacagatcaattaattagatgtacaaagtgtatacatttttcatttgattatattttggtgttgtgttatagatatttggtagataaagtgaatccaagtatttatttaaaaaactacttcaagacgacattggagggtggttagtgagtctgagttgaaggattatgagggccccaaggctggtcctgagtgtgctggttaaaggggtgcacaggcacctgacrtaacagagctgggagtccagcaactaacaggagagagaaaaggtggcatccttctccctgtgaaagtcgccttaagaaagcttaggctccacttatggcacagagagctaaacatacatcagcttttccctccagggaaatccttcggggtactctgaacacatttctgttggattaacagggcccttagtgagatggtgttaggctgtccagcgactgggatcttccatttctttcagagcaggagacagcaaaatcatggcttttgttatctatctatatatacttattaatgaagacattccaaatgaatgatgacttcctgagctatccttgtggcatgtgcctgtccttgtgtgagtgcttgtgtgtgtgtgtgtgtgtgtgtgtgtgagcaactcacctaaaaagtaggctctagagtaggctytaaagagcttggctgtgccttttgaactgacagatacatatactttatagaactgtgaactttttcacccaataaaacaggggtaatacaagagtcttctaaatctttatgtttcatgtcagtattaccaggaattctgaggccgaagttcattgcttacagggtagttaaataaagatgttaaaggattagctaaaacattatccatgtattatcctagagtcagtggtaatatctactgacaaaagagaagattaacctcagagctttttgctaaacagcaagctgatgctcaagtcacgtttcaacatatttcttttgcaaggaggctcttttatctctatccaaggtgatactaatagacttatggaatacgttttcccggtctccagaagtgtgtcagctttccaatgacgtgttttttccaataattcaactcatcagattcatctggaaacagttgttttgatgccttctgtctttcatgtggtgccctaataaaggctgcagaaggaatatggtttgcagaaagattaaggtgacccaaagatgtattaatgccctgctgatgttcaaacaagccaatggctttttctttggaagtttaggtgttagtagaaggaggcacagaggcttggagttacagaatgtttggcccagaagagcttagagatcccatacccatctcacatttgggagccctctgtggctccccatttaggtggtctccagccatagtttctgcacattcagggcagagaaagctcactacttccccaaggcagtctatttccactgttagaccatgataacacaagaaaagtacttctgagctgagctgaagtgaaatatgcttatgcaacatttggtcctagtcctgctttctaaagcacaaagaataaatctctttcaccctgatgggccacacagtccagatgaatggatggagatattgggtttgactctgctccatcacttaagtagcagagcatgttagaatctctcaraatcttggctttctggtctcttagacgaagatcaggatccccatcacctgggccattgtggagtttgggccaaataatatattttaaccatctatcatggtacttggcacatggcaggcatttattgaatgctcccttcttccttcttcttgggagctcttcaaacacttggaggcagcaagtctattttcctttggttttctcttttcccagccttcatgctgcagatcaaaggaatggarctgaaartgggggctgggaaatatctaagtcagtgtctcctaaagtgtgggcatcaacaggtggtaagaaaggttatttttagatagcacatgcatgatcattttataatttaaatataaatctatctatctatttaaatgatatatttcatagctgtcctgtattatgtcagggaatactatttttctatatatgctagtgatataaagtctcctttaaaataaggttatttaagaataaaggcaaatcaagtacaacaaaagctgttattattaccttgttgaaaatcaaatgagtttccaagcaaatcaaagtctatttcaaaaatctcattagcaagcagatctgaagaaacgacatggtgtatgactccaactatgtgatattctggaaaaggcaaaactagaaagacagtaaaaagatcaatggttgccaggaacctggaaggaggaagggatgaataggcagagcacaggggatttttagggcagtgaaactactctgtatgatactgtaatggtggatatttttacatattacatttttcaaagcccatagaatgtacaacacaaagaataggtctagtaaactataagatattaatattagctcatcaactgtagcacatgtatcatactaatgcaagatattaataataggagaaacttgagggtatatggacactctttgtactttctgttcagtttttttgtaagcctaatactgcagaaagagtctattaattaaaaaaaattaattagctagacaactttccagcctgattgtttattcactgccatttctccatctgtctcagggacatttcatgtcaaaaaccaaattagtcacctttctctacagaagagtactgctatctagttacttccaattgttaacctctgagatcctcccaaccttagagaatattgtgctcctattcctccttaatttaccaccttaggttcattacgaaatctctctgtccctctactccctccctttactgtctctggaatcccaaaccttcacaatttccacaactattgccatggactgggagctctcatcactccaagcctgggctactctgattgcctcttggatggtcttcttatctttaatttctcctccattccaagatcatccatgaacagctgttaaaatcaggtttgaataccaatttcaccccattccttctttgcttgagaatttgcaaacctctgtttccaaccatccaagtgggtggaatggtcaaagacctggatattacctgtgcccaccaagtcaagacaaggacttggatgagcarctactagctgatccaacaaagataattaacaccgataattatgaccatgtattgaacaccagtagaggatgctgtggttcgtgcccaggatgaggttctcattccctcacccagyggctggcactctcaggtgagcccctctctaggaattgccctcacctgaaggcagccacctcccagggccagcacagacttgatgactggtggatgaggaggaataacggccccatctcctagccatgaagcaagatacttcagaagggtcagctgagcatgagagttcccatgggatgggctgcccctgttgtgactgcatcaaagtttagcttctccccaacttcctcacagcacttgcatcctactgtgccagccaataatctccctgtgcacaaatcccatctgggcatctgctttgtggagaataagccctgcaacagcatccaaagtcagttggactctgagtttgtgctatgtccactgatctacactatcttttgaaaacaggcataataatagctgtctgctgtcaaatactttctcggttccaggtgctctcctaggatattttatttatacaaattctaatcttcacatcaaccctgtgagataggcccgctttccagatgagaatacctaagaattagagaatttggaaatgtacaaaagtggtccagtcaaaaaggttttggggacttagggaaggccagtccgtggcacctgggaggcatgaaatacaagtgacttgacattgaattattcacttcagactcatttacttctccctgcccagggacagatcctaagaggggttaggagggctgggcagtcrttcaacgttccctgcttatctccgttcttcttcccagggatgcatccttattagctcttcttctgactacatgtgagcattccattccaatccagccgctcagcctgctgtccactccctgcagtgcaacccagcccagcccctgccttatgtgcgtgtcgtgttttgtcttctgaaatgctcattcctctgcccatgcccatcatgttcctttcagtttggttaaaaaaggatctccttctgaaaggactttctggtgctatttccagagagacaattcacctccccaagtacttaaacactcattgtagccccagttgttctagcctatttcatatccattagaggtcatgcttagaattcagaycatttcttcttcttctttcttttcttcttccttcttccttctttcttcttctttgttaagcaaatatactcttytctatgtgttaccacttctgtggtgcccgtgtgattttgaagtgtttttcgtatgccattagacctggtcttttctgccagattgactggaactggtagaacatttagcatctgcagctgggaaatcatagaagaaatgcctgaatgttttcctatgtgagtgattcttatctcagccaaagaagaagtaagattttaaatgagccaaaactgttccagaaggcaattctaggagtgagcattgtgtaaaaatctggaaaaataaaaagtttaattgtgacaactggggttttatgtggtaactctctcctctttatgtcgtgttatacccaagaaaatcttaatatctcttcctatatttataatattattgagggtcaaaattacatgatgaaggcgtaactgtgcatggttcctgtggccactgaatccagataaatagatagataaactctatgtccagaaccaaggagtctattttggttgtctattgtctggatccactcattaggctggagaagggttaccagataaaayacaggattcccagttacaagtgaatttccaataaacagcagtataaatgtcaagtatcacatgggctatacttatactgctgtttatctgaatttcaaacgtaaatgggcattctgtatttcacttgctaaatctggcatctgtaagctggcaggtacctggaaagactcctccttccaaggaggaaaccaggtcatgggtgaaggctttagtcagggatagggggaaggaatatttcttagtggcagccaagtaggtcaaagtaatgcatgttgtcccatcaaatgcctttctccctttgaaaaacagaagcaattacaggaaggtgagcctaaccaatgatctgtgaaagtcggaggttgagacagaggtcccacatgtgtacatctagaaaaccagttgggtgatgtggttaggtttggcttttggttatgtggatatcctagcaatattatgagtaagtgaagaaaaatgaggttttggggaatcagaagggcagggctggcttgccagaaggactaactcctgatgggatgtctggttttcttaacatctagtattgaaagttacagggcaaatttggccttggtatgggcaagctatgcaattcaatgagatccaatgtggcaggctggttgtgggagaaaggcttggctcccacagacagcgctggcaagttagggttaagtgtcataactcttgacccagtaggggcctggagaacataaaaggtcatgatgaaagaagatgaaggctggagaagggagttaatgaggacaccagcttaaagctcttggactcctaggcttctcccaacactctaaggatccttctagggaagcctgtttaattctgggtctagcctaggggtggagttgaggcagttcatggcctatctgctttggtcaggctggctcagagtttaggaggtgggaggcccatgagatagaccaaacagtcaagatctgagtagctcacaggaagctagaggaacagctcccaaatcatcttcatttgtgccaggaaggtgtgtggggtagagagtaggcaatgtaccagacaccacatgaaggagtagcagaaacagttggagaggcaagactgattgaaacaggaaagtacaggccaaagaggcagatgagtcatcatataaagatagcactagacgccatagaaggtcttcttcttttgaaaagcagaaacaattatgaaaaggtgsggataggcttttgaaggttgtgtctgatctctggctaggctcacaagcccagcaggagcctgtcctacaaagcctttccctgaggagagcttgcaggttgggcagcctaagccctcgacagaaaagcacatgtttccatgaagtctgaagtctcaaatgattgcatttcatggagtttgccttgtgcaaagtcatagaaacaaatscaggtgcactgtgggcaccagagctaataaagaagagaatcttgtagacatgaaagagagaargtaagagagataaaaggagatatgtggaaagagagagagagaaagggaggccataaactttggtggtttttgcctttagtttcacttatgtaggcctttttgactaaaaattctgaagattagtgtttgctataccttcagttaccttatttttcgtttctttctttcttttttttaaattttgctgagacagggtctcattctgtcgcccaggctggagggcagtggcacgatcttggctcactgcagcctcaacttctcaggctcaagtgatcctcccacctctgcttcccgagtagctgagactgcaggtgcatgccaccatgcctgcctaatttttttgtatttgtagagatggggttttgccatgttttccaggctggtctccaactcctgagctcaagagatccacctgcctcggtctcccaaagtgctgggattaccatgcccggccccagttaccttctttttcaatatttaagttaggtattacacaaaaatgtttgcaatgtaattatcaacttctataaggcattccttacttgtttactttgcactaagttgatttatattacagtgttgagaagctcactgtctggatgtggactgtgctgggccctgaacacttgcttgtctaacttctttttttttaacatttaaaaaataagctttattttggagtaatactagatttgcagaagagttgcaaaggtagtacagagaagtctcatatgccccttgcctagtttccccattgttaacatcttaacaataccaagtatatttgtcacaactgagaaactggcttgtctaacttctaaatgtgcttctaaatgcccaggctttcaggagtggagaaatgccctactcaggttgatgttttttcttgctccgggagcctgaactttccacccttggctttggtatccatgtgtggtcccttttccaatggtgttttcctttcttatttgatttttgtatttatcatatctcgatttacattcccaaatgtaaaataaactatttcaaaatgattttttcgtacttctagagttgaaacagaggaaaaaaatgcattgttctggcaaggaaaaatatactaacaggagtaaaataaaaacagtcacttcatattcaaggccaaactctggaatttaatcatctcttataaaaaaataaacaatttttgaaaattacttaattcatcactgattgagcctggaaattagatatcgaggaacaaaaacaataaaactctgttagttagcatgaaaaggccaaagcatgtttagtctaagtgtttaggttaatagacaatcactgtgtgttcactctaaaataagagatcagttgtgaaagagggctctagtgagtgggttaggaaggtacaatacatgagagcactgggctgagagtctacttccagtttctcaggctaattctgctacaaatgctttgtatcctccaaggcaagcaactttatctcaagccctgatgtcttcacttgtaaataagagatagttagagataaagaagtggctcaagatttccccaaattctagattctgattccataacaaaatccaattccctaaacactcaggagtttaattgagtattattggatgattcacttggcagttaggatcttgctgtggaagagggtcaccagtatgaatattcactattgtgatgatgaaatgtataggtgagaattcatggatagttggaggatcaaacacaagatcaatgctttcaaatctgctttatgatgtggcatacatagaaatcaggggtaaacagatgaggatgcctagacctggggcatacttagattctctaaactattcccagttcctccatgggctcatacttagattccctaagctcttcctagatcctccaagggctgagaggattgatttcttaggtaacaacttataacccagtaatggcatagcctagcccaacagtcaggaagctcttgactatggaccagaatttgctctagaatggagagtgacatgtaacacaataaacatgatagctactaaagataacatgcctttatatttttattccttttttttttttgagatggagtctcactctgtcacccaggctagagtgcagtggcgtgatctccgctcaccacaacctctgcctcctgggttcaagtgattctcctgcctcagcctcctgagtagctgagcttacgggcacatgctactgcgcccagctaatttttgtaattttagtagagatggggtttcaccatgttggccaggctggtcttcaactccagacctcaggtcatctgcctgccttggcttcccaaagtgctgggattacaggcatgagctgctgtgcctggcctatattttcattctttagttcttgtaaaaaaaaaattcagaataaatgagagggaacagatgatgtgaagggggtggatagtaaatacagttggtgacacactgattctgagatacctctgaagcatctgaatgtagatattgagactattggtagatcctcagagctggaagtcatgagggaattgtgggctgcagagagttttggaagtcattagcctatatagatgagagttgaagccatggatgaggtttctctgaaagagagaaaatgagaagaagccaaggataaagctcaggggaacactaatatttaaggagctggcaaagagaaggagctagcaaaatctatagggttcatttacagctacttacacagtgatttaaagtcatttcatatgtgaaaaacataagaccaatggatatccacatatagatttgatttgtgttgtgtaaggatatacmcaaatgcaggcaaaggaacccacatgctgtggatttgttcactcattcactcattcacagtggatgcattgattctttcaatgaatgtttactgagcacttactgtgttcctggcattattctaaccactagggatagagcagtaagcmaaacaggttacgtcccttccctagcggagttttactatggcacataccaccacacacaccactaaatactttagagcttgctctccaagagggagagcagaatgtagacaggctctgtatttttacctctcaagaatcctgtgtcttcctaaaggattgcttgtcatcacaccaactcatagctttggccctggtgctgtatttgacttttattcacttaaaaggttaactggatggctgaattacaggattctagccaaagtgtgctccctagaggattcccagctaatcagtcagctgagctgagctgacgactgtcttccattcctaaggagctgggcatttgcaggctgagctcacactgtgaaggctcagcaagaccttgatctcccttcccaagtcatggctgagtgacagggagcagcaaaggtcatggttcaaatctgaggtggcagattctgaggacaaagcctgcagagatcgctttctattgggaactttctcattttaattccttgtcagaatattccaactccaggccttccaactccaaggaaactgaggcaaaaatctaccttctatcttgttatttcccccagattaatatttttcttaaaattttctcagataattagtagatcagagattttctttattttggggctggtatgttttgggttttcattggctaattagccaacttcatctctagaactttctgtttctatcaatatctatccaaggatgtctctaatctccctggttctttaacgtaattcccatgcatgaagccccccacacccgcttctttctccattgtctggttgagatctagtggaaagcctacatggcagtggagattggaaagtagtctttgggtgaaaatatgctccattatggctaaagtgttggctatgccagtccttttaattaatgaacttaaagtaaccttakactccttcctcttccatcatctgtcatacctaaataattatatatgaattagatttcttaaaatgctatatgtacatgcatgctttagcaagtaacttttaatgcatccctattacagactggaacccaaatttattagcctattctttgacctagtgatgagtgctttcaggatttatcttaccaatagagtcatacatgcaaaataacctatttgaaaaattatttattgtagcattatatgtaatagcaaaatacaggaagtgatttaactgtccatttattggggactgttaataaattatgattcatctctacagtggagtactatgcagctgttaaaaaggaaattatttatatactgatgataatgacctctaaactatactgtaaaatgaaaacagctaaaatttgtgaaaaaagaatacacacgcatacacacatgcatatccaatttcttgtaatatgcacttaatatccctggaagcatacataagaaacatcagtttcctcaggagtggagagttgggtaactgaggaataggagtgggaggggaacttttcactataatatgctatggggacttttgatttttgagccatgtaaattgttacagataaatatacaaataggagctaggcgagatgcctcacacctgtaatctcaacactttggtaggctgagataggcgggttgcctgaatccaggagctcaatactagcctgggcaacatggaaaatccccatctctacaaaaaatatgaaaattagccaggcgtggtggcatgcacccgtagacccagcttttcgtgaggctgaggtggggggatcacttgaacccaggaggttgaagccgtagtgagccttggttgcatcactgcactccagcctggtagacagagtgagaccctgtctcataaataaataaacaaacaaaaacactttaaattttaaaattcttcacctggcatttgaaagcccctcacaatctgcccttgattatattatcaggcatatttctagaatatcacattttcccttgcacaagccgtctgctytgcccaccaagcacctcctgcctcatgtgtgattccatttaggtcctttcaaagccaagttgccaggttctagttccaattctacccaactcgcgttttctggaaactccgcaaaaagcactgtgcctgcagctgcaggctatactctcaacttagccttttctcactttgtattccctgggcatgtaaaatttgttagggcaacatccttgatcttagacccttttgtggagggaaggaaaataaatggggtagaaagagctgacaaaagcttcaaacttcttcagtatctgcttaaaggcccatctccgctaggaaaccaggcctatccattcagccatggagatctcctcccctggctcctataagtctaattatgatgacccataccaccgcccagcaccgaccttatgtagccatacattgacatgtgtgatcatgctgtgtccccccaccaactcaatctatgtctttaccaaatatttaatgaacaccaccatgctaccatgttaccaggtagcaaaagatgaccragaccccattcctgctgacaatggaactcataggagaatcaaataacaattgtacttgaagaaattgtctctaagatagtgcgacatggaattgagacctctgtgctctgcatggaagacccgagagggctgctaaggggatactgtccttgacatgagtcatgaggatatatatgtatcacttttcaagtggaaacaagcggaaaaagaaaaaggcatttaacaagaaggtgtttcaggagaattccaactaattcagtatggctgaagtacacagcacctgcaaaaaagcaaaggtggtgagggtggatccataggcatgagctaaaacaaattcctcctgtgtgtaggctccttagcagcagagatttttgtgtgtttattgatggatcctgggtgctccatagtgcctggcacagaacaggtactaaatatatatttgttgtataggaaaacaaatcaatgttggaaatggattaataaatgtatgtcaggaccagaagtttggactttgacctaaagggttattgaaggactttagtcagctcaatggctaggtcatacgttcatttcagataagcacgtaatcaactggaaaacaaatgaaagtatataaaggggctcaatgtgaaggcttacagagaacacacagacatcatctctttatacatatatgtaatgtccaataataaaataaatagcaataaaaatttaaaacaccaagtaaaattaaaatgtgcaagatgtacatctttaaaaacaataaaacttaataaaagaataaaaagaagaagacttgactaaataaagggaaacatcatgttcttgggcaggaagtctcatattgtaaagatgtcacgcttccctaaagtaatatataaatgtaatacagtttcaattaaaatcccagtgaggttttgtggtacttgacgaatagcttttaaaattcatttatatgtacaggtgaatgaaaacggccaagaaaaacttgaaaaaccaataaaaatgagaaaggagcttgcttaaccagatcaaaagacaccaaataaatttatggtaactaaaacagtaaggtactagagcaggaacacagaaattgaacagagtcaagtatctaaaaacaaatcttgtgtatagttagcagtggtgatagctcacatttattgagagcttactatgtgcctggcatttttctaagcattttgtgttactcattttattctcataaaaccctctgaagggtgtcttgttattatccccattttatatatgacaaagcacacatagattatgctacatgcctatggtttcagagctggtgagtgacatccaggctgtctgactcaaaagccttcattttcaatcacaataaaatggtctttctgcaggtaaaaagcagaggcattcaaaacataagagacaaatttgactatataaatatttaaggcattgatcctgaaaaaaacagtgttaaatgaaaagcgaaaagctaggaaaatatttgcaaagtacgggaattcttacacatcaataaaatatgaacacctaaatagacaaagtaaacaatcattatgaacaagacaatttatacaagaagaaatgcaaatggccaataaacatataagatgctcaatctcaatggcaatcaaaaaaaagaaaattaaaatgagatgtcatttttctcccatcagaatgataagaattaaaggtaggagcctagggttggcaagaacatggtgggaacagtatcaagccaacaatattggagcttgaggtaaaaggaaaaatcaataatattgattctacctttatttcaaatgttgatattttgttcatcatggacttttcttgcatgaattttgatttaaaaatattgtatcaaaatatttgttttgattactgaggtttgtttatagcacgttaaattttgtgtccaaggaaaagtgcctcactcgtgtcatattagtcccaactctgcatggacagtctgcaaatataaatcaaaatgtttaggtatgcttagccactactagcacagcaattctttttctaggaatttaacctaaaggaataactcatcaagcacacagagataaaagtacagagatgctcgttatggtatgactcgtaagaaaaagttgtaaactatcattaagagattggttaaagtatgatatatttgtacgctagaatactatacaggcattaaaaatgatgtcatagaggtgtgcatatttaaaggaaaagatatccgtgttgcattaaagagtacataaaaaagcaagaatatgtacaatrtgtacaataattccaattatgcaacacacacatgtaactccaaaaaaagtcttaaaaagtaataagtttttattggagtgacatgaaaaagtagcaaaatggaatgtcacacttcacacagtctctcatcrtggcagctattttattttctctcacaaaactcccttttgctaacataccctcttacaattttttgacatatttcaatttccccatggtagcacrtagtgcctcatatgcctgcatttaatctgcccccatgttttcaattctatagctctgcccatcacccaggaggactagtacctttaacacattagccttctttcctacaaggcaggtgtaacagacatttatttttcttaggggaactccttggcttatgagtctgcctccctctatagaagccagactctttttattccagcctccctttccacttgagcatagacatatgacctgggctcagtcaatcagctgcccctgcccaagacttgcaatcagaagctagtgactgaaagcagcaggtgccatgtagaatccagtctggttgtggtggtggcagctgatgccttcagttttcagaagcagcaattgcagggytcccggtggaggcaaccagtgcccagcatctgccgggtcagcagagcaggctcctgtactgcgttcagtggtggggctgttgtgtttcctccagaccagctctgcagtatgactgggacttctctggccatgcagcctccacgcctgggttgctgaccattccagagattctgtgagtgacttcacattctttaacaaatctctttcctgcttaaattaaatgtttgctttccattgttttcaactaagaatcctcactaatacatagttatttttggtactgccatatatatgtgtgtatgtgtgtagaaatctgatttcaacacccattatagcttactctcccaaagaaaaacaagtgtataggttaaatcaagttgatatgcttagggaagcttcattcatctagaactgtatagtcaaatacaatagctactaggcatgcatggctattcaaatttaaattaattaaaagtaaataaaatttaaattcagtttctcagcaactctagccatatttcaagtgttgaaaacccacatgtggctatgggtaccaaaccggacagtgagatttagaacattttcattattgcagaaagttccattggacaggacaatctagagggatcttgagatttcaccagcccacctcactgaaccatcacagagagtgaaaaaccactttgggttacatgcattgcactatctaaccatatcgcagaaattttgtgtcaacagagaagtaaccttgctaactagattagagtgtgttttacttctctatttaaattatwcttgttttcttgctctctgcctcccagcctcccattctctttctttccttgccaggactttgaattttttcaggttacttggccatatgctttaagtcttcttgtgatagtatctgccccaccaactttacaggattgctgtgagccaataatataatttgggagggaattttatattcatgattggtctgaaatgagccctgatattagatgattctatgattcaagccatctgactttgagcaaatcactcaactttcctggattcctgtttcctcaccagtcaattgaagaagttgaataagataatttctaagttccattaacaacattaaaaaattatcttattttatatagagccccaaatactttatttatgatctcttcagcagagctgaggagttctgatgcaggtggccaatgatgaggcaggtagagatgacaataatcaagaatgagtcttttttcaggatttgatgggcactagcccattttactagaggcaaaatgaatataaaaggcagaacagcaaagtgaaagcttatactacaacctctttctctcaaatcactcaatggtcatatttttcatgcaccgtagttaatgtttaaatgttcagaagaaattgcaaatacgtgaagtttttaatctctttctttttgagatgcccagcttcatgcttggcaatgcattccttgctacgggaacacagtctacctgaaaatgattccattgttgttctaactaactatatgttcttctaaaaaatgtaaacacatatttcagaggtaacccctttagatcagtgccaggtccatcccagagaaaacctcttgggcctccgcaaagggctttctattcaggaattcaaatacacaygagagtgtcaacctgtctctcttgagtctcctccactacagtttctattaccagattaaaatgttaagctgaagcttcttgagaagcaagggtattctaggtgagaatgtgttcaagtcttgcagattggatagcttagaatatctttttagaactttctatcaggaaaatggacagtccttattgttattagggaattgtgttatgataacaacattcattaagcatttctacgtgttaagcactttatatgcattatagcattcccattttacagatgtagaaacagggatgcagagtggtttggcaactgccttgccttacatctcatagttaatcaatggtgtgaagttgagaggatttgaagcttggagctgctgcaaccatcttgctcctacttccaggtggaaagtgatcacaacacacagaaggaagaagtaaaagaagcgagctgagaaaaatctcatcctgatgcagcaagtgagccctaaaatcagttgtgcctgaagccagctctatccctgcacactgaagctttgacgaatcagtcccaacccttttcacttaagctttgggtgttagttcttctttaatatgtactctcgagaattttacttgatctaaacttgttttatttaatgttaccagtgaaaatatacataaccttatccaagggataagttttaattcaggagtgtgcagaaaaatagttcaaattttttttattgtggttgaatttaaaaccacaccacccccattgtggctcccataagctggctggacatggaggtttgtatgtcacactcaccccctatttcctcattcaggaacctaagccctgaattgcactggagaaataatttactgtggcattttactgaaacatcctgtggatattttaggtatttgcacagagaactttttgacctttgaataatatatgtgctgagaaaggtcttgggatattttaacaacatgttaaactgagatagtcctgatgagatttattttggtctctgttggctgctacgttttttcaaatcctgttggaatttttagtttctatgaggacatttccaagatttttttactgcagcatatttcatgctatttaatggtccctttatcaaagatgacaggcaggcagttgataagctctccagagagtgactcctcataaagcctttcctccgttaatgtgctaggtacattgccaccgactcccatggccacctgagcctccagtagtcccctccaacttgatgtgtcctaaagtgggtgctgggtacttaaaatgaatacacaattttctaacatttaaaaccgctgattaattctctgaaaacataagtgcaggtgatcacaggcataaactggccagtatagccaaaggcatcatgaggattggatcgcttccacaggcagtggacattagatgattctatgattctagccatctgactttgagcaaatcactcaactttcctcgattcctgtttcctcaccagttgattgaggaagcaaatattaattagattaattaattgaagaaataaatatgatcagactttccccaacagccccttggtagaggaggccagaagtaattctgtcagtgcggtatgacagactgcagcttaaacagaggattaattgaaggtgcatgcatttaaaccacaaggtgcatattctcccagaatgcaggatggttcctaggctagggtttggtatctttgaaggacctgtttaaatttctgtgcaagtaggctgccaggaaatacattcctgccccggaggacactttgtctcctacagaaaggaactagcattgtggaaatttgtgggtgagaatgcaataggttgattctaaattatgttaactggattttcttccaaattaataaaagagcatggactggacctgattgctcattgctgagttcctagaaatgatcacttgtttgcatacaacaagcgtgtactaattatttcttgagtgaacaaatgtgctaaagtggtgagcaaatgtcttgaggagacagaagttaccttgcaaaggagacttttggaactgrgtgttcaagaatgagtaggggctctcttgatgaaaggaaagaggagtaataggagaaaaagaattgtagtcaaggaaacagaatgcacaagggaatggagacatggatttcaagcttctagtaattcatagcaggaatctataaggaaaatcttgcacaaagttatgaatgacaaaccttcacaataaaagtgcaaacaaaatcccaattcataaatgtcttgctgtgaatattggtcagaagctggactttcgccaaaacataagcattatactaggtcaattacctttgtgaggtgatgaaacatttctagaagttggcagggtcctccgtgctggttttataggctattgcataatgtcaacttattctagaatgttgcctgaggctgcatcactgggattcaaggattggtcaggaacatacattaaccgtctgtgtttgataaagtgggaaattcttctacaattggtctttggctgattgctgtgtttttgccagtagtgtacttctgacagtttggatttggcttaagaaatctaagacaatttttagaaatcaatgtgtcttagaaaccattaaacacatttatctccttttataagtttaggatatgaataagaagagtccttaaggaatgataatcacccttttctcaggccaatgggatgtgttgcaaaagagaatggggataatctccaaagatgttaggctgctgggcacaccagagcatattccctactcaagcaagggtggagatgtctgcaatctttctaaccaacaacatatcttgaatagcgctcatttgccagtggraaaaaaaaaaggataacataacatcccttatactaattaacaaaccatctggtgcatatttagataactattcctgaagtgctttcctttgctttccaaccggggactgtcaaatgctaaccaaccatcctgaagcatgaattgtgtgaatttcttattaggaaatgcagatgktaaactaattacacctggagtgtatattgacgttaacttatatacatgtatacatacagacacccactgtctatgctgaactactctgaagtaattacagaggagattgtgtcttaattcctgattttttcctaatggttccatctctacctctactgccagcaaataatggaatcaataaggctgcatgaattaaccaacttatactggacatgattttgctcttttctgtgtcaaatgatgcagttgtcaaacttcttatagtagtttagttctcaacaaattcattcgttatcctgttgatctcatcttcctactcttctgaaaatgaagaaaagtaaactgaagaaaaaaactagtcatggctccaataccctaacacaatcaccttttgaatccagtaaaaagaatggtgaactagaatgtttaaactggagtgaaattgtaaattaaaatatgcttttctttgtatagtctgattgcctgattatcttttacctcagtggacattaggggtgagttatgttacatctaatttattaccaatgctattattattaatagtagtatttcttgactataaacaataatttataatttataagtaaatagtattatttatgaaatgctgaacattgtgaaaaattttgtaatataaactggaatagaataagcatgttatactcctacacatgttctcaggtgaggaaatgttgaagttagccatggtgcaggttaatattcatatgtgtggcatgtgcatcaggggagaagagagggtaagatctgtgtcttgttttggcctgagatgcttatgtatgagatgacattggctttgattctgctccagccacagagctggatggggactgtggatggtgccacaaataacgtcctggccagatttcagccaggtctgcgatttgagaagctgggtactttcgtgccttcagcaggagccactttggcaggaaggacaatgagacaggaagaccccaacgagacctgtcttcctcaaagcaaattcaaattacctgcgtcattatgtgcagggctggaaattgtgcaaagaccaatgtacagatcaatggaagtgaaagacattgcacgtaagaatagcattccttccacgtgtacctagctctgtggtttccccaaagctctcaggtatattgcctcagaaggctgggaaggtagtgtgctgtgatgggaatagcaccagctttggagtcaaacagtctgaaagctcagctgtgtcttcactgtgtccctgcatgttcattatttataataacatatccatgacaaggttcctgtgatgattaatgaggtatctttgggggaaaatagcttttatttataattgattgctgtcacctaagaatgggtggatgacagtagttggaagactttttgtttgtttattagattgatgggtggtgggcacgcaaggttagactagttaggaaagagctaaattgtttccactcattcattcaacacatggatatttgggatatagatgaacaaggcagacaaagaccctgatgatacggtgattaccttctagttggggaaagacagataataaagaaatagtcaaatagaaaaaccatataatgcgggtaatgatgagtgctatggagaaaaagaaagtcaggggaggggttagagaatggctgaaatggaaagggtagcagggagaaggtctccctttcaagatgctcagagaagtcctctttctgaggtggtggagcaagttgtgcaaaattcagtgttgaagagtgttcctggcagaggttgctgaggtataaagaccctgcagtgggcatggggtgggtatgtgtgacaaattccccagggagatcaagggatcaggagtagaatgaggcatgcatggtaagaaatgagttctgagaggtagacaggacccagataatattgagaggctcaagttaggggttcagattatattctataggggctgggaagccattgaaatgatttgaaaagaatgattccattaatgtatataagaaaagggcagggatttagaggcctagaaggaagaatgaggaaactagaatgggaaatagagtaatttagatgcatcctggaaaggggttgagggaaaaatatatcccttaccttatcttcccactggcttggtcaaagagggtcgttggggagaagagaagtgacaaaagaacatttgttagattgttcaaagtatggtgtataatgagagctcttgcctctatctctgctacagaatcttcaagaaatctcacactggttaacaatactttagggtgagtagatcctgaatggtgagtgggaggaagtgttgtgtctggcttaatggctaggcagagtgagaacagaggctggaacacacgtggaaataccctggtgtggtacaaagcagagactcaagaagtgtgcctttccccttccgtagtccttacttcgttttcaatctgtgtgtagggccatctccttgtttatggaatgacattcaaccagcctgagttcctttcaaggctgtcagtttataaccctatggcctatggcttttatctcccagacaagggaactctctctaaatgtaatttttccctcaattttaatcacagcatttaatgtaatcatttrggggaatcaatctgaaaatcatcagggattcttttttctttttactgctaccacgaatagtgattgtgcaacagagttggggaaagacttttgtttttgatgttgcaatagcaggaaatagaaagttgctgctgtcagccacttggtcagagttacatttcttttgcaccacaaaagaagwcttgtaggagactggaatatggttccaggtaacccaactatacattcaatgatgaatgcaccactgcaaaggagaggtgtggccattgttgagtaatttgatgaaagaacaactaaaacagattctagatgatttaaccttgacttaaagtaagcccgagggggagaccataattataactaacttccatttttcttggcagagtctacagtccattttgttttcatttcatttaaagtattcccactactggattatctccattttagatcaataatcctcttcctccctttgcagtggctttaaatgttttaagaatttgtagtcattttttttttaagctatcctgaggaatcaatctagactatcacttaggaacaagaaatgcatcataactggcatcttgcagctagtataaagagagtaaattacaaattaaatattgaaactaacattgaactgtgctgatagatagccaataggcacatttgtcaatttaaatttaaatgaattacaattaaataatattaaaattcagtcctttatttgtcacatttcaggtgctcaaaacagccacatgtgtctagtgtctaccacattgatgtaatagatatggaatattttcctctttgcagacaattcaattggacagcctgatttaggaattttaatagttggagtcaagagaagagtcctttagagtgtataaagaggcaggagagtctcatcaaacagattccatgacattttaatttcattaaacatgacttcttcagcaacggatccatgtgttagaaccaattagctatcccaaaggaagaaaagtgaagataactttcccacaatttccaatgtgttagtattgcccagattgtaggttactttgcaaaatggccaaaagcatttgcagcacacggaaagagggtccctctgccaaataatcacgaggaccttcccctccctggagaaatagattgaaacctcttcccctccctggagaaatagatccaagcctctccactgccatcttgtcaracatatttacattgctcaactgacttgggaagaaaacaaatttccagtatgagactctctggtgggccaagctgtttctcaaggagcattgagaaataatagcaactccaaatattaccttgggcaagacaaggcaaatgatatccttaactttgttatccaagcatagttgaaagagtgtcttcttccagttctctgtgtctttgactctggctagaccctcagggcctggctactgccttgcatactagattcatgggtattttcctgaagctcctttgtagctcaagctgggcctgctctccagcaactcaaactcaagtagagcttttggcccaccatcttttatgatctcctagcactgtagggaaggacacactgtgtatatatgcacattcgcacacttgggatacatgctctctgaggggctctgggaggtcatgtttcaaaggcttcctgcatctggggagtctgggttaaaggcagtttcatgggacaaactctcagctcaaatcttgtcctgcagggagctatgagccctgagtccagtaactttaatcttcaatgctatggaattgggtagaaaaagactaaatgaaatgcctgtaatcacacagcaagttaattatggaatcaaaaaatgattttttggctgaaatgtctgttgcatgattaagaagtttcctcttttcattttgcactgctctttataaaggagctttatgtgcccagaggaaaagggaagatggtgtagatactgattttcacttaatagagttcccttgggatgtttgttagttttgtcccaggcattaatggtaggtctgccttcatgcaccttttcatcatgctgataggaggaagagaaacaaaaaagaatccttctttccctgctgcttaagactgtaacttgggtttgccttctgtttgtgtgcaacaggcttgggaagacaggccatctctctcgttctcagatgttaaggactgggaccaaatgagaagaagaaagccaagtaggcgtttctcccatggtagttatctttagtctatgctgaggtcatgtcccagcataagaaagttgcctgcttatgggcttggggccaaattcacactgattcttgaagtctggaaaatcaccaaccattccagcatctaggatcagacttcttcacaggcacaacgacggttaaaatcccctgtgtttttgtcttgcgtttgtatatttatatgtggaaaataggtcccggggaactagtcttgtacaaaaaagtgaattactataaatacatataatttgtgaatatatgcatgtacgtataaacacacactataaaagttttctgtagcgacaatgaacatgagagaaattgatcatttacatttaaattgaataaattgatgatttattggaagacatgttccaagaatggtctaggtgttatgaaagggcttaatcttccaaaccgaaagtgaattcagaccaccactcagtcactattggccaaacaatagtctaagcaagattagttattctttctttagttttagtagaaggccttgacgtagagccatttttgcttcatgactgaaaatatttgactgccattttctttttttacttttatttttatatattttaaaatttaatttatttttaagtttttatgtatttagggggtacaagtgcagatttcttaaatgtatctatcgcgtagtggtgacatctgggcttttagtgtacccatcacgtgaatagtgaacactgtacctaataacaggtgattgtcaaccctcaccccaaccttccactctcccgccatcccaccttttgtagtctccagtgtttattattctggtctgtatttgactgccattttctgaagcctggagaaaagcatctcttcccatgattacagctaacatgtggtgtgaatatgcaacccaagagcaattgacaggaaatagatagccttaaggaactgaatcactaccactgtcgccgtctcttttgtatattagccttggccatgctaatctttaacatcattgggaactagaaagcatttgaaaattgattataaggacagcatagtgtaagatgattttatcgctagggaggcatcatctaggaaagtctttgccaggaagcgttctttctcattctaaatcctaggaggcacaggaggaaagctagggatgagtgctctggatcataaggcaccaaagggatcctggaaacgctatgattacagtggcttccagagatgtggtaggaaaaatgtgagcaccagtggtcagcatgaccaacttacaggtccagcaaactgggtggcctgagtggtcatcacgatgggaaagacatgacccatggatctatttgttctgtgacagcacagttaggactgtgcagtcatgggaggtgactaacaaactcactgactccatggccatgtggccaagggtgaggttcagcttgattgtacaaagtgtcactcactctgctgagtgtgtatttggaagaagaggcaagtgaaatgttagagacagcagcagccactgtaaatggaaatgaagcatgccaggagacctgccacagatgaaaagaagcaagccaggcacacaagaaagaaaggttgaaggaaaacaggacaagggctggaactagggctttgctaattttagctaggtgcatctactgacctcatagtaacagtaattgacagtccaacaagaacaataactagttagcacacagtcaattagttatttttcatcctacattgtttagcaaatatgtaagtagttcactcatagggttccaaggcttgtgctttcaaagaaccaaattaaagaactctgttcaaacattattactaatcttaaaatgggcagttgccatccagtttgaaggttttattccaactgtgttttctcaaaaccatcataacatttgggtgttggaaacaaaagacattaggtggatggacaccaacctgactagcatggctttgatgccttggcatggaaaatctttattgagtcttccagatggcaagaggcacagacaatcattatatatttggcctctaaactgaaagtgttcctggtaccaatattggaaaaaaaagaagtggtactcatttactgagcaccaactatatataatctattgcacttgctatgaatttctttatatactcttatgtttccctcacagtrtatctgggaggtagaattactattcctctattaaagataaggaaacagtggtgtaaagtttcaagtgagatcttcaacccactttctcacagttgcccccagakcctgccgctgagaacttacartttggagaaacgacagctgccaccaggggcttactgattggtgtgctctttttgaagaatgaacagaagtaaaagtcatacagttaggaaaagagaataaaactgtctttattcatagaataatgattgtttaggtaggaaattaagaaatctacaaaaagttactagaacyaataagtgaatttagcaaggtctcaggataaaagatcaatataaaaacgtctatttctatacactagcaatggatgattgaaaaatgacatttaaaaacatttcacttacagaattcctggaaagcattaggatctgaatcatttatcattacggtagtcttctatccagaagaaaaagggagtcarcagagaagagttgctaggaaagtcaaatgtctacattttacttccaaagagttgagaatcctcagactctttacaccatgcccagagatactaaataatttgcccaaatccacacaactagtaagcccaaaaactgggatttgaattttggcatctttgattaaaaaaatstctagttttttccacagcgcccctgcaattaattaaagtgtttccctgtgtactgcaaatgtaccttatctrctctttattccaagagcccaaaggttcaaaaattgtttccgaactctcagaatttccatttggctcttggttggcattcaaagtccaatagtataataatgctgtctcatatttgaacaatatagtttattaaactttcccatgtattacctcatttggttctcacaataacttgtggataagaaatggttaaaattatctcaattttatagctgatgcrtagctagacccagatgaaaatctactttgaaaacatcaactcagaaagagcaccagactttgctgacatagacagggttttgttaattcaagtagttcattgacttagacaacatctaagcattgaaatttatttaagaaagtacaggttgttatattcatttacttaaaccagtactctaaggaagatggggaaacggaagtgtggcctcatgttttagagaatgccatcaattgtaaaaagaaataggaaactcatttttaatatgcctatttaaaaaaaatagatgtcatgactgaaggctttactcatccaaagctgaactattccttggtatataggtgtatagatcactgattcaaaacattcaagagttagaaagggatcttagaggtctcctagttgaacctgctctttcctagttgagggaacagaagctccaggattttcaatgattatttctggtcacaccactaattagtggcagaattggtcttggaatccaattagagccagactccaggccagttctatgatacaccccaagctcaggaatttcttcctcctctttttaatttctatgagacastttcaataataactttgaggtctctagttctgagtggccatgattttgtaatgcaagtgatgctagctcagaaactccatgcctggccctctctagacacccaagggaagggctgcagaacgtgggcaactcccagggcttttgaggccctggagcttcccacccggaacacaaaatacactgtcatgtgtcatcttgctttgtgacttctcatcttaaggtcttgtcaaagctggccacgtaggcctttgaaaatatcatagagttctttgaagtaggttgtttacttttcttgaaacacatctgtgattcatcttatttgcattttaaaatgtaagtgttttggccagcaatttgagggagaagtccaatagaaaatcagtataccagtccaatttgacagctttcatctaatctatcatcactttctattcatttgttcactcattcattcagcaactacctaatgggtatttactacatgccaggtactgttctagctgcttgggaaacagcagtgagcaaagcaaggtcaggaaggtttcattccagggaaaagggacagataataaacaaaggtataaattttttatgtgtcagatgttgatgagtactatagcaaataagtagggtgagtgaggatagggagtgtggtgtggatggtgctgattgggatggttaaaaaggcttctttgctaaggtgacattttgtgtagagacctgatggaagggaagaaacaagccatgtagccatttggggtaacaatttccagacagaggcaacaacaaggactggctcctgaggctaggagactgctcggtatgtccaagaaacagctaaaaaataccaagtggagtgagtgaggtctggaatggtagaagaygaggtctggggaggttgcagggaccaggttttatagggctttatagaataatataaggacttttgccttttctttttagayggagtctcactgtgttgtcaggctggagtgcagtggtgcgatcttggctcactgcaacctccgcctgccgggttcaagcgattctcctgcctcagcctcctgagtagctgggactacaggcgtgtgccaccacacccagctaattttggtatttttggtagagacggggtttcactgtgttggccaggatggtctcaatctcttgacctcgtgatctgcccacctcggcctcccaaagcgctgggattacaggtgtgagccactgcacccggtcagacttttgcttttttaaaaaactagattttttaaattgaggtatgatttacatccaaggaaatgcacagatctcaaatttgttttgaaggtatctggcaattttatactctgcaactatcatgcaaacctagacatagaggattttcatcacctcagaaagtttatttgtgatgctttctagtcaattctccacctgctcccagcccagaggtaaccagtgttctgatttctatcactattctggaactttgtaaaaatgaaattatgcatgcttttgagtctgggtttctttcactcaatggaatgttttagagattcacctgtgttgttgcaaatatccatcgttcattgctgggtagtactccattgtgtaattatatcaccacaagtttattcattttcctgttgatgggtaattagattgtttcttggttttggctattttcaataaagctgccgtgaatattcttgaacaggtcttattgtgcatatacgtttgcatttctcttgggtacatacctaggattgaaactgctgggtcatagggcgacagatgttttaactttatatgaaactgctgaacagttttcccaagcgatggaacaattttatgctcccaccagcaaagtgtaagagcttccattgttccacatgttcactgacatttggttatgtctggtgggtttgtttgtttttgttctaatcattctggacagtgttctgtgtaagaaatatctgtctactccaagatcgtgaaaggattttctcgtagaaacattataggtcttagcatttaggttttagctctaagatccatcttaaattaatttttgtgaatgctgtaaggtggaggaaagaagcagatatccaattccacattatttgtgaaaaacactgtattttcccattgaattgtctcagcagaaggagtttgcttttattccaagtgagaagaaagttgctggggtgtcttaaattttcctcaaggcaataatagttgtcttgcataatagtggtctactttgcatattagatgtytattgcacttttaatacacatgtgcatgcacattgcacacactttgagaacaggaactacatcttgcttttatttttatcctcaacttcagtacctagagcagtgcttggcaaaccataatcaatgaaagaatgaatgaatgaattccagcaaatgacataactttttattttcctgtgtagcctgtggatgtactcatttgtctgtgatgtactcacatgtatgtactcacatgtacaaatgagtacatgtgatgtattcacacacacacacacacacacacacacacacacacacacacacacactctcacagccacttgagtcgactgaagagatcagagaagaaaagaagtgaggcagcatttactacaacctaaaagccaagcctcagaagaagtgagagcctggaactatgagccttatgtatgagcagctcttgtacaaaagagaagtgagataaaatgggtcaggagtctaaaagatggcaatcccagtttacctttgcttttatcctactttgatcaaataatgagtacatgtgatgttctctttgtcaaatgtactcatttgtctgtgttctatatggctcccacacatactatgaccatttccacttgaggttgttagtctcagatttatgggtcattgataatgtacatgcaggattatatatttcttatatataccacataaacctatgctggccccttacatggttaacttagctgctatttttgttttcacttctacatgccatatttggggtagagaagattaaaaagcatatgtggacaacacagaaatggcatctggaaagcagccgtgttgcagcactctcaacttcccttgaaaatttccagaaaggctcagaaacaagaaaaaaatctcaccacagccacaaaaagcatgcttgtcagacagcctgttgccaagacccaggagccacctccctgagggaagcagagatagaaggagtggagaaaggcttttatgcctcccctggagttttccatttacagagccccttggtctattccagccagaaagctgagtccccctcccatttttcaaggagctgattccttttaaggcaggcaaaaagctgcttcccattcacccttccttctttctctattcacccaacctccacaactccccaaatccagtaggataaaaaaagggagggatctttttccctcccttgaagcatgtgtaaagcttaactgcatmctgggaagtgtagttccagcacttaggtggatccaagaagtaagatttatggcagaagtattctacatgctgggattgtagcttttcatgcacagggtgttgagtcagcrtctcaaagaatcagacaatgacggttaggagcaataccccacccgtgcagagctgcattagaatttagagttaggttagaagctgcgcaaacacctgttctgcagctgcaggtgtgagatcatcatacaaatggagggccggcattgatgaagccaaccccataccatgtatgactgctgcctcaaagtctcaagaaagctcaccttatttaaatatttatattgaagaagtaagttataggaaagactacttggaatcagtgaaaaaattgttgaagaccccaggatgtctatttcaggaaccaggagaaagtttcaaaaattttcaaaatatcttttgaaatgtaagccttccttaggcaggcaacactttctaccttgcattatggttgtttgtgtgcaaygtcttaatacacataggcatatacatacatctgcctgcacactttgrtaacaggagacatgtctttcttttatttacattcctaacatcagagcccagcacactgcttggaatgtcataggaactcagtgaatgaataaagaatgaattccagcaaatgacaaaatttgctctttttttcttattgagtatgtggatgttctcatttatctatgttctatttggcctttaagaaaacagaaatggaaaaccacaaggtcataggcatgggagtgggagtgaggtgaaaatgaaaatgtgaaatggataaaatctgactgaaagttaacaactcaagagcagaattaaaattcgtattagagtcaacaaataactgaactaaaccagagaagaactgaataatgattggagaggataaactggaaatctctctcagaatgcagagaaaagggaaaaagctatccatgtgataggagagatattgttagatgtggagggcagagaatggagttccaacctcaaaattataggtattttgagttagtaagaataactgaaacagaaataattataaagactttgaagaaacaattttctgtactaaaacaaagaatatggttgtcatactccaggcaaaatgaataacaatttttttatgacaaagagaaagaaaaatatcttgcagatctcagctgatatcatctagctgcatggcgtgggcaattttcggagcctaattttcttcatctttaaakgggaaagtttccagagagtcactagatccctgctagacgtgactattttatgatttcataaatgtttggaggactagagggtctaagacagcaattgactattttaacatctcatttgagatagaacaagcaaagaacaattgcaagtcctcccaaacaaggctttattgccccttaatataatttgctccagtgcattaactgggattccaggaatgttctaagcaccccagatgttctcatagtaacatcaggacctcacagcctctggcaacactacctgtttttgacttcatgtggagcagaaacctcctgatcacaatgatgtctgtcaaatccagcattaagattttgaacactaggaccctccaacctcccagcagattttggcacacttcttgctctctcctctcttccggaagactctaggactaaggcatcttctccatgagctccctctaagtccatgcatgccctcagtcccaataatttttggcttccagagctccttcttctcagcccaggcaccaagcaacttttcagcatttattcagcatttaaatcaacctcaacagtgaacacagccttcctttttgctcattttcagagcccagcgatttcatagaatggcagggcatcaggtccagatcatttagaccactgccatgaccagcgataggtatggactccacttaaaaataaggctcgtagccgggcatggtggcacaagtctgtcatcctagctactcaggaggctgaggcaggagaattgcttgaacctaggaggcagaggttgtagtcagctgaggtcgtgccactgcactccagcctgggcatcaaagtgagactctgtctcaaaaataaaaaaaaataaaaataaggctcatagttccaggctctcatttcttctgaggcttggcttctaggttggagtgaatgctgcctcacttcttttcttctctgatctcttaagtcgactctagtggctgtcagtgtgtgtgtgtgtgtgtgtgtgtgtgtaggaataggcatgaatttaccagccagaatatacacacacaccctttcctgtcttgtcgtgtcctgttttaggttattcaaaatgttattcagtggccacatttacagcaataataaaaataggcagaagtcatcaacactatgaatagtaaacacatttagaaaaaggtggcagacaataacgacgtctgggaagtgtttcagtggagtctttcctcacatgagcacgcagtggtgtggctgccagaactccctggcttctgtacttgatttacgcaatggtctgggttgccctagttgtaaccatgcagcttggctctgggcttcataaattcagaccccagaatacagtttatttatgttatgactccatccaaaacgttgcaaagaagccaactcccttcatcccattaaaaaggtataatatgtatttttactagcctgcagagcttggcattcagaggtaacaatatgtgctttgttactctgcaggtttgccgtgaagtgtgctgtaatctttgccaggggtgtgctgctctctcccargagggttcacagcccgggaggaacacttcagactgcttaacgacttgctcgggccttgccttatatggaatttttccttctgcacaagagaatgacaaccacttagagtgacagccagcagggaacagatgacagccaaaaatccactgtgctcttggtcccaggatgtcctatctgacttgaacttttgctgtttaggcttgctctctgataatgaatttgggaatgccaacaggtttggaggaataggagtcacttagaaaagctagccagataactccattttagaaagcatgggggaatgtctttcccattaatcctggtaagttagttaacaagcacagggcacaataggtccccaaataaatggaagaaatggtgcaaaatgcaagctacaaagtaggtgtttgatcatacacattcatattttattatttaatttgattcaatcttarggtcagagctaacagaaataaatatatttattattattattgatcaataattattagaaccataaagaagtgtcctcacactcagagtctagtgtgctagcccagtagagagacaccaatgatatccccaggaggtggaagggaggttggtgtggatctggttcaggcactgctgtaaatgctttagatctactgtctcagtgaatcatcaccacaaccctatgagatagtcctattttatcttcattttgcagatgaggaaactaaggcacagggagactaagaaacttgcccaaagtcacacagctaggtgtggctagatgtggcttctagttggcagcagcctagagttcaaatacaggcagtcttgctctatgaagattttaacaggcacaggtggaagagggcagtgcgtgtggcagagatgtcagcaagaacatgagaaaggcatggagtagagaacagggacatgtccagttggattggagtatgggtaagagggttggaggaaaattacaccataaacacaagctactgccatattgtggagggccatgaatgctgatgtgaatatactgtaataaatattgctaataataaaagccaatatttctatggttttatattgtgtataatatctgtaatagcctagctttgtttttacaggtgcccaaaaaggccaccagcagatggattcactaggctcatttctctttgcccttgtctttcaagtggtttatgtcaggctagcccccaggccaccacgctgattttcagttaaaaagtcactggtattgaggttttttaaaattataaatgccttcttaaacagatgttttactytagaaatgtttgttaaaatatattctattcaatttctagtaatggttagcaaatttgccttgacgttcttggggttcctgtcttggcattcatgcagaatttgatataaaattatatatactcataagaagaaccaaagaaccaaatagttcttcttgccagtcacttggagattacaaaacagcatttctgagtagaaggcataatcaaatatgatttcatgaactgatgcatatatgagttagaggccaagaaatattgaatcatgaagtaargttcttctcatttctaaaatactgtaactccataatttttttcttttttttttgagacagagtctcactctgtcacccaggttggagtacagtggcatgatctcggctcactgcaacctccacatcccagactcaatggattctcccacctcagcctcccaagtagctgggaatacaggtgctcaccaccaggcctggctaattttttgtatttttggtagagacagggttttggcatgttgcccaggctggtcttgaactcctgagctgaagcgatctgcctgcctcagcctcccaaagtgctgggattacaggcatgagccactgagcccagctggctatatgtccataattttaaagattacaaatgactctatcaaaagttattctgttgacagtttcaacacaatatttaccagttgaaactgatttttatgctcttggaagctggtggccaccttcttatatgtatgtttggtttattctaggatacttagttgattaaccacttggaatgaagtagagttgtgttttcttttttttctttttttaactgtagcagagtgaccaagcatgcaaaggagggagagagaatatgatccatggcaaatgcaaataccccctatactctttccatctggacttggtgaattgggctgcccttctgcagttgagggtacatgaacagcccagtttctcattcccaaaaggacactagggtttgcagggaatgacgcactacaggggttcccaagacagctggggcatcggccttaaacatgaggcgataggagcagctcttgtacagaagaggagtgagataacatgggtcaggagtctaaaagatggcgatcccagtttacctttgcttttattctactttgatcaaataatgtgtgatgctaacatcattgtattggaaatagaatcatgatgcttcctaagttaaatggcagattgcatgtactgtcatgtgtcctatctgtcatgatgctgacagttacacaattttgctctggaaactgggaattacactttgattttggggtagagggtgttatattggcttgctaggctgccataacaaagtaccagagactgggtggcttaaacaacagaaacttttttgctcacaattctggagtctggaaggccaaaatcaaagtgttggcaggattagtttcttctgaggcctctctctttggcttatggatggccatcttctccctgtgtcttcacctggtcctccctctgtgcaaggttatgtcttaatttcctattcttataaagactccagccatattggattaaggcccactctgatgatctcattgtgacttaattgcctctttaaagaccttatctccaaatacagtcacattctgagatactggggataaggacatcaacagatgaattttgggaggacacaattcagcccatatcagatgtgctctcccttagggggttctaagacaactggggcatcagccttaaacatgaggcgatagragcggctcttgtatttctgtctttagtcccttggtctgcccgttagtccttctagaaggagtccacttgacagatcatgatgcccttcagaagtacccaggtctctcacagtatctagcagggcctccccaggctactccaacagactattgaaattagtcacgcgccccaccatattagaaccactttcctgggcctaggcaagtccctagtgctggggaataatcactggactagtgatcaagagatctcgttcttgtctagattgctgctggcttgctcttgggcaagtctttttctcatctggggctgattttcttacctaagaaatgttgagctttatgatttctgaggttggctatatgtgaattgccctagtaagtgcaaatgtgttttcataggttagaaaaaaaaaaaaagcccaaaaagtattttctgggaattgagagttgtaagcacctacaattctagaatatactttattataaaagttaaaatgttatgcaatcctatagaaaaattcaggaccattttgctgttgtctaaaatcagatgtgtgatctccatcttcttaatttgacagacatttgccacaagtcacttccacaccaggcagagtgctgagcactgtgagaaggatgtgggaattcagaggctaataagttctagtcccctgctcccaaggagttcgttgtcaacctgttttcatcactggatgtttagaagccttggataatatcaaaggtatctatgttggagaccatgggcttcaatttctggctgtcttttgrcatttagaacctaaacagctctgggctggtagacatcactgacatgactttattgttcccatgagtgaacatctgcatgagatcaaaagtagtgatttcagtgtcaccaatattgaaaaatacagaaattgaaattgtaggtaaacccctggatggttatagttmaggacagaaagacaaggagtgaaagaaactccgtgaaacaggaaatgccaagaaaagcctatagcttccctgacttgagacaaagrctgttgactagaatctcttgattcttagtccagtgattattttctagcaatagggacttgctcaagcacaggaaattagttccaatatggtgggggcacatggccaatttcaatagcctgttggaatagcctggagatgccctgttgcatactggcatgtttgattccttattgaaaamagataaaatatatacaattgcaaaattcatataattctgcaaaagtaatataatgtaaaggaaaaagaggaaaaaaagttctgctaccatgttaaaaaaatcatgcaatgctaagtatgatacctgaattagaatggtcaagggtggccaaccagtggagacaaaactcatttccttctcatcctcagagctctgccctaggactgtgtgtgtgtgtgtgtgtgtgtgtgtgtgtgtgtatgtgtgtgtgtctgtgtgtataccaggatgttagcctgtatgaaatttctgggctagatgaaagagaggggttgggattgaggcaagttctggaaaataatttgtttttttctaaaggtcatgatagctacttggatctagccaattgttaccatgaagaaatttttaaaatgttggcaatcaacttaagacattcttttgtaagatatagtatggtccaaacaaaaccatgccttggtcactaatttgcaatttctgttctacagcatcttccagatctttatggttacattaatgatctgaggcaaaaagtgcaattcaagacaggtttctttcccaatgaagaaatacaagataggacccaatacaggcagagacccttgcattccaccctcacccctgcttctggcttcctaagcaaactgtacaatctacttaagtgcgatgtccatgtgagtctttcaaaatatacctgaatccagccaggcaaccctagattttcagttctgttttgtttgctttcaaatgattttcattcagtattccactcagaaaatgtctaaactgagtggggaactgcggttgagttgggcatatacaaggatatcctcagtttgaatcttccctaaatatccataagggaaaaaaccccactttaataataaattattcaaatgtgcattcgttcttgaaacattttaaggatgtttacattgaaaccagatgcctgctccacagacagcccccgtttctgttgattttacagctctcctgctcacttcagttttctcagtagggtctttgttttactcactagtaaaaagaatgtttcttttgtttgcttttctttgccatccgcgctgaccagactctagagggaactccagccatgctgtgatttggctagcatccccttcatttcactcctaaaagtcatatgtacacataatagtaaatcgtttctgagacctcatgcgcttgggcttttcctagctcgttcttcttccatgtggttggagttttgcagcagtttgagtaacagttcaatcatgctctcaattaaagaagttgagtcagttcatgatacccatctcatagagcaagatgaagctaggatttctagggaatttctggccgttcaaaaatgtcatctgaacccaaagcttttatttctaagctgagctgaatccatcaccgagtaaagagcaggagggaraactcatttgttcaaatgcctgcaggtattggcctgagggaatatggggagaatagctattcccaaggataccctttttctttcttagtggttggccattcaaagtgtagcaagaaccagaaaggtgagctatctaagtctaagaaaaagtaaaagtcataaagataactaagcaaagcttttctactcacactctatttggcctgattggtcctttcatgtattcatttgtttattcaaaaaacatttattgagcacctactatgtattgctaggtctgtgctaggtrctgtagtgcatatctcttggtggaggtggcagaagagtccagaaaattttagtgcggtaacttatatggcgagaaacacataggataatgggacactggagaaaggcattcaatgaagaccagttagagtgaaggtagaatgcaagaagacttctgggaggacgtggagcctgaagtgaccatgagtaggaattagcaagccacagcttttcaaactttcacatgcacaggaatctcctgggaatcttgctatactggtgattttgactcaggtctgggatgggtcctgagagtctgcatttctaaggagctcccatgtgaggccaatgctactttgggtaggaaggagmtaaatgatgacttgacatgggaaaagagaaagagggattgaagaaaacatttcaggtagagggaatggtgtgtcaaaaagcctagaggtgtaggagcatgtggaatgtttggtaagttgcaaataactcagaatgggagaagcccaaggggatgagggggaatgatgaccttgaatctggaagcagccatcatattatgaaggaccttgaaggtggtgctaaggatttggggctatttcctaagaacaagaggaaaacactgaagagttttatataaaggaatgataagaaccacttcattttgaaaggattactctgattgcgatgcaacagatggactggggaaaatgccacctagaggcaagagaccagtagccgggcaatcttgttcatccagttgagaaaagatgaggtcctgaacataaagagtagcagtgagtagagagaaaaagcaactggctttggaatattacagaggttaaatgatgaggagtactagctggtcaagaagaggagaggcaagttcaagaactgcctgttttctggctttagatgaagttcactccatttcaatcctggtcatagtgtcccgcttcctcaagataatgattggtgaaccaagatgccacttggagtttccaagagaaaataccagagccaggatttgtacccatgacttcttgattcaaagcccatgttcattttaccatactccattgcttctcagtggctttcttaaagccagagaggagaaattcggaagttcccacccaagttgagtcttagagattttactactgagcgctgaagcacaggggagggatcaaggctttagggaatcagagtggctggggtacttagtggttgtttccaaaaccgttccagttctgctctaataatgggggacggggaaaaagagggtgcctccttcctcagtttgccatcttctttttccagcttccaaaarcatactcgaggaaagccattggaaacctgtcaagctgttccctagtactgaaagacagtttgtgacaaaacaggcttttctgcgcccttgggctttctgtgastttctcaagatgtttgcagttgatgatctgcatgcaagcaagccacgttgacagtttctgacctgtttccagcacctttgcaagtgtgtgtggaagmactgttcagattcattttggatgcttttccrtatatcatggggaatttgatctatatatctcagagtcacttaaagttaactcatcgaggcagttagagattgtgcctatcgtttactaaattataaaaaggattaactaagactaaaagccatccaagcattggagttcttcacttctttaaagtaattgaattcagctcttaactttttaaaaatcaaggatactacatttttcggatttcaaaaatgatacaagtttattgtagaaagtttgaaaaaaatacagaaaagactaaagaagagaaaagagtaattataatttcactgccccggtataactactgtcaacaccttggcatatgacctttccatcttttaaataaatctgcatatacacaacttttcagtgattgttactgtactctgcacattgcttcctcgcttactgtacattaaaagttttcccttgatttttcctttattagattttattggagtgccaaatacaaaacatgtggcatgaaagataaaacagaaaaagtaccctctaaggtatccaaggtagcttggactcttatttgtaaaatcaagaccagttaagctacttctctaagatcacattagttaggaamtgagcaggactacaaagtagaacttatattaagtccattgttttggttactgtgaatcctataacagaatccaaaagctgagaactagaagtaattttagaaattatcaaattcaacttcttcattctctcttttttgtcttrttatggtaagaacacttaatgggagatctgccctcttcacagattaagcgtagtatacagtgttgttaattatagtcacagtgttctatggcagatctctagaacttatttatcttgcattttgtcattgacttcctccttcccatctgtcttagtcagtttgggctgctacaacaaattgctatagactgagatttctgagacaacagaaattcatttctcacagttgtggaggctgggaagtcctagatcagggtgccagcttggtgagggttctcttcctagttggcagatggccttctggctgcattctcacataactgagaggagaagcaagctctcttgtgtctcttcttatatgggcactaatctcatcatgagggctccaccctcacaacccaattactcccygaaggcctcaactccaaataccattacattagggattagggtttccacatacgaatgttggggaacacaacattcaggccatagcacsatcctaataaatggcaccactatccaaccagttgcacagactccaaacctagtcatcattgctgcctctagttcctcttgccctatagcctgtgtataagcaagttctgctgactctcctgccaacaccaagggctccttagaacctccacctctgccacccgagtctaagccaccatcacctcttagctgcacaaattcattggccttctacctggtttccctgcttcctctctcactcacccatccccactcccacatacgtagcagccacaagtatttttaaaatgtaaaccagaaaatgccacttccctgctcacactcctccaacagcttctcattcaactgaaatccaaattccttatcctgaccaacaaggctctttataactggtcctgccagttcctctttcctcacctcccaccactccccctccattcatgttgttccagccacagtggccttcagactctttctgtaatgtgtccagctggttaccatcctagactattggtctcattgttccctctgcctgaaacctcttctccctcatctttgcatggcgcacaccttgtcatttgagtataggaacatatttcctgacaactctattgaaaacagcccacagccaggtgtggtcgctggtacttgtaaggtgggaagatcatttgaacccagaaatttcaggctgcagtgagctatgatcatgccactgcactccagcctgagcaacagagtgaaaccttgtctctcaaaacaaaaaatagaaaagcaaaataaaatagtccccagcccccacctccacccccttagtatccctttacactgcttaacttttccataatgccctcatgactatgtaacattaaatatttatttatttatttattatatgtgaggagagcctygctagaatgtaaacctgatgaagacttcaaaacccctggaacagtgcttttgcacagagtaatcatcatcaatacatacttggtgaaaaactgtaaaaatggcagcacaatcttttatcacagagatgtaccatgataagcatgcagattcattttgatttttcatcactgcacatgatggtttgatgagcttccttatacataaacccttgttcccatctctagttatgttcattactgatattccaaggggcagaatcacctaaatcaatgggtatatatagttataacacttttgattcacatcaccaaatggttcaccagaagacttgcaccatttatatacatrcagataccaacagtatgtaagtctgttcctcaaaccttcactaatgctgagtgtgattgcttttgaaatcctgcccactttgatagtcaaaataacagcgtcacattttgtgtttctttggatatctgtgaaatgaacatttctctcgtgtctgtttgccataggtatttatttgtatgtgaatgtgtgattggacccatgttctactattaatcttcatcttttttcttattgattcataagggctgaactgttgatctgttacatacagatgttgtggatatgttttcctattttgttgtttgccttttgattttgattgtggtgctatcttttatagacatgttcattggcttttggccaattttatcagtttgttcttttaggatatgtcctgttccttttacacccaaaagtcacttttcaccctgaaattaggtgtttactttttatgcttarctctctaatccatgtggagtttatctgagtgccagttgtgggatatggattcaaactgtagttaatttctccccagaagttaaccagatactctatgcactttactggatatcccattatttcaccaccagttggaatttcaagatttatcatatactgattgctttgaatcacttgagattgttttatgcatggttagcttttagtaattctgaccatctttaattttttttgatgagtacatatttatagggcacatgtgatattttgagtacatgtatagaaaacctaatgatcaaatctgggtatttaagaagtctatcacctcaagcatttatagtttctatgttttgggaacatttcaagtcctctttctagctattttgaaatatacaatacattgctgttaaccataagtgacctattctgctattgaacataacgtgttctatctatctgtatgtttgcgcctattcgccaaccactctttatccccacctaccctcatacacacccttcccagcttctagtaacyatcattctaatctctacctccatgagattaacttttttagctcccacgtatgagtgagaaaatgcaagatatgcctttctgtgcctggataattttacttaacataataacctccagttccatcacrttgcttcaagagaacatttagtggcaaagaatactttgtaagaatcccatactgtatctccttctttcataccaatgcgtggtttaatatataataaccttgtttgaaataaaagsctttgatgcctggtgcccttaccacttatgaagtaaccatcggtttccaccactaaaagtctcctatggtcacaaagtcctttgtgaaaaaatccaaaggcaaagagagaggcaggtctgccccatacagaagttcaagctgtgcattgcacaactccaaggagtgtctatcacatagcaagttatataaatggtgccccagagtttgatagtccrcaatatgtacagttgtgtgcattgatcatgaagagagaatccatgttcacttcccaattcagccctcaagaaaaccaacacgaggtcttcgasagcttactagatcttagagatcaacttcatcatttacagcaaaacatgccaaggttcaccaaaaakgtataggcttgtctatggtcataagacttagtgatagaaaagggatagatcccagatttctctttttttcattgatttatctatgtaactttttatgtatttcattgatttatctatttcattttttgtttactttcaagaaggtaatatattctcatggcccaaaattcaaaatgtatatccacaaaaacagctttacccatcctaaccccctcccaaccccactgagagttcccataaacaaaccctaataccagttggtggcatatctttccagggatagtccaagtatatacaagcaaatacagccatacattctccaatcactcccctttttaacctaaatactaacatactgcacactattctgcattttgactttttgatttataatatatcttcatgcttgctccccatcagtgcatgaagagtttttccatcctgtcttaaagagaagttgtgtactattgtatgatatacaacaactcttttaaccctatggatggacattcatttgctattagaaatagtacgacagtgaataatgttgttctcatatcattttgagcatgggtcatctgtaggataaaatttgtggaagtgggattgctgggtcaaagtacatttgtaattttaatagacattgccaaatggttctctataaaggttgttccgttattagctgattttcttatatcatcattaacactgctagcaaacttggtacattttgccagcccaatgcatacaagagagtgcagtttgkgtgtgtgtgtgtgtgtcaatgtaaagacaaatatttctttaaataataatgtatttgtattwttttttgcagtggaattggaaattttctcacagtcctatccagatgtgcaaagaagtggtagtttatttctataagtgacctaatcatccactgtgtacatttgctgtttaatgaaatctcagcttctcccagctttaacatgtattctcatttaaagatttagaaagataaagtaaaagggtggggatcagattctgcccttcctctattctttcctacaatttgagtctcatgttggctcttttsttcatttgtttttaattgactcatgatagttgtacctatttgtggggtataatgtgagatagtgcagctttcatttgcctttctcttattatgagtatgtttaagcatcttttcttgtgtttcaagctatttgtattttctattctgtgagctatttcgttcctttgctcattttcttaaaaaactgagctattggtctttttgcttactaattaatagaaagagaagtaactttttcactagttatattgaaatagaacatcttttcatagtttgagagccagtgtattttctctcctgacctgtctgttggtatagttttcccttctcttcttttggggtgtgaatctttttgttcttgatgtatggagtcatttatgcattatagaacccagatttttggaacccyattcccagcctcttacacttagatgtgmtgtatcctcatttcttcattgcacatttcttcatttcatagaatggtagaawgttttgtaagtgtacatgtaaaaattaatcaattccagaatcaccacaaactcagaaaacatggcatcaaaacggtgattctttaaggtgcaagatagtgtgaatcatttagtctccagcaaatgcatccatcataatataagaccttttagaattrgaaaaataatcaaacctgtaacaaattttgcaagcaatttataaacaggtgctagaatctaagatattggtgacagtagagaagcaaacaaacaacaacaacaacagcaacaacaacaaaaaccaaccagtgattaattgtaatcttttaggcccattttaaatgcgtcctcctccatgaaatatttcttggttyctctggacggatgttgtttctcttgcctctgaattcccagagaactttgtacctctcttagggaaattatcaatctctgtcttttattatagttagttatgtacatgagtatttccaggagcactgccaatttcctatactgatcatagatttttcctaatgaaaggctcaaaggtcccaaggcaaagtattcttttttgaagtaaggttattgtggtgtaatttatatatggcaaaattcactcttttcaaatgtacagttcaacgtgttttgacaaatgtatacatgcatataattacctccaaartgaagatacagaacatttccgtcaccacagtgttctcttggtacttctgttgtcaagccaccctcttcaccctcagcccctattgatcactgattcgatttttgcccctatagttttgcctattccagaatgttgtatgaaaagaatcatgcatcctgtagcattttgtgtctatttttactctaaaccgcagtactttaaaattaaacacgggaaataatttactcattgctttgtggaatttaggttaagcagacttgctcaccaaaatcatgccagtagttaggcagtggtcaaaaggaaggaacaaagaggaaaagggagggagaacagaaattgagaaaaacacagaaggaaagtttaatgtttattataatattctttattgtttagaaattattttctatagagcacgtccaacgtctccagcattttgtgtcatcttcacgataactttacaaactgttattattcccattctgcagatgaggacgctgaggttcaagttatttgactgacttgtccccaaacagaaccatagaaaaatgaaaaatcagcattgaataaactctgatttgaaggacattgttttgtggactccttcaggcttcctcttccccaaattctagtaagagagagttaacgagaagagctgtcagctctggaaggaagagcttctcgctttcactcaccattgtaaacccagaaactagcactgtgttagcccactgtataagaggtgttcattaaatattgttaaatgaactcacgaaacaagtatctgtccttcagatccttagagtacaaatgcactcaattttcctccccaagagctccctgggagtttttttcaactgttgcattttttttctcattttttaaagtttccttttttactcaaagtaaaacacaaatgatttctcaattcctgtaactttgtgtcagggcacattatcccaacacatgcattgaaggcgtgtgactgagtaccaccttttggattgtctgtcatttgaataaagaatatggtttatgttcattaaggaccactccagaggtaaccttcagctaatcatttcttatgttcttcatctagaccagtggagtaatgatcaaacataaagtgatctatttgaatgaaaaacaggctatacataaaatggttttaaaatgaaaagaaaatctaatcttatggcattttaagatgctgacaaaccaacagggtatgtggaaaattccatccaaaataatattattgctttcctaaaaccaacctgaatgtttgaaggcagatgaataggtcaggaattataacagtatctattacttygtggattgttgtaatgtctgaaacaaggatagaatttttttttcaattttactttaagtttcgggatacatgtgcagaatgtgcaggtttgttacacaggtgtacatgtgccatggtggtttgctgcaccaatcaacctatcatctaggttttaagccctgcatacattaggtatttgtcctaatactctccctccccttgtcccccacccccaacaggccctggtgtgtgatgttcacctccgtgtgtccacgtgttctcattgttcamctcccacttatgagtggaacatgccgtgtttggttttctgttcctgtattagtttgctgagaatgatggtttccagtttcatccatatccctgcaaaggacatgaactcattcttttttatggctgcatagtattccatggtgtatatgtgccacattttctttatccagtctatcattgatgggcatttttgttggttccaagtctttgctattgtaaatagtgctgcaataaacatacatgtgcatgtatctttataggagaatgatttataatcctttgggtatatacccagtaatgagatagaagacatttatgctgtcaacaaacatatgaaaaaaagctcatcatcactggtcattagagaaatgcgagtcaaaaccacaatgagataccatctcatgccagttagaatggcaatcattaaaaagtcaggaaacaacagatgctggagaggctgtggaaaaataggaatgcttttacactgttggtgggagtgtaaattaattcaaccattgtggaagacagtgtggcgattcctcaaggatctagaaggacagaatttttttttttttaatggtattgtttcatataaacctatgtagttcccaaagaggtcttcaaagtgttttaggtccctgggaagtttttgatcttttgaatttctcattttctttttacataattatgtctccaaaatggctcctcttttggcaataaactttgatcagtggaagactagtgacacctggattctaggtctaagtttccacttttaatttaaatatttgtctatttaacaccctggaactttccaatgaaattccatcctagagtataagaaaagtctttattaatctagatgtgtagggcagtatagatattcacctttaaattaattgatcgattatcctcactgaattgccaccccagacccacagaagggattatyggagctggcaatgtcttgaaatggcaatgtccacatggaagtggcattaatacagcagcctttgtgctttgtcattgcaacccaggccaatgtaagtcactcactgtgaggcaggaaaaaaaccctaagttattataaaggggcaaaagctacttttatatacttttcagaagtctcttgccttggagctgagataatgggaaattttaaaaaggaaaataggagaatgacatagacaagtgactttttgccttggcagacatggctttcctaccctccttttatctcaatgcccctccttcccattccccagggggtggaggggaggaaagagatgggaatgctgagaacagaaaccagagtaaacattaggattttagggtcaggaaagagctcaaagatgttaagaccatgtggccagagctggccacatgatcagagccaggcacatgcctatgtggacagagaagccaagagagaccagagggcagcactttcagggagtcaataagggtagagccttttcaaggatataagtggagagagcaaaggactccttgagaagcaggtcccaaaagcagggctagagagttggacaggttaacatatcccgggggtcactgtggcatgaaaaacagaagctgagggaaactcagagggcggagggaccacaaaagcctgaaacccagaaggctggcctcctcctgcccaccatccattgccaggccctattcatcctccccgcctcctcaaatctgcccttttctctccatctccatagagctgagaccacgggctatactaccagactgtcggtaggtaagaccctgccctgcctcctacttgctttgcaaccctaggtcaaatacctaacttctctgtgcctcagtttcttcatctgaaagatgggaatgatactaccatatccagtttaggaactgtttggggtgccaaatgaattgacacctgtgaagcattcacagggtacttaatattagtttcttagctatgttagtttcctagggatgctgtaagacatgaccactcactgggtggcttaaaacaagagaaattcactctctcatagttctgggagtgggaagtctgaaatcaaggtgtcagcagggttggttccttctggaggctctaaggaagaatctgtccttgcttctctcctagcttctggcmgctgctggaatttcagagatgcataggccctcaatgtggggtgggagggaagtaggtggaggtccttggctcatggacacattgctccaatctctgcctctgtctccatgtggccttcccctctgggtgtgtgtgtgtgtcttaaatctctttctcttatgaagmcattggttattgggtttaggtcccaccttaaattcaggatgatttatctcaatatccttaactaaattacttctgcaaagactctaagtgaagtcacattcacaagtasaaggggtaggacttggacagatcttttggacagccactattcacccaggtacagtcatcatagttattactttcaattcaggctcctattgtctcttgactatactcttataatagtctccttgcctgcagtcttcacacagcaacccattctcagtaaagtatccccagtgagctttccaaaacatcttcctcttttacaccctcaagtggctccctgtcacctgcaggggaacatctgacatgctgaactagacccaacctggagcttatctcatctccccagggccatctcccacccccctccatcttgtacatccttctccaaaacagggtgtctcccagaactctaaacacactgcgctcttttacacctcctggcctttgcacagcttgttctctctgmctatatactacctcccccctagcccccattgasagcctatgcatccttgaarttcagttcttatttcatctcctctgagatgccttcctggacccttctctggcagttcccctagatcccaagaactgcctccttatccttactgattcttgagctcacccctgtcatcaaactgtatcaactgattcccaaagatctattaatgtttctgttgccccttgagagttgcaccttattcaactctgcctcaccgatgccagtgcagtagtggaaggtgttgaatgatgaatgactggtggatggatggatgaatggatggatggacggatggatggatgggatgggatggatggatagatggatgcatgggtagatgaatgaacggataaagggatgaatattttttaaaaaaaagaaaagaaaactctgagtcaggaatcatttggaactacaaggtgaaacctggactaaagctaggaccatctgtgatgagaagacctgagcagttattagtgaggaaggaatgtggatactcaggattcatatctttgtcatataaataatgaacagccatgtatctgaactgccccatagatgatgccaaaagtaactgctgagcaaactcattatagctctgattctttttaatgtctaaagccttaaaataaagaaacccctttgggagtggataaaacgtggttctcacatcttacactttagtatgaattagatttacctggtccataagtttaaaatgtggacacctaagctccacccccagagattctgatgaagtcagtctgaggcaggctcagtgatttgtgaagaggttaaaattgcaaattctggctctgccacatctgtgctatatgaccttaggcagttccttaatttttcatstcttaagtggagacaatgctagtacttcttcacagaattgtgatgagttaaatactagtaagaagagttcagcacatgtaagtgctcagtaatgttacctgcagtcattgccgtcttcatcaccatcatcatgatcaccatcatcatgatcatgatcatcdtcatcatcatcatcatcatcatcatcaatgacatctgtggtttttaatagtggctgcatagtaaaatcacctgagaaatttacaaatagatcctgatatagttagtctggagtgggcattgggtaagggtataattttagagcaacccgcctttaaaagtctgatgtgcagtcacagttgagacccagccttgatctgtgcttctcaaacttgaattgtgcacagatcactagggcagtttgtaaaaaatgcagattctgattcagaaggtctcagggtgttgataatctgcatttcaaacaagctccaggtaatgctgctgctgctgtcacagaccacagtatgaggcatcaggttttaggggatgagtaaaacctcctgagcctgagatgcaatgcacaacatggtcggggacttggtatcaacccagtgaccaattgtgatggaggccacatggttcctggttatacccaggcctgtcatatgcagagtgtcacatgcctgccttctggaattcccccagctcctcactaatgtcccagggaggagaggcaggcaggctgtcttgggcttctctgataagatatgtcaagtgtacatgcattaccttccctactgtctggggagtcctttcggaaagcacttaaggacatgctatgcactgagcacttagctctttatattgtggagctcagggtcaacgttttgcccataaaagggccacttgtgtaggtcaaactgccgagtcaatgaccctgcccagtgggaatagtattgtcacccctgtttttggcacaaatgatttgagtgttttccaaacatcattaaatgccaaggtccctgaccctaaatgtggttcaggtgtagggactcagaggcccacagctagactgggcaagggaggggtagaagattaaaatgggaatgactgacaggcataggctattaattctcaaaggttggctctgcatcttcttgcagactcattgcgatttcctcaaagcaaggccttcactgcctggttgtgcatcatagagttcacagcattgtgaaatcacccttaaggcaaagctgacagcatctttatttattgtgcatggatttcatgttarcctcatcatccttttgctgcatgttgataaggcagaaatagtgagtcatttaaatagcggattacaaagactctgatgtagtaaatctaccctctaggttttcatttcataaagaatctgtgcattatttatcatcctcatcagcagaataataaaagccaacacagaccttctcatgaaccccataatgtagatattattgtcctcagtttacccaggataaaattgaggcacagagaggttaagtaccttgcccagggctcccccatgccaataaatatggagctgacgttggaacccagagccttgcagtgccagtgctgttagccactgtccccgactccatttgtgagaatgctgctgactggcatttatgagagtgcttagtacctgccagrcactgtgcctggggatttacatggattatctacttttaccctcaaaacaccgatatgagttaggcactattaatttcattttctgattgagagagctgatgtgagagaaatgcagtgattttctcaagtttaaactcaccttgtaagcttcaaagctgtgattggaaccctaggggtccatgttccccttgctcatgtgttctggcccctcctcagctgactttggatttttgtcccctcctactgctccctccaaccccagagtgaaggtctcctggctttgtccaaacattagttccatcagggccgccccaccggcctgtgcccaccctaataccacttccttggagtcccttttgccattggagatgatgcattcacaggttccagggattagggcgtgggcatctttggrggctgttgccccatctacccctaccacaccattttgcaggtctctcacatgaatcctgcaggatcttgctggtttccctgcttacatcttcttccctgcctcatccctggcagctggagtgaccttttaaaatgtaaatacattactttgcagtttgcttaacccctcccaaggccgagatctggtggggccaccctctggcctcctctccctgaacccctcccctcgctccctctgccctgacatgactccatcgctggcttcattcggggctgtctgattgtcacttcctcctcccatacctaaaccatcacccccatgccactctctccccttagtgttggcttgcttcagagcattcctaagttacagtgtgcacttctctactcttaatgtctctctcccttccctggattctaggtggaaaaaaggcagctgatctctagcacatgggacaatgcctggttcaaagcgtgggctaatacayttagcaggatggaaggagggaaggtgggatggaaggaaaagagggagagagggagaaaagaaggaaggagaaaggaaggaaggaaggagggagcaaaggcaggtaggtaggaagaaaggaaggaaggaaagaaaaagagggaaggaaggaaagaaaaasagtgaaggaaggaggaagggagggaagacaggcaggaagaaaggtaagaagaaaggaaggaaagaaagaaagaaatggaaggaaagaaggaaggaggaaggaaagtaggagggcaggagggagtaaagcaggcaggcagggagaaaaaaggaaggaaggaaagaaggaaggaaggatgggggagtcagctcagttgattgtccttttaatgtttgttatctgaggccttattccttaggatgacagtccaagtacttaaaaaaaaagtatcccttttgcctctttcaaatgcatwttttttattcttaawttttttattgatacataatgtttgtacatatgtatgggatttatgtgatattttgttacatgcataaaatatgtaatgattaagttagggtatgtgaggtatccagcacctcaagcttttatgatttttatgtgttgggaacatttcaagttctctcttttagctattttgaaatatgcaattttttaaataatactgctaaatgttcctgatacttaagtagttccacacagtcacatactacaaacagtaagctcatcacctgatattattacatctgccacttagaagctgtgtgactggaagcactctgtgcctcagttacctcatctgtaaaattcrgataataatagtgctactctcataggctgatatgaggtttacattagttaatatatgtaaagcactttgaatgaattcagtaatayagtcagcaccatgtaagtgtgtattaaatttaaaaatagaccaggcaaggtggctcatgcctataatcctagcacttcaggaggccaaggtgggaggattgcttgcacctaagagtttgagaccagcctgggcaacatagtgagaccctatctctatttataataaataaatataaaaacaacttaagttcaagactatcctctccagtcttctattcatacttttatttaatttaaaaagactgttggaaactttcaagtttttacttgcrttagtttgtttctgccttatcagaacccataaaaatagtagtttttactgacattagtttgtttctgccttataagaacccataaaaatactagttttttactcctacgaaagtgaaatggcaaaagtgtacctatgcacattatttttcccaccaatggtcatattcttagcaaataaacgtttyctctgtgggctgggggtgttacaatgtttttaaatagtgggattatcaagtttagggttttattggctcagagggcaagtgygaaatcttgagtctgtctggtgctggggtttgaaacctgatgcccatgtgtcacttgctttattaagtcaccaycttggaagggctgcttcctccttattaatgaaaagcctgctccatttgttttggcttgcaccaacctaacagtgtctttaaatcagcgacagactgttttccttggaagccacagagtccaatagttttggactaagctcagattctggctagaacttccaaactggaagtaaaatgacttcacccaacagtggttggggggaaaagccaggcaggcttttggaaagtggatttttaatattggaggatatttgtgaaggtgcctgatgagatggacctaacagtgtttgagggtgatgtggacaaaccgttttattattctgtttcaacatagtgctatgttttatttaaatgaatttgcaacttggggtcctgaaatctatttttgtttttgtttccacctagaatagaaagcactttcaagcttatcctgggaggcaagaatagattgaaaggataactactgtatgtagatgcaaaggaggtaccttctcggggagatcgggtgaaggctgttctccctagaagaactaaaggctgggtagacatggagtcagaggaagctttggttgggagaaagacagtggcagtaacccaagcccagagaggggattccttggcatttgtgccttttctgtgccatcaacagtgaaaagaactagagaagggcagctctcagagctcagacagccaatggttggctaggtcagaggagctcttgggctgggtcggagttggccagacttcttgtgctcttccattcatacccaaaaggagcttctgggtcttgaagataaaccactttctcttgttcctctcagttgctctgatattctaagacccagagcagattttttttttwaaccaggagtccatgagtcttctaagaatgtccttggaagaattcaaggaattcctgataccccagaaactatacataaaatgctgtatgcatgtgcactgctctgagaaggagtctatagttcttaccagattcttgaaaggattctgtgaactcttctcccctaaagcttagaatcactgttctggatggtaccaaaaaccacacagtagaacactttrtacttttgtctcccacctctgataataaatgcagaatttggcatagtcaaaatgttacaaaaggtttgtacagcatcaaaagaccttggattgcaaattttacaggtaagaggcaatgaccaggttagcaaccagtcaagaacattcatgagcaaatgctggtctagtctgaagggccatcttgggtacacttgggcacwactggtgctgggctgaacatgccactcaggagtttttactggaacacaggcatgtagaaacacatctagaaggatataggtgtcaacatccagaaggatacaggtgtcaacagataagattatgctcataattagaaaatagaattcattgagcatctgcaatatgycaggagctttgtatacattatctcatttgtttgtcacaataatcttatgaaatgaatactattgtatttcccattttacagacagcatagcttaaactcagagaagtcaagtacaattctcaaggtcattaagtggtaagaactggaagataaggtcaggtttgtccaatctatgcttcctcccaacttaagtagcttcatcacatgcaaacaatgatcatggtggcttatgggacaccaattaatctgacaagagctccttcgaggctgtgactttataatttttagaattaactgaaagagtggcaagttgagcattcaatttgcaagtcatgctatgtttggaattaggagggataaccmcttttccttcccaaagrgactgacaagcataccaagagggggtgggatttctggaactctgtgaagttaacaagaagggacttggaaagttagaagaaggagggggagctgcattccaagcatagctcatggtatgagaaagcaccaaatttggaatgggacgaacagatgaagaaggtgtcaagttctctggggaggagtggagggtactagacaccaaatacagggtaaaactctggcaagatgctgtggtgacttatctgagcctaaaacaaaggagaaccatcccagaatcctagaaatctcccttcccccaaatcartgaagggaagtttcataatgatggacagagtcccagatggaaattgactacctgttctacagaaaggtcttcaattctaacagagaactctctgatcgcaggaaaagctatctcaatttcaatgacttgtccactgacagaaaatagtgtaagaagggctcactctgggggagtgagaagtaargcattagaggaggaaagatgataactgagtgggaagaaagaaaatcatgaaggaccaacaggaggcacctgggtcgcagcccagggagcattaatgatcctacctccagttttaggggcacaatacttaatccgacccagaaggtggaatgcaacaacctccctctcctcccctcccaccccagaggcattaccgcagcagataaacaactggcatgaccctccaatagaaagcaagatcacctttgcagcagaagtggccctgccagctgcccttcttctttccgtggggacagacactgttttccctggggaggccagagagctgctgagtcttcatttcctgaagggttgggccagatttgggagctcatgggagttatagaactgctttttctaatttacaagttctaaagtcttgttcctggtcacttccttctcaaaagcgaagggcgcagaggctcctgtggaaacaccttcccttgtgaagtctgcacagagtcctcacagagcctctggagtggctaccttccatgtgctggctaccaccgtcttcttccagggaactccacaaggctcctggctcccagtcaagcagccgcctttgtgtctgttctttttccacccccacctccccaagtatgccttctctagtgggataaatttagctctgaatgaatgcagaaagaagaacacattaaagtaaacacagaccaaacagcattcaaatataggtttggcacacacacacaactgacaaaagatccaagtttttctgtttccttctcttctgcttatctctgtttctcccatctcatcctctgactgctacactcttttctgcrtgtatttaagctaattagatatgtagatcagaatgtggggctgttggtcttcaraccccatgaaggggaaatcactggagtgactgagaaacatcaaggagtgaatgagagccccaggtggtgctggcattttcatttactggcttgatcatcttagaaacccttccaaaaacttgaaagcatattttatcttatgtgttagcacaaccttttctcccggtgcactgagtctacagtggctatagaatgttgcaaggtcgggccgggtgtagtggttcatgcctgtaatcccagcactttgggaggccgaagcgggcggatcacgaggtcaggagatggagaccatcctggctaacacggtgaaaccccatctctactaaaaagacaaaaaattagccgggtgtggtggcgggcacctgtagtcctagctacttgggaggctgaggccggagaatggcgtgaacctggaaggcagagcttgcagtgagccaagatcgtgccactgcactccagtctgggtgacagagcaagactccatctcaaaaaaaaaagaatgttgcaaagtcttttttttttgatatggggttctcattctctcatccaggttggagtgcagtggcacgatcatgattcactgcagcctcgacctcctgggtttaaatgatcctcctgcctcagcctcctgagtaggtgggactacaaccatatgctgccacacctggctaatttaaatttttttttgtagaggtagggtctcactatgttgcccaggctggtcttgaactcctggcctcaagctatcctcccacttcagcctcccaaagtgctgggattgtgggcatgagtcactgcacctggcctgcaacaccttctaaacatcttcccaccaaccagtcagcatgtccctaagccctacttttgaagtattttatttcactgtagttcttcactctcacagcatttgtagttctcagatcactttcttattcacgaactttaaacttataagaatctaatgggactagttagctatccctgttcccagtttacagatggaaaacctattcccattttacaaatagagaacctcagttcagagcaggcaagtgacttgtacgaagtcacacagcaagtggcagagttaggattaggacctaggattgatactttgtcttatgttcattccactctaccatgagctgctttggggaaaggcagtttgtccgggaggccctggctgggagggtcacacattagtaatgagcaatttttgagactggctcaggatccatttagtcaatatatggagggtgtgcaaggggcagttgagacctctgtcattcccaaaggtgtcaggcaggcacagcatccataggtggtaggagctgaagctaggctttcccaatttcattattcattccccagccagcagggtggacaggatttagtrggcaggccaccatccctccactgccaaccccgcaggaaatttctctcttgtcagcagtgctgacttgcagaatgtacacggcattattgaaacatggttaacaatgaaagtgttgatggccacrctaccaaaagggattccaagctgackgagcacatcgtggtcattgtgctaaggtaaaccagactggcccctaagctctctgagaaaccaatgaccygactgtgtctactggcatcagataaccaggctggagtagaacctggccttcccaaagactttctagtttgtagctaattcatagccaaacctagaattgtttctaccacagagcaccttcaatatgtaggcatgtagctctcttcctaatactcaaaaattaagctgttcttcccatattttcctaggatttaatctatctcctcttaaatttttaaattccttcttatttataattgttagattgacccacactaaaagataagactgtagatgtctaagaatcattaaaagcagagtctagtaaaggtgtttctagataataaatgacatagggcagaatcctcttgtttaaaagatggaaaatgagaagtactgactaatgggaggaatgttaagaataccgatagctcaacccttaaaaaaaaaaaagcctayataaaagggtggataaaatgaagtcattcacttaagttggtccatggcatttttcatgaagcaatgattgggttgagtgatcaagattaccatttccagagcacctaccatggccaatcacaagccttttacatctgttaaccttatttattacaacatccctgtgagagggctgagattccaacttgtcttcagagttcctgtcttttctgtgtcatatctacctcctacttcctaatcctacttttcaaaacttttgtcattaacaggactaccactctggaccaacatctgaataacacagtatttaaacttatcagatatgacaacccaatgagactggacatcacatattttcatttccatcttaatgtaaggaaactgtcattctaatctattatgtgatttgtccatactaccacaacaaaataaatgtagaatgatctctaaccatttggctctaattgattcccgtacactctccttatctacccagtttcctctagggactcatgttgatcaactgacattgccaaagctaaccaagagaaaaggaagtcatcacagtgaaatattgatattcatttctagccagatttccaattgctcattttcaatctgctatgtaaagaccttagccactatataccttaagcaacattcagcctagtttatttttcacaatggtgctgttttctgacttctttctatcttcttgctccatggggactccctaaatgaatctatcatttggatcccatggagaaaaatagcatatacttgaaatcccatcaactttcccaaagagctaacaaccacaggagccaagaggaccacaggcaatgttctccttcttttgattctgtgcagctatcacatatgttttaaatgaccatttattttcaaaagatcccaggcaaaaaagaactaacacaaatataaacatttgaggggatcctggcattcctttcaaaattacttttgtccaagggaagcttcaggttgctgggaaatgtcacactcatagctcttgctcaacaagactgacttttactcacacaacgggccttggcaagtcatttcccttttggtatacagagctcttgttttccccacaaaggaattggctatgatcgtttgtgattctcaaaggactcatgttctaaaatagattctgaaatttttattaacaaaacatctattttgcatatctagcattctgtatccttttcgtataatgctttgcaatgaagcatctatcataaaaaccactaaacyrtacagatggtgtttatgcaacacaatttaatgtcccagcaagaactagtgatttgttacatacattatgcatcattgtgatgtatatatccagattttaaatgtttggagggcaaatagtcaccaatatcattgtggcactagactacgattttttttcttaataccaggccatggccaaacatctaatataaaataattatacaatatgtttattaaataaatagcatagtttgggttttaaatgcctgtgtttgtaatgggttcaaagattttaaaatactaaaatttagaaagttgaaagaagtgctggaagaggaraaaagattttccctctgctccttggccaaccatcaggcagtcatttcatgtgccttcctgtttcacctagggttcttggtcccaagcaacagaaatagattctggctgataggagcagaaaaagaatgaaatgaaattgtattagatagctcacaggagagatggaacgtccaaagaaggaagcttgggcaatgggtacaaccaaaggtgaactaatagcctgaaggaattctctaacatgctcagtctccaaaattcttggcaggcacacatgcctgactgagccgagattgcctgccataccatggcttcagggggatctggggaacaagtgtctgatacctcccagcttctaccacaggatgtggctctgcctctcactatggcttttaatatgggaaatccccaaagatgggaaggagttcacaaattggccagccagaggaaaaaaaaatgtgtatatgaacaagtctgttacacttcctacctggccagaagcattttgaatttcctctcttctttggctttttgtcttacctgctttgataatccgcaacactgaataaacacaagctttttttattgtgggtctcagggcagttaaaaatcacttaggaagtacacactattggtcatgagtctttagtctattcctagtaaattcaattagtacaaaggttctaaacccatccctaactcccacatcaccctgtagaaatttaattctgtacaggtcttcaggagattctgatgcagatttctgattaggaaccatgttttagtctttctcatctttcacagtttctttacaaacgatttctatttttctgaagccccaaccctaygccatcagtcttaatcaatgactctttgttcaattgggaaaaccagtccatctgatgcaaattcacttaacctctctcctgagagttgaactcaaactttcttcttgtctttatccatttcttcctccttccctacttcgttattccttcttcccaaggctaactggctaatgtgatgctcatctgaatgtcctcttgactaattagagactttgactaatattcaccttcctttttgactgtatctttggcctmatttccctgttgtctaatttgctttgacccccaaacatccaagtcttgcctgacctaaaaaccctttccactagaccctgcttcccatgggctatgttcctgttctccaccttcatctttcacatctgaagagctgaaagaagcagtttgtactcatggttgcttctctgatctctcgctcatccccatttttgtttgttttattttcaacattcacttggtagcagtcattcctcacctcttgtaagtgcttccaagctcatcttctggacacaagtcactcatggcttactgacagccctccaatggtctcttcttcatctgcatcccccatgacctttcagaagcatatgaccctgttgaaaacctctttccttctttgtggcttttggtgcaaatccctttgaatttttccttctacttctcggatgatactttatcagtcttctttgctgggctctctcctcttcttgctctgttttctcatcctggctgttctcatttctttagctgtaaccgcaaagtagatgacacttggatgtgtgtccccaaccccgattcttctattcagagttcagatatttccaactgatcacttccaaagggtgcccaggcccttttccttctccatctccccattccatcactccttttaaaaatttattgcggttaaaaatacaaaacttaaaatttaccatttcaaccacttttaagcatatggtttgatgacagtaagtacattcacactgttgtgctcaatcataccttttaaatatctgtatagctgggagtagaaggaccatttctggttcaattgtttattcctggggcctgcttctatctccatatcattggccaagcctggtgcttaatggttaagagcatgggctctggtgagtgtgatctgagtttaaatcccagctctataactgtagctgagtctttcaacctctctggtctcattttcctcatcttagtattctctacaatcactctgctgaagcaataacagctttgtttatttgtgagcaaacccctttaaataacttgtcctgctggggcttgtgctggaaatgaagaaaaaaggatgcatttgaagaaaaggatgggcttagccagaaagtagaagtttctgatatattggagtgggatgtagaatctggcactggcttggatttattaaacaatcagctccacctacacttgttatgaaaaagatgggaaaacaatccatcagtaaacgattttggtgagtgcttccatctttggtcagaggagtaattgttcatcagtgacaggtgaacctctgtgaaaattgaaagggcaatttagttgaaatggaagcatttattcaggaaacaggtgatctgggaaaatttgatgtgcatttttttttttttttttgagacagagtttcactcttgttgcccaggctggagtgcaatgatgtgatctcggctcactgcaacctctgcctcccaggttccagtgattctcctgcctcggcttcccaagtagctgggattacaggtgcctgccaccacgcccggctaattttttgtatttttagtagagaaggggtttcaccatgttggccaggctggtctcgaactcctgaccttaggtgatccacccgccttggcctcccaaagtgctgggattacaggtgtgagccaccgcatctggcctgatgtgtatatcttttaacatgcctttaaatcctatggctctaaagaggccatattagttatttcagtgtttatttcatttgatgaagaaacgtttgcatatgaatgttgggaattctagcaggtcctgcctcaatgtgaagaggcatttttttttgcttttggcattgatctccttttggactgggcctgatccacttcttacatccagtccaggacctgtcacaaaagactcacattagtaccacatggtatcctgttttagtaaagaataggtgaaatattttagtgagtagatcctacttttcctttcagatgcaatgaacagaagaccctgaaaggatttcaatccagaatgtcacaggataataagagcagatgtctgtgatgccctttacaaagcacctttacatactgtctctcattcgtctctaatgacacctatgtgatcctccattttttcagatgaggaaactgaggttcagagtgattaagcgagttgcctgagatttcacagctaacacattgtgaaatctagtctagcacccaggactaaaaactctcggcttcttttaaggccacatatcgcctcaccagaagggtggcctctctggagatataccctaccctcggccgacttgatattgagaacttggtcatcttaagcatgtgggccacttgggcaaggcagcccttcccaaattgtaaatgtccccacgtggagctcaagcgtctggcttgagccagaaggtgccctgaacactcggtggccccagcccccacgtaacagcacgtgctcgggtcccacattcggtcagacgcccctctccactggcatctgcccggtggaggcgccactgcgctctgcctccgccccagcaagcgcgtgtccacgcgggcgcgccacgccagccgtgcgccccagcggctcgccgtgcgcccgcgccccaggtgcccactggctcgcgcgccctccgtctgcgccttggagacccgcggcggcgatcgctcggagccgccttggaccgcggcctcgggtccatcacactccaggggcggagcgaggcaccgagacgtcagggcggagaactagcgccgggctagcgcgccctcccggcggctgccggcgtcccacgtcctcggctggcgcggccggcggcggcggcgaccgggagatgcagtgagcggcggcgctggggcgcagccaggcggccgggagggcgggggccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttcyttcctctttcccctgcctgtgtgcccttctccaggatggcagaggcggaattgcacaaggaaaggctgcaagccatagcagtaagtccactttcattttattttcttgctctattgtctggggtggaagggggcccccgagggtttcggggcaagcggcatgccagcacagtagccgcaggtcatatgttccaggggctaaaactctgtcagggctcagctaggctgccttttcttttctatgtctatagatggagacccccaagggcgcgctttggactgaggatttgaatgtggaagattggcttaaaaaaagatgcttgctgctgggctttggggaaggactaaacagaggcttggggtsgggggacgactccaggaatattatgaccraatgctcaggcatacgttggcttcatagcctggagaaccaagagaagggtgacctgaacggtggctgccatcctctctgcggaagctgtcctcctgttaagtrgaaaaccaggagtcagcgactcagccagccacgcggtagaacctcctcccagaaaccgggaatgttagttttcccttctctgtttgatattgacaagggcactggcacaagccaccaccctggaggtctggggacttcatacaactgggtcctggttataatattccatgagagcctccttcttatggtgtggagtatctgaaaacctattttcagcctacaaaggagtagtcagttttggcaaagttcgtaggcactttcagaaaagtgtacccatgtgcatcttgggtttaaaaaagaactctctgagactgcctagatttgagcaatcttaacacagtgttgccaatgatccacagatgtggtatttttactggagccaccacagctggattatatatttccttcgaggatgagggaatgattactgctgccgtatgaaatagtaacaattaaaaaagaaggtccgttaacatattggcataaaagaatctccagacattcttccacctaaatacatttgtgtttttcagttcggaagttctctggaaacacatataaatttgttggagaaatagtgtgtaatgttttggaaccaaagtatattaaagcgttttccaaaacctttttggacagattcttcattgggaaaatgcacacagacccttccttttttagaagcatttgacatggtctccaaggctctgagaccctctttctcaaacgcctcaaatctgaaatgtcttggagacttcaccactgaagtgagagagatgtttgctggcaatattgaaaygccatggtttgcctattaggtaatctttgaacgtggtgctctgaactcagaaaggttgtttttttcttctttctctttccccctgtgcatgtgtattttgatggtttgtgaagttatttgtggtttctaaagttggtggcaaggcagcatggccagtgtgtcatgaacttgataagaatggtgatattgagttaatggtgccatgtagctggtgggtgttttgtgtgaactggataataggctgctttaactgttgatgcagtggctgttcccattggctgctgctgaaggcttccaacagttgtcacattttctgcctttgcacaaccagctttactggatgcctgaggaacagctgaactccatgaaaggacttgctttccaaacatggagccagtagctgctaacactggggtacccttttccaagtgcggttgagtaatcccagcagaggccaagtcgattttccaagaaagatctaggcaaatctttgggaattctcttgagcatataagaatacacacaaatactcacttgtgcctcttcagttattgaagaattgagtttgtcctgtgtatctggggagctgttgattaytctcatgaatgtgcacctaatacagtctgccctccctattcatgggttccatatccacgccttcagtcaatcttggattgtaactattggaaaaaataatagatagctgagtctgtactgaacatgtacagactttttcttgtcaccattccctaaataatacagtataatcaactgtttacgtcgcatttacagtgtattaggtattataaataatctgaaaatgattaatgtatgtgggaggatgtgagtaggttatatgcaaataccatgctattttatagggacttgagcatcctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggamttatggccacatcggtaaatggttttatgctatgctttggtctagtgcctactcttctgaattctgcaaaccctgactctctcatcactttcctggagttctcaggggaccctgaggagatcacaagcctgcccccagaacctagcactcctgaagtctctctggagatgtgagggaagaagasaataggtcctcacatcttcacttacttgggcttctctctcagaggcagagaatcgactgggattccagtctgcagggccttgggcagtctttagtctgggtctcagctccttcatctgtagaatgggttcatgagttctacctcctgggctggttgtaaggtttagttaggatggaggtgaagcacctggcaggtagctgtcattggatggtgttgagcagagcccttagcttttgtctgtattgctgtcttgtcctrtggggggtcagaagcaacatctctgaagtggaatgtgtattaatgactttttttttttttagacagagtctcactctgtcacccaggctggagtgctgccatgacagctcgctgcatcctgaaaccatcctcccacctcagcctccccagtagctgggattacaggcatgtgccaccatgcccagctaatttttaaattttttgtagagatggggtttcgccatgttgcccaggctggtctggaactcctgacctcatgtgatcctcccacctctgcctcccaaagcactgagtttagagacatgagccactatacttggtctgaacagctcttttttaatcccttccttcaactgactgaaagtcagggccctgcccagcatcactttctctaactgctttagacagaggcagagatatgacttgaggattcattcatccatttgttcagtaggtatttacagattgcctcctctgggaaggtattggcaacactgaaaagttggtgtccccaggtttcagctgcctgaggctgaaacctttatttcaccttttgcacataatttcttgaaggacagatgtcctgatacctaagatgcttgtcacatgaacatctgtggaatatccgcccccaccaacaaaactgaattaaatacttagaaactacagtgctttaatggaatcttccatttggatccaggaactaatcaatgagaaaagatgactcttatcctaatttctgccaaaagaagagcaagtccatctttgacaatgatctctacactcacatgctcctttcttctgtagggatactccccaaactttacatttagaacatggtaaaaagcctctgaaacagcatgagtgagaatggtaatcccagggactaataacaacaattgccatttattgaatattgttcattcagaaaggcacggtgtgaaatactttttgtttttcrcctaacgttatttatagtctaatggaagaaatagaaaagcacataagcagttactatccaggagtactatgaaaatgagcatccaggaggaacatgtaaaccaatctcagagttgtgaaacaattccccaaaaagaagacattagagtaagtcctgaaaattgggtaaaataaaatataaaataacatcataaccttcccaattaccaggaggcatttgtttattcgttatttgattattatttattcaggacatttagygtgagaaagggaaaggcaaaagcatgaagaagttaagtcagtagctaaagacacaaactcagagtgaacactgaaatgcttttcagcatgtattatctcattgaatcctaataagaagcttatgaggtaggcactacagtattactcatattttataggtgaggaggttctagaactggtctaacattaaactgatagtatcaaagccaggatttgaatgctgcccgcagcaggccattggagcctttgctttgactgctgccctgagctgccacccaagatggcggcagcgtctcgcacttttcccatgagcacactgtgcaggtggtctcagcagcctgagtgtgagccacagactgattccattgcaatgggaaagcttgagacaagccaggaggcctacctccttttgagagtctttcaagcctggattcagtgcatagaaatacccaacataaaatttaatggaacgagtaacattcccatggggaagaagctgttgtgtctcagtggaaactaaccttgtgggagggtgctgttatgtctgcacattggagaggaagatagttttctttgggcatgagtgaaaataagtaaatgttatataaattgtcttgggtgaaactcctaagagccacgtggacaaggctcaggctacaccagggaccagcatgagtatgtttatatatgtgcggaaataggaaatgctaatctaacctatgctgttctttagggaattttgtcatttaattagaacccactctgtgaagtaataaaaatgatctttgcatttgtgcagtactttataatttatgaaaaccttgtatatgctaccttcttcctgaggtgtgtagagcaaatcttatacgctttacaggtgagtattcagagctatccaagcttacacagatagaggtggaagagttgtagtaaatcccagcctctcctgactcccaattcttgtattagtccgttttcaccgtgctgataaagacatacccgagactgggtaatttataaggaaaaagaggtttaatggacttatagttccacgtggctggggaggcctcacaatcatggcagaaggtgaaaggcacatctcacatggcaacagactggaaatgagagcttgtgcagggaaactcccctttataaaaccatcagatctcgtgagactgattcactatcacaagaacagcatgggaaagacatgtccccgtgattcaattacctcctaccatgtccctcccacaacacgtgggaattcaagatgagatttgggtggggacacagcaaaaccgtatcacttgtgttagtggtacatccagccttggaagggtgctttgatacgggctgaaactgcaactaagatcctgctggactaaaatcttctggctgggaggagaggagtgagcttggatgtgtctctrtggaatatgcccttgttaggatttcactttcggcctctttcattcttgaaattctcaccaaggggtcagctagtgagtttatggctttcatctgattctattctcagtcctgcatagacctgggtatacgctgttggcctaggctggctgtgccgtgggcttacagagaagtgctcattggcttttcgttggattcgcctctccatgccttttcttgcctgggagcattacagccttgagtaccaggcttggagtgtggggccagtggccaaggaggccaccaccctgcttttggtccaggccttttaggccgacctgcacagcatgggcaaaaagtccttgcaatgatttacatactatccagtccagcttcccaaggatccctcagaggggttagagactcaaacccaagccctgtagaaacaggcactgtgattcatgtggggaccatccccatccatgttccttgtggacttgtgttattggtatgcagctgtcagagaactggagaatttaagatcctggtcattcatctgttatcttatatctcagagatgcagatgacaccctgcttctaaaattccatgttaaggcctaaaaaatcatttgcgtggtatattggtgctgaggaagggttcaacttggctgagtctgtgaagctgcccactggataggtgacactttgggcccatgcagggtcattgctgtgtctgggagtgccaaggcaggccttacccagcatgcataagggtcacacacctccctgctacttatttgtacctctgagtatttcagtcttcagcttattgggacaaagagcagctactctgacaaactttaaaatgctctgagaaatagagcagttatcatggaaaaaaaaagtcatcatagaaaaagctaagtgaggggggttgtgggttatagtttgtcaatatttaaaggaaaaccagggcccagtagaattgtttctatatttctttgggggctactcaatgctttggggtcactgctggcccctttgaactctccacatttcaccactgatcccatttgggaatgttgatgaacttgcttggcagtaagagttggtcattctgtggcatgaaattgactgagacagcagatggacattgatgcacagagacggtggtcccaagggctgtcattgtggtggggtagttaccagcatggattttggtgtcaggaagacctggcgcaagtcctggcctttccgttggtatctgtatgatgtcactgtaccttggtttcctcacctgtaagatggggctaatgatcatacccacttcagtgtcttgttgtgatggttcttttagaggtttcttgggaaatgctcagagacagcatgcattaagcactcacaaactttcctatttataataagcaaaccaacaaatcataacttatgcatctttaaacagaaagtgaacacaaagagtgaaaggagaattttgttagccacagcatttttgtcaaactaggaaattagataaatactaggaaatcagataaatgttgtaactcctgagttttcaatgcatgaagatagtattaataataaaaaatggattatttgtagtaagcaggagtagtaaactcaacaggtcagggggccagcatgcaatgtaaatgagggacacagattgagtcgaaagtattggtccctagagagcagatgccacctctcagttaagatgcagttaatttatgccttgtgagaacgtgggtcttatgttgttacatcaactcattttcaagagaagccagaaatctgatttttaacatgtgagatctcccacttaaaaaagaacagtattaactagtttaaaaactttaaaaagattggcagtcacaacacaattccttttgatcaagaggccgacattttgtgacctttagatatagacagagctttgaactttacaggatgctttccttatgcattgatttatttggatttcataaggatactgtgaagtaagcctatcagcacccctgagatatttcataatgttgtaatatcgggttgcattttcaccagagctttgtgagtttggtgtccagatgtttggatcattggataaatggtgcttatttgcgatatcttttgacattaaatgagcccttgcaaatcactgacattattgaaactcagaatactcacatctagataggtaattgctctctaactcaaccaaaacaaatctaaaccacatcaagtcagcaccttaatttgggaaattcctcttattagaaaagaatctttaagaasctatactcaaggtatgcaaatctgaaatgcaaacctgatatgaagcccaagcctaactcatgtcagtcaggatgtttgagttgatcctgatttattattagcctcaagtaatggacattgtagggagattctgctgggctcaggactcatagtagcagcaactgccatttgaccgatgtttttgtcatatatggtatagaacagtaattctcaaacgttagtgcattaggatcacctggagggttccttaaaacacagattgcaagagcacactcccagagtgtctaattctgtaggtctagggtgatgtggcctgagaatttgtatttctaagaagttcccagctgcaactgctattctggggaacacactttgaaaacgactggtgaagtgtaggagatcaatagtaaaggaagattatgacctgggtcctgatgtgcatcacatgcccattgtgatatgcccaggagtttgtgtggtgtgtatattctgaagaggtgaaatagaataaaaggccaaatttagtcttgattaatgagagccttaaacatagcccagtttggaagtcatgcaagccgggtgcggtggcgcactcccatagtcccagctacttgggaggctgaggtgggaagatcgcttaagcccaggagttcaaggctgcagtgagctatgatcactgccactgcactccagactgggcaagagtgacaccctgtgtaactgtgtccttctcacattacactggctaatcaagaagaggtctttgcttatctcgggaacttgctttaatctatttaaataaagtgagatatctgttggttacttgacaacaccggtttggaaggtttgcccaggattggctgggcaggttgagagagtttgcctgggattgactgactgaaactatgggctacaaaattcccttggggaggccttagaggacacctcagtgagataagaagtcatgcagtagagaagatatccagcaacaccatgacagccccattgagagaggcttgccatacatatgatggtgtatagatgaagacatcaaatagcagatcagcccatcaagcctggtggccccttctccagcctgcaggtgctaattcgcgatgtgattgcttctcacgtgggcaactccaataggatgccaggagaagcagcaactgatgttcatttacttaatgatggttaatattttatgaagccagtctgtgtatatgcaagtatgacttgttattggcatatcaaggacaagtttattcttccaaggatgtcatgcaggcttccctcacttgtctttgtaccatgcattttttgagctaacccttcatttttggaaggattctgcctcaccggatctcttrtatatcttaaaacacaaagcacagaggctgcactgtacaggatgaggcctaagagaacgtggagactgtaggggatgggccacacagcatggcggagtttgtagaggaaaggttgctcataagtgctctgggtttgggagaagaccacacagctgagatctatttctgacaggaaatgccggcaggagcagagggtggtgtggggcagtgcgtgttggagctacagtgcccttggttaattattatctcagtatttctcattagtctcttgttgaattaaaatgctcaaaaggagattattaaatacacacagaaagggagacagactgacagacacagagacaagactacaccctatttacataatgcttgaacatatattaaaaatactttggattactctttgaccctagtatcactgtttctataggatcatataagtttagctagaagaaaagaatagagaatctgtacctttcttttgcataagatcgaaggggaaagaaaagccatgtgaggcccaagataaaagccccagctgtagatgaaaaagctgtgggccagacgtcggaacacatcttcctgtccatcatttcccttgtggaagcctatttcattaccctgcaggcttttaggctctagacagctttgcaataccaaatatcttgaaggcatttgtaaaacctactcttacttttttcctggaaaaaaaaaattatactggtttacttactattctaggtgggtgggatttttcccccctctgctaaattataaccagtcatctaagtattcactttatttttaaattcagggctgaaacttaaaaccttgagggttaccaaaaaatgttattcttaagagaaaaacatgcttgaaaacttaacccctttggtggcaggcaggggattttctttgtctgtgtttgagtgctaatgtcgacaactttgaggccaataaataccaaatggggctctaggatttgggcaactgtgatagtgtgtgtgtcctgcatgtsacatgagaaagagagaggccgggatttaagaaaggtgcctcttggctgggtggcatgaactcagtcagctggctttccccaggcacctgattggccttaaacactgagtttttgtggygtgacttgacatacatcttgggctgatatcacgtgctgtttctactggggtgggaagtgctttgaaaatgtccttgctccagtggaactgtgagacatatctaaaaagcttaaggctaatatgagtgatgctaaaaggaagtcctgcttatccaggtaagcaaaagcatactctaggatagcagtgctcctgtaacctgcatggcctatttttcttttccaggtggtatgcaggcagtcttgttcatgaacattgatgtctgagcatgtgtgttcaaaattcagtgttgttaatcaaataaaactcaccacaaaacccgaaggatatttaacaatagatgagataggtttggcggagatgggtcagaagacagaggaggtcctggaggcagcagtagaatgtactttccaatcttactggtgactagagataagacactagtagcctgtttactccccatccttatttacactggagtgagaatgatatatgtcagatcagtattggatgcgatgagggagaatgaagagaaaatattgactctgaaaaatacagacaagaggaggcaaagttgaaagtaatgtaaactgcttaatcacctgcctttctctctttccaccgtcatctctttctacttgacatgttcctgcttttgcctctggatggttctatctctcatcccctctcagcctgggtccacagagaaaagcaggaagcagcctggcatggcagtggagggagccttttccagccttcctccagcagaagtgcgccctctcccctatagggagatagggcaccccaggcttcagaaagcaagggaaagatggtacttcatcatgtagcttttcttaaggggttggagggaagggctcccagttccggagagggtccatgtgccagccaccctgctgaatgccttatgttaggggggtgagatctcagatgtgcacaggwaccaggttgacttggctgagcttttgggactgtggtagccaagagagggcagactcctgaggggacagagagtgctcaactccaactgatgggcactgtgtgggaatttgagcccagggtctcctgcttttccaagagaacctggaaatccaattttgaaggaagtctgttgatgtttaaatgctcacaacagtttaaatactgtatgggccaaaccaaacataacacagattttaacacagtgtaggctggatttgttccctgtctcaatgaccctccccctctacccccagcctgggccaccagttttccacgtctgcatgtcacaacctattttatttaattacaaaaccaatagtatgtgggaatgggggctggggggttggtacagtataaagctatgtgagttgtagatacacttatgtatgttgggcaccttggtgggatccataccctataagaaaaccatagtcttgggtcagagtcagggctgctacttaaatcagttccttatccagcatgctggatgaactcatcagttctctgtaagaagtaaaaactacaagcactctttaaaaaaaatgaaaatgaatgaagagaaaaatagacttattaaattctttaatttggaagactgggtctcgctatgttgctcaggttggtcctgaactcttgggctcaagcgatccttccacctcagcttcctaagtagctgggattataggcatgtgccattgctcccagcactaaaattgactttcttgatgtacagctctctcaatttgaacacatgcgtagatttgtgcaatcactggtatactcaggcaacagaacagttccatcacccccaaaagtctcccaggaaggctgattttaaaactctaactggaatctaagtcattctgcttggggctaccttataccctgactttgaagaccctaaaaatcagttgagggtgggagggttgaccagaacatgaaacttgggttcccagccattggtggggaactgtttcataatgagcaccctaccatacctatataacaagtttttgcttcttcctaatacataccttctgctccagcctgggtcgtcttttcactatcccctactagggttgttccatttagcaactaaatgtataggatgcccagtgattccatggggacatatttatattaaaatattatttgttgttgatctgaaattcacatttaacaggacattccatattttatctggcaagcccatcctcttcacattcatgccacattctcatgtaagttcaaaacctactttctctgtgtttcaccaaagggtgaaaatactctttgaaaatactctttgattttattacacttaatcttagccaaaggccaagaagcgattgtatgctttgattttaaatagtrgcatgtttatagggagatagggcaagtgttggaaggataagagtgctttctatacacataaatggattttcaagaaatgttttgtgaccaactggttttatcctttccagagaacaagaaatgatctaatatgtgctcaaggaaggaggacaactggatttcagaaattggttcatgttacagcccctcctctaccctttttctctggcctgacctttgaataatataagtctgaaaagactaaacaaagagattgctcaaactggatgagtttaaaaataacattggaatgctagccttcagcaagccatatatcttatactgcactgagcaggacagtgccctgtggtgggtagaagatgagtcacacagtgatcacaaccagatccttcccagcctggatactttggtggagagtggtgtgatggctgatttatttgtcttgtttgtttgttgtttcatttttccattttactagtgtgatttcagaatcacaaggaggcaagraggaaaattgattttagatagcagcttcagaatgaaaaatgagtggaaattccacttttcggtctagaccagggaccagcaaacaatagcccgtgggccaaattcagcctgcagcctcttttcataaggcctatgagcastgcctggtttttatatttttacaaatttgaaaaaattcaaaaaagkatcttttatgacwcatgagatttgtatgaaattcaaatgtcagcatccataaataaacttttaccagagcataaccatgcccattcatgtatgtgttgtctatggctaagtttgtgctataatggcagaggtgaataattaaaacagagactctatggcctgtaaagccaaaaatatttactatctgaccatttggagaaaaactttgccaacccctgctttctacatggcgtatttcaatggctgtatttgcgatgaaggctccaggagccttttatctaaagaaatcactattgcctcattgcttacagtccagaacaataaagcatctcagacatccttttcactgttttctgggcttaccatgatgagaggttttgtttaccgaagctggcatgtgagttttgccgctgtggaattttctcattatatcctttgctatctaagccaactgcatgttgttgttgttgttgttgttgttttttgaaaaccagaaaatctgatctcttagggttaacagtttggcccatctgaaataagtccatacaattaaaaacatttctttctattgacagggactgagggttgagggaaagcactgcagattttccaggtgtattttttttttttttttgctccctggattttgcctgaaccctcacttttctctttcagggaactttaagcacacttagtgaaagactaaaggtcagagagcacaccagccacattccctgagtccaagcagggagccagagaggagtggtttctggccarccttcmctgttcagttacctcatggaacccttgggaccagggccttgatttacaaatagagtggccaccaggtaaaagttgcccatggccagtggtagcaggatcgaccctagtgtctctgaatcattaagtacttcctttctgccctcttccatttcttactcaaaaacaccagctacaattttgagtctggtctgcctggaaatttccaaagggactttggtgccttaataaatattttcaaattgctcaaggttttggaagatagcagagccataattgtgaaatcgrgttaaagaatgattgctgcagtacttgcgtcggccctgtggccatgctgaagtggacagggttgtggacactcamaattgctcactgcagatggacagcctttgcttttctggtcatacatatgcttgatcctgaaattctctagatgggctacttctgagcagctgcttggagaatgggaagccaaccctatagtgtaaggtttcttaactgaagtacyattaacactttgggatagataattttctgctgtctgtggggccgatcttttgcattataggatgttagtggcatccttggyctctatccattaaatgctagtagcacaccccactcttcattgtgacaatcaagaaggtctccagacattgccaaatatcctttggggaaaaaaataacccctttgaaaatcactgatgtagtataacataaaggttacctgaccaaatgtacttcccattcttttaccattagggatttatccctttaagtcttcactctcatcattagggattaatttctttaaatgtcaaagtcttttttattttctagaatccctcacgacaatattgatttaactaacctgcacgttgtgcacgtgtaccctaaaacttaaagtataataaaaaataaaattaaaaaaatggtaaatccttaagcttgggatggcagatggttttcagctcctatgtgaactctaactgatagaaagtgtccatctatagtgccgccgtgggaagatctttgaagctgcattttaggtgttggagaaaggacatyaagacagattagagctgtcttccatgggcaagagatgagggagttggcatacacgtgtaaggaaccttcttacctaacatttctgcggagattcactatagtcaggccttaggctggtgctgtagttcagccttactgctgagccctgtgccagggcactgttcacacaaggtccctgtagccttgtgtatttgttagggcaattttccagcaggttttgaggaaagggcaccttttctagatcacagagtgccatatgggcgagcagaggtgctgtactctgttgatgggaatagaagtcagggaacaaaaagagaggggcaaagaatataacttcctgtctgtctctcctgcctgactgtaaacttcttgaggccaatgactatgtcatattcaccattatctactctccgcctgtcacaacacattttgcatagtgtcaaagcaagtttagtgacttttagcagagttcttgttctgtatcttggactccttggcagtcttgtggaacctatgggtcgcttttcagaatagtgcttaaatgcacaaaataaaatatttaggattaaaaatataaccaatgaaatttatatatagtcagcaaaatattagaaaactgtgatagataatgtgctttgattgattgatgtacagtcagcaaaatattagaaaactgtgatagataacatgggmtttgattgatgtacagtcagcaaaatattagaaaagttaaagataacatgcttttttattaagtaaaatctagtggcagttctaatacttactctaattgcaaattattggtgaatgtaagtgatattttgagctgtctccaacaactgtaatgttatataaaaagtctgtgattcctactcctaataaagtcatggtatattagtccaatctcacactgctataaataacttcccctgagactgggtaatttrtaaagggaagaggtttaattgattcacagttctgcatgtctggggaggcctcaggaaacttacaatcatggtggaaggggaagcaggcacatcttacgtggcaacaggtgagagagatcatgtgtgtaggagtaactgtcaaacacttataaaaccatcagatttcatgggaacacactcactatcatgagaacagcatgggagaaactgcccccatgatccaatcacctcccaccaggttctgcccctgacacatggggattatgrggattacaattcaagatgagatstgggtggggacacagagccaaaccatatcatataggtactaatgatctacctggggcttgtgcttacattcataactgaaggcggtgctaaatgttagctagggggtggtaaaaataacctttagctgggtaccctaaattctgtcttatccccaaacgccctgaattctcacttctttcttttgtaactgggcccctgctctgatggtttcctcctttcctttgcctgatgctacctctkttaccttcttggggttcttccccagcaaatttttctaggttctttcttctgcattcactttccatctctctcagctgggttgtgtcctttggccgctatctaagttctcactccgcttagcatgggaagggaagcttctaggcccagcttggggttaccctgagcttcagaggagagagggaggttggcacatcacagatactcactgaatgctttttgaatggaaacagttgctttgccaacttcaccttttttatcaggggctcttcttggattcttggactgtgtttgagatcagttcactcttgatatctcccctcsgcatggaaagcatccacaaatttccagctagagcatgaacttgcaatttggtttgcctagatcctggaagtctacagagttagaatctttcctggttctgaactcagaagcagcagtgagcagtgggactgctrggacctttaccagcaatcacccaccacrtgcaccagcttcaagcagctctgcagaagccgtccgtcaccctccccgttgcacaccttggctgtgaaccgccagggcaggggcatgtgtgggaagcaggcggcctgcagattcattattgctacaagtgaatttcataataaacaaacaaaaatgagccatctctagtttagttccctttgagcatataggccatcaggtcccaaaatgttcagagttgggttagtatctgtggctttcaccaggtaaacacatcagtgttcttcctaatttggactgttgtggcttccctrgttcttttttcccctagattgttataaaggttctgtattagttttccagggctgttataataaagtgccacaaattgggtggcttaaacaacaacaattttatcatctcatagttctggaggctagaagtctgaaatcaagatgtccagctagattggtttcttctgagggttgtgaggaaggatctgttccaggcctctctcctggacttggggatggccagcttctccctatgtctcttcacatcatcttctttctacatatgtctgccggtgtgtccaaatttccccttttcataaggacaccaatcatgttggaatrgggcctaccctaatgacataagttgatgacttctgaaaggaccctgactcagaaatatcctgaggtactgggggttaggacttcaatatatctttctggggacagggtccttgcatgctgtcagatgatacctgcatctcgcagtgatggtcaagcgtaccctactctgcttctggctatggcagtagaaattgtgtcccaggggaatggctaaggggcctgtaaacaatgggtgccatatgccattaatggctcaaacctctgccttgtctacacactcatgtatcccataaccctctgtctcctgtcaaagccttttatcaggaaaggcatagaaccacatttcacgctaaggcatgagtgttaaacataccctcacctagccagttaaaaacattgggcaaagctgtaaactacatcacaggagttcaaaatgtcaacagagctgcccccagtcctgtctgtgtttttgcttaggacccagtgttgtgtcactactccccattgawaataaacaaaacatkcctcatatgttcacagttatttagagtttacagaattctctccttctatcaatttgtttgtgcctgaaggagcaggaaaggtattattttctgcattttatttcagagaaaacagaagctcagctgagtaatttgttcaagatcatccaggctgtggccggagcccacatcatccatgtctctatgtcagctgtctttccactgctccaagccacctgccctgctgccctcygtttcccctccaggtcactgttgtgcggaccatgcaacccgagtctcaaagactcacggatccccttgctgtgctctaggacccagtccyagcacctcctaacctccccaagagggcaaaaagcagcctaggtctggtgagggtggccaaggccagaggattctgttagtatgcagatcaaaggaggagcatgggcaaagtgasraggtttgtgatggagcagaacagtgtcaggaagtgatgtgaagctcagcgtggctcgtggatgttgagaagtgaggttgatgggcagggggtgctggaccacagaagaccaggtgttccaagtggggcaaagatgtggtctgtgagaggctgagagccactgaagacctgtggtttatcagagactgctgtggtggcagagtggaggcaggatgaggcagggagctgctccaggttcctgactgccggtccctgccagtgctggtacattcctcaaggcttctcagtggctttccattatttccatagaggggtcacctttagttttggggagtttatttttgagatggggtctcactctgttgcccaggctggagtgcagtggcacgaccattactcactgcagtcttgaccacctgcgttcaagtgatcctctcacttcatcctctcacgtagctgagactgtaggcgtgcaacacgatgcctggttaatttttttgtattttttgtagagatggggtttcaccatgttcccaggcttgtctcgaactcctgggctcaaacagtccacctgcctcagattcccaaagtgttgggattacaggcatgaaccactgcgtcggccaccattaggtttttaactgtttaaggcattctttttatactgaaacccagaagaagcatcctccccagcttcagtggaaagccttagagctgatggaaaaccagtttcgagttggaatgtggaggctatttctggcctttgtgacatcctgttcaactttcagaggagcctgggaagaaaggggtgactcagactataagcttatttttagggaaagctaagaattcagtcagagccactcggattccctattgcctgccatacagaatgtgctgttggtggagagattgatgggcagaaatcctatgtttatcacctgattgttacccagcacctcccatgtgccagtataaggtttactgatttgaaaagaggatggagatcaacacaaacacacttttaaatcagaggagcatatttcaaggcatttatatttaagaactaattttagggccaaagaactaatattgtaagagcttctgtgattaggtacttaatatatactactgttatggtaagtgtttagcaaatactaccgcatttaatggaaacaataatactctgttagaggaattcttatcactgttttaacagaagaggaactgttaacttgaggaggtttaacgttagcccaagaccgggtagctgagtccagattcaaactcagatctgtctggctccaaacccatgcaaatgacccctccgggtttggcaattaaacgactcacatgttgccaccctttgttcctatgtatcactaattgatcatggaattatttcttgctcagctcagatttgacctcaggatcctttcaacacaatgctacaggtagccactgctcccaactgagcaatggtagtacttgaagtagcgtctacctgtcatcttagctttatctttctctgtatttactcaaaatagaatctttaaatctacaggggtttgttgttgtttatttctacagwtgtatttgtaaccttttattgattaaacaattgtaagaaatggagtattcaatacaatttccttttatagtcactggaaactctgcgtgctttaatagaggatcctaactgccttggagggaagaatgacgtcttaggactcaaagccttgatacaggcaactggcttatgtgtcagtgtggtagtgatgagtgggagatggggaatcagcctgaagaactcaagctgtatagcagtaaaactttcaattagcccagtctggttaattacaactggatggtgagttggggttgggggatgtggtgggaaggctaaagaagcaagataacagggtagatttgggggttgcatacatacacaccttcagttgccgtgaaacatttcagctcagcagacagacctgttgtcctaaaagtatagcaccatgtggggctgtgggtccctccagggagaaaggagttccttaaaagcaaactcagacaagagaatggggaagatacccccagggatagtggtgaagggagaacctagaacccagccttgcaggaggatgaggtagaaattggtccaggaggaagtctatggacaatatctaaaactggagcatcaagaaatagtaatagaaatatgttgcttagaaaggtggattccagatgattgagctgaaatggagttggacagtcacaatgtatggaaggtagtgcaggtgcatcaccaacacagattcattcgataaaattaaaatgtttttgttttactttcaaaaaaataaatagcaaaaaagcaagctcaggccagtggtggctggtggcctgtcagcatggagcatggaccttagccacaggccagggctttaaagccaggactccaggacctgggatgggtcattctgaaagctgattatcagaatgctcaggccagagctgggccagctgcccaggtgttgatatgtgtgtgtgtgtgtgtgtgtttgtgtgtgtgtgtgaagggctgagaactgcatctactaacatactccttgtgtgatgttagggttagtgaattgacctacagtggtacttggcctgcaggaaggggataaaaatgggcatcatggtaagaagttgggccagcaagcagctctagtctcacaaagccttttcctggactaatgagagggaccatggggaggggtgatccccccaaaatcaaccagatcaagttcctgatgaatgggcaatttatgactgaccagctggacacaaaatgccattgaacaacccaaatgaacaacacttctcagtcaaaatgctgctttggagagtctgtgtatgcaaatatacctcatatattcttctcactgtgggatggagcaagaaggccctgagcgtgtttctctaaaaatgcatagcaataatcctagtcttaattttagcctcttctgggcatctgaaatggggttgctacagttaaaataatgctgtataactaacatgatattgggtattgaggtcagagcagggctggcttcatcagcacgtgatttctgtagtcacataggttccccactttgttaaatgctccatagccatattgaaattcttaataacttttggaccaggagccctgcattttcattttgccctgggccctacaaattatgtagccagcagtgggttgtcataccccagagtcccagacaccagccagacatttgctgtgttgaaattatataggggaaaaatataatttagagcataaataaacccccatactttcagcaatttaacagtctaatgcaggtattccttgccagtggacagctttcctccatgtggtttctactatttctgactctgctatctcccagggcctcagaatcctttgcctccagcctgtcaaatgagagaggatgaagaggcacactcacttcttaactgcctttgtctggaagtgacccacatcattcttctcatagtctggagaactagtcatatgaccacacctaggtgcaaagaaagctagaaaacatggtacctggctgggtggttactttccagggctgcctccatcctatgggaggaagagcgtaaatttagatggatcattagccttctctgccacatagattgttcatgaaggaatgctgatgcaaaagcaggtatctcagtgcagactactgtgatggatcaggaaaggtaggaatccgggtctttttaacacagatgccagtctcttagcctcatcagttcattattattaagatgcttgctagttccagaataggaagaaactagaatcagaatagtctgtgtttgtttgcttgcttgcttatttatttatttccaagaacaggtttttggggraaaaaaaagaaacactaacacattaaaatgtacacattaactgtaagatgcattgctatttcagtaacattataatgcgagaggaaacacaatagcatatcttagaattgaagaaatctagtaattgtcactgtgaattattggtttagtaatttttcacaaatccttttgctagcttcataaagtcctttaatagtgctcataggggatagccatgtgttggcacttggatctggtaggttctgcctgaccattttaatcaaaatgctgttaaccagggtaggcaccgcctgttgaatagcacaccttcttggtgaatttgtctcatggagcctcatttctggatgtgtcttaggcaaactaggagccctcaagatcatctagacccacgctggaaagaggtctaccttggagatgcatttatattcccccctgagatgctggtgattttgcaagtagtaataatcagagacctggaaaacttcaagagttctgtaggaaatatgtcctggtcagttctcatcagctcaacaaactgatgtggctcttgagggaaccagctgcaggaggcaggaaagcaagttagcatcaacacaagtgggccagcaccatagtcccaattctcctctttcatctgcttctcctccaccctagtagacaccttgggaagacaaggtagagacagtggcttgaaattcctagtgtcttcctttgatgggtatgtgctcctgcagagttaagggagtagatgaggttaactgtcatctaaacaaaggcagtggctgtaaatatattccttggagcttgggagccccatggctatgttccaggccagagagtccaaagaaaatcaaagactgccacctaacagcttttttggycatcctgaaagtccccaccttctcccaggtagctccagagawagacaactcccagccaggctctgacagctgaatcgaatggcccagtggtggcacattccccagagggcttcaggttcaggatgcagccaagtttcctgctttatcctgagttaagcagagatcatcacctgcctggatgttgttttgtctgtgtcacctcatcactggagaaaacagattaccatctcctgcagtttttttcacaaaacagagcatggcatggaggaaataagatagtcagcatggcatcttggtgggtcaaaaataatatcatctgtatactttgattacattttaaattcagtttgcacacaattggggttcatttaattaactctaagctgtaatctcagtctgggtttgaatggatctgaattttaatagctttttcctccaaaatattatttctatggcaaataagcagcccttccttataatgctgaaatcatakaagttagttgttttcccctcattttttgacaatcattctttttgcrgtagtaaygaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgcygttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcwgtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggrygctgagaatgttcatggtaaatacaagacagtctctgccctcacggagcttgcattctggtgggagactagrgaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgasatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttgatctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcccggttcatagatggaaccttctatatatatatgttcacatggtggaaggggcaaggcagctctctgggaccttttttttttttttgtctgaaagaattccaatattatgagcatgtaatataaacaaaggtagtgctttaatctattgggaaaakgatgaatgatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgwgaacaaactaatacagtaaattggtactggtagagtgaggtgctactgtaaagatacctgaaaatgtggaagcaactttggaactggtgaacagggagaggctggaacagtttggagggctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaraagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaagaaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggrtgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttcttaaagcaagtcatggtataccygaaagaaaccaaatataaggcactgtagatgaatcccagtgctgttggcagaagggacagggaggccacatgtgaaccaggggtcactggccctgccccaaaggctggacttgaatatgcagctggtgccactggctaacagagccacagtctcggtcacaataatagaactgttgacccatgaggtttctggtcataggggcagaaactgccaacagggagagggcagctggccatctgaagccaggatctgtcccatccaggaaaggagaattggcaggagttggggacatcttgccatgggtgaatactcctctgagaagggagaagggaggaggmagcttacagacagaaccatgarggagggacaacatggagcccaaagccctgctcctgagttgctgggtctggatctcggggtcagggttgtttgtgagattggagaggcagcagaagtagcccagatgaaagggaagaacctgggttggtctctttgctgggcaaactctttgcaccacagtctgggctggctcaggcattggataggagtgagcctgagggtgggggtactgacccatccagcggcacaatttgggaaaggaaggggcagaagaagcaaggcgcggctgatgaggaacatctgctctcttcccacagtgcagatggaaggcctaaatgccagcacaccgtttatttcactttggcaaaatccatgtttatttcatccctcacctcattgtctagacttaacataaatcaggacagtgcaaatggaaaccacaggtccttctcttggccttgccagctttattcttccctagggcaggtgcgcatgttgcattagtgtcataaggtggcatgagactgtaccaggccattagtcctgattctgatccagcagcatcactgccttgctccgtgatcttcccatgtttgagtcacctcatccttgatatggaaggggcagtacctgttctctcagtagcataagataavaggtagggaagtgcttgggaaaatgcaataaaagacactgctggaagccttcagcagtaggttgggttacagaggtcttggccttgcaaaatgaagtgaggtcagcacagattaagcagaccaaatcaaatctttgatggttgagtgatttttaaaaatgattgcaggtctgcacaatttaacaagactgcccatagcagctgaaaacatttccagagcagatcagataaagccaagttagaaattggtcattgctgtaaatcaagtggcagactatcaatgacctagattaccccagttttcccacaggaagtgaaaggaaaaccactgtgtggctgctgaggcttgatttgtcaagagctgagagagctacacaacattaaaagattgcccatttctcagcttgccctaatgaattgggactcatttaattcagaagccgatgagatgtctaaatcacatctatagaataagtggtcagatttaaactccagttgccaacaatctgtaacagcctctggttgcgttgttcatctcttagttaataaatgcttggctttttgctgaagctgccgctttttaatgtctaacaccatgacgtcagcatttttcccattttctgccctccctttaaggaggtagggatgagaaatggtaagaagatagggcttgttatgggtcttgacttggaagacccagagcatgggtcttgaagtagaaccttgatggctcttttctgtctgtgctgcaggtttaggggcctgcatttagactggcccataactatgggagctgctcccagccatcctagacttctcaagaagcccataactcttaggaagaactaagagcctaactcgtgttgtcctggacttttcaagaagccgataactcctaggtagaaccaggaacccaactctactcgtctgtcctacgtagggtctacaaggcagtgtaayacaccacgccctgcaccctaactgatcatagtcagcygtggtgaccacaggatggttcatccttcttgctggttcccagcatccttcttgctggttcgcatgtgctcttttggcacttatcactcccacattctggactcctggccctgcagttgactttgaccctaccttcggccctttgaatttgtgcaaataccactgctgagctgacttgactcattctccagctcccactaccgtttgcagtgaaggtttgtaatgcccttgatgagaatgaagctcccagtttcacattgggacacagtgggtaagcaaatgccacacaaaagaaggcacatagtgcacacttgtaccatcatctaacgtctgcatggttctattgcagggctatactttcttatcrgtagatacatggaaatggaaatgcacctgcttttaaatatrtacttaatgcacaagtgtcaatgatatagttttcacctgaagaaaatctagagccatcaaagtacagggcgagacatactatatgagcctgaacgattgtggcaggattctaagaatctggatgatgaatctgaagaactctgtaacaaacagatgcaaagatgccatatttagacctcagaggaagtgagcctcctgtcactgggagaatccattcattctcctgattcactcatatgcagaataagtgttgatggccttctgtgtgctagggattcaaggacagtgcagtggaaaagatgggctagtacggaggatttagaaggtggtgtgggacaataagtactctgatagagaagcatgtggtgctctcagaagtaacttgtccatgatcacaaaccagtaagtggcaatttaattttgaacacatgtatatctgacaccaagactcatctatcaaccattaagctatatcattgcataagcagttccctgtaactggattggaaggtttgagataatggtgagaatggtgagaaagaatgatggagagatggactgtcttgtatgccattttaggtagagtttggattttatcctgtgggtcatgggaatctctcaggaagtgatctagttggatatgcatttttgagagagtactccactgtagtatatgaagtaatttgaattgggagggatggggagtgggcagtaagaccactcagaggtggytatcttgatactgatccaagaatgaaatagggatagamtgacatgagagagtggctgtggagatggtgaagaaggcatggatttratagttatgtggttgaattgctggaacttggtactgattgagtaaagggtgagaggtatggagaaataaagttaatagccatgtttccagcatagacaaggggatggttgatgttgaacatggaaagagggacatattttggggaaaagtgatgagtttattttggacatgttgagatcataataccttcggaatatacatgtgagatgcctgataggaaataacatrtaggtatggaattcaggaaggagatctggttttggggacttcagtaaatctgcatcaaatagtaactttagccatggatgtgaatgaggctatccagggaaagaatgcaaaatataaggtcaacctggtgactcactgtgctgagggaagccagggaagyagaaggggagtcagggtagacagaaacaggggggtaggtgaagatgaaagaactttccaggaaggagggagtgatgcatggtgccaaatgccactgacaggcaatggtacacattctaaaaagtgtccattgaacataccaactagaaggtaactggtggccctcacaagaatggaaaagcaggttcagtgaggttgtggagtgtggagttcagctgagaggaagttggggattaaatgaagtctttgtctccctaagtggtgtggctgtgaaggaaagaagagaagtaagtcttagctagagagggcataggatttgcatggattgttttaagaagaggaagtctaaattcttaggtgaaggagttaggagaaaatagtsaaagaggtgaaatgcaggtgagtggaggataaatgatggtatggggtccctgagaggtcagggcatgatggaattcaaggtactggttattagcctttttatgtacaaacaaaaaagatattgatgttctatttatgctaagtatgggcttgtcctggggagaaagtatctttaactgaagctagagagttgacaaggaacatgtacaaagatccctggacagtgttgagagctcagataaggttggagaccacagatttgtagtgtcgttctcctacactccagggcaccttatgtaggtgtttgatcttgggaaatgagactgtgcttagctctcatttgggatttttgccagatacctggatgtagccaaaggacgaggaggcaagattgttgaggatataggaagacagtgcagtgattggaatggattgttcacatgatcttaggcgaaaagacataaaaatgaagacaggagggctatgatggactgggataagatagaggaagctggagattagaagatttgaaaagacccaagagcagaggtgtgaggacaagccagtgagagacagggaaagaggcgaggctgtggttggagtctgggccgctgcacctaaacagttccacatttagtgatgaggccagatttcagccctgagtgcagatcgttgaggagagtgaagatcaaggtcatcagagttgaggttttcaggaaactgtgggaataggrttgaatgagtcatgaacacaaacactgaagtcaccccggatgatggtgggatttcatatagctcctgtgagccaaggaatgaagtcatcagtggatgtacggaagtgaccagaagatcagctggggacagagttaaggagagagggaacaagggaacagatgagactttttccatgagggcagaggagtcatggtctggaaatgacatgaaggagaaagaaaagtgccaaacccacttcctgatcctaatgccatctggcttaagagcccatattcattgagtctgaaatgcaacggacaactaccrgtttgtctggaggcggtacaaatactcttctaatatttttttaaaaactataggatgtagtctattttcaactttattcaascagatttatttacccctaccgagttttctaaatcagtgaatcagtattttaaggaataaatcttaggcacataaaatgataggaataaaakatgtattataaagcttctttaatcaatacaagctattcttataagtctattggttaatgtctagattgccgtgcccacttaaaatgggaaaacattccagttggcactttgtggatgttgagttgctacttggacacagttactggccttttggtctgatcagaggccaattttgagctaggagtttcccatgcatatgcatgatgtcctactatctgtgatacatgctgsgcatctgagcctgcctggtatgctaatgatcagaccagggaaatgcacatcactgtgagtcacaagggtagcacgtctaatctaaaaaattcaaacccctataattagagttcagatgtcttcatagctctattcctcagatttttttgatctgaaaaacaaaagcaaacaacaaacaattgtgtaaaaatagacagtctaggcttgtgtaaatttgcagtggaaatctgcctctctgatgagccatacagtgtctatgggttgaaaaacgaaattcagaaagcaaatagttggtcaccttagagcccagagggatgctcagaattccctaacctcacagyggtgactactgaaagtttcattctgttttatgacttgacttgcagcgaggaaggtagcacagctgtaaaccagctgtattttatttacgcttggaaacagggcccctttgttccaaatgttcctggccccctccctcaatttcatggatttaggttgttagtggaaaagtagttgttgaaatatcagttcactcttggaacctgccactcaccaggacttctggcaaccagtgagcctttttgtgatatgcagcaaggtaaagaagtcgttaagtggatctcccacatgttcctctgtgacttcattcatagaaatgcgctgataactgagttacattaagcgcagtcttcccagctgtctgaggacataagggatgtagcgcctcctagtggagggaatttcttagcatgtgttcaaccccgcacatatttttggaatgaggcaaggtatttaaaaatagtgtacgctaatgaatgtatttattatatctgggtagcagcgaaacagaaaaggtataaataagcctttcgaaaaatgtacttgctacacaatctctttttttttgacaagtcagcccttgaatacaaataatcttttaatggtgaaaaaaatgactgaatcatagcatcttataaacataggagctatgggtatcaataacatggaaactgaagctgtggttatttttgagtggaagaagagggattaaaattggcgtggggcacatggagaggcttctggaagtggctagcaatttctatttatttttaactgggtggtgattacaaaggtgtttgccttataaaaattcatttagctaaacattggttttatgatgcttctgtatctgtattgataagaaggtaaaaaacataaaaacttttcattaaacatactacctgctaaatttgctttttaaggaaaaacctcaaaaatgctaagccatgtatactttttatttttagagatggagtctcactgtgttgcccaggctgaactcaaactcctgggattaagggtttctcttgagtagttgggactacgggcgtgcctggcatggttttgacactttatttcactgtactttcgaaataagacttaggtaccagtgaacacctacattgacaggcctggtaatatcattaaaacttgagcttttatgttgtctgtggcacagactctcttctttctagttcttcagagaactccaaattcagtatttcacttggaacatccagttgccatagaaatgaccatgtaggttacaagttcatttttgtaaccagtcaaaaggagaaactaagaatgacacgaaggcatctttccattggaaaaaaatcctttgcagagtcccaatttgagaaaaaatacattttgctttagaagtgagaggcgaacagatgaattagtaatgctgaaatatttgactccttcccccacaggtgaaaactcctgcagagcatcttataagaaaaattattttagagcaatataggtgatggcaaattgacattgggttgtaatattctatccaacatagtttaattctgagttattcaatcataactaaatttattcaagacatagaatacatttaaaaattcatcttaaaggaaatttcacaaaggcttttacattcgtgtaatccagatgagaaatgaagatagggggcaagcaataaagttgaaagacccaaattgattccggaaggacttgccaagtttctataatgcctcattagctgcttatgtggcagggagacctgggaagagcaataactcttttctaggttctcaggttagggaatgagattttgacgtggccaatatgatcttatatgtccatttatgtcttttaccttatcattttcttttaccttatcatggacagagtggccccccagaagcacaggatgcaagacaacacacatttcagtggctgctccttctgcatacatcattgagytstgccaagggtttgaacacacacacacgtaaataaaggcctaattatgtgtgtgtgtgtgtrtgtrtgtgtgtgtgtgtgtgtgtgtgtattatatgtattaagctctttttcctttctccatagcactgcatatacaaagatcagccaccctgagttgaaataaactgtcatgatctgtttggcattgtgagatcaccactcatcataaaataagctttttaaaatgttaaaattgaagtgagagcatgagcacaaagaaacaaggaccagaaggtgtttataatcatgaaaaattgggaacaattcaataggaaaacaggaaaatggttaaatatgatatgttcggagtatggaatatgatgcagcagttacaagtagtaaaatagatcagtatgtactgacatgaagaaaatagacttacacataccttatgtaaaggaggtgaggaaaaggaacawtggtcttttctgtattattagaatttgaatatcaaaattggattcatatattacttatataattaaaaaattaagttagtcagacttagaactctttgaaatctaatttttgaaagttaatttatgccatctggaggcaaacatgccaatgtgattgaagtttcagtggtaacctgaatcctcagtctcgttgcacatttactctgaagacattctcaaaagagaattggagaggaaatccacccagtgtgtcccctcatgtatgtctgtctgggatgctccagtggtgagatgccgtcacctcagtccattgtgttagtttattgcaatgttctagggttcagtctcagccccattcctgccaactgttagcttaaggcccttgggcaaaggagataaaattgttcagggccaacagatctcagagtttcttggaaccttaaaaggagatgacccaaacatttcttattcaagatgccaccagctccagtcactcacagtgacttgccacaggggctggtgatgttagctgcttccttggcgtctgagttctggcttgtgagcagatcttatgcccaatacatcagaaactccatgtctccttcagttgtagtcrttgggagaatccatgggttgacwggagcctaaggaaagcaccaaaaagtcactagaggcactggagtggatatgaccttttcctttgaacagcagtttgcacaacatataccggtggctttgtagatctggttttcattaccatttctgtcctggggcagccatggaagccacctggatatttcaattagtgcagcaagctggaattcatttactttagagtctactgcctgaagcttctcccagctgggcacccaactacgcccaggaacttctagatataacacagcatcctgatttcagtctaataagtagatctattttagtcttctcaatttccagtcattttgaaagtgctcccctgtccccataccaggcatgggttccattcccaacttctatcactgtcagtggaggtggcagccttgtgagctgccaggtgggaccaggtgcaacccacagcaaggccacttgatgtctcagtctgtagagtaggtgcttaataattgtctttgacgagttaatgggtgcagcacaccaacatggcgcatgtrtacatatgtaacaaacctgcacattgtacacatgtaccctagaactgaaattataatgaaacaacaacaacaacaacaacaaaataataataataattgtctttgaatggctgactgaaagcacattcatattatctagtcaaatgaatgtccaccctccactatagagcctttgtaactgagctactggggtctacctcatttcagaatccctcagagtccatggtgtatccattcatgcattcattgagcaaatattatgtacctgttctgtgttagagaatatttgaagtggtgggaatatagtggtgagaaaggcatgtttctgccttcaagacatcaccatatgaaagatactctgggatggatggagggtgttaatagaaccccagcaaattgacaaggtggctccccctgtgtcctctggctagtaagggactggtggctccatgaaacagggagctgccctgtgctgcccaaggctccagccctgcttcctcctcatctcccccctggacgtgactctgcctcatggggagcccattctcttagggatctttgtaaactgatcttcttgtgtcaaaaacatcaaatgcctcagattccattgcttataataagcactttgggaccaaaggaattttttgtaatgaaaaaaacagtttttcataagttaatgtttttcctttgagacctggatgcccttctcttattcatccactgcccatgcagctaatcagatttgaagggtaaaataataccagacttatcattgcatgttacatgagaaatgtattagttaggagtctggggttctaaggcatagagacagcatgagctagctcaaggaaaaaggggagggaattgttataagggcacaggggtgccccacagaatcgaaaacagaaatgtgactaggcctaaggaaagcgtcaaaaagtcactagattttttttctctctttcatctctcttcccatcttccccatccatctatccatccatccatccatccatccatccatccatccatctatccatccatctctctttccttctctccttcccagctcctgcctctgtatttcttcctccttttttcttccaactttcatttcaggttcaaggggtatatgtgtgcatttcttatatgggtaaattgcatgtcacggggggttggtgtacagattactttgtcacccaggtaataagcatagtacctgaaggtactttttggacctcacccttttcccaccttctaccctcaagtaagccctggtgtctgttgttcccttctttttgtccatggtatactcagtgtttagctcccacttataaatgagaacatgttgtgttggtttttggttcctgtgttagttcacttaggacaacagcctccagctctatctatgttgctgcaaaggacatgatctcattattttttatggctgtgttgtattccacggtgtatatgtaccacattgatgtccaccattgatgggcatttgggttgattccatgtctttgctgttgtgaacagtgctgtgatgaacatatgtgtgcatgtgtctttatggtagaatgatgtatattcctttgggtagatacccagaaatgggattgctgggtcgaatggtagctctgttttaagttctttgagaaatctccaaactgcttgccatagtccgcctctgtatttcttcctccacctagcttcctctgctttctggtccatgaggtcaatcaaatagggttgccccatagtgtctaagttttcatgtcaccagcccagccacatcagagagactctcgtcagatcagctatggccagaggtcatattgttccatagtggttcctggatgcagattaacttccagcgaaaagggacacattttgagcaggacagacatggccaaagctatctaatatgcccaagtctacacacacagacacatgcccaaatccctctcatggctacacatccaaccagagatggtcaaatggaccctgccctgaacccacatgggaggatatggttctgacttgagctgcaggatcccagggcttgtgttgaggtgggaacagccctggacctgagccagaatactggggctccagtcatggcttcaccattaaacaactctagagtcttaaacaagttcttagcctgtctgagtctttattttctgtataaactgggagtcacagaggcagctttcaattatttaaaggaccactttatgggagggggataggtgtgttacctgtctagtgttggaaggtgaaaccacagtggagaccacagagtggcaatttgtggctggagatacagaagaaccttctcccaatcaggctgccccaccatgttcaacctgcctgccttgcagagagttggctctccctgttactgtgggaaatccaaggggtctcagaaaacatctacagaatggagatactggcccatttcctagcaggattatctgtgtttgtctgggggtgaggggagtaaatagaagtttgagtgctacatacaaatgtgtattttttgcattgtaatcttaacaaacagaaagaagtattttgctccagtttgtatattctttcaaagcctttgaaccacactttatttttttagacaggatctcactctggcgcccaggctggggtgcggtgttgtgatcatggctcactacagcctcaacctcccccagctcaggtgatcctcctgcctcagactcccaagtatctgrgactacaggcacataccactatgcctggctgatttttgtatttttgtagagacagggtctcactgtgttgcccaggctggtctcaaactcctaggctcaagtgatcctcccatctctgcctcccaaagccctaggattacaggtgtgagccactgtgcccagctgaagcacactttttagtgtgtctgccacaagggtttccaaggccactagctggcagaaggataaggtggaaatgtaaatgacatgcccctctcttcatgaaaacaatgtcagttgttcctctcagtccycaccataacagtttctgaaattctttctcacctccttcacttatttatcctttctgctccctgctagactgctaggggtggggacaggagtgatgtctgatcaccactgcctctgtgaccataacctctgatactgtcatttcttctttccaaagtcttggctatcatttgaggagctgagacaataggatagttctgctttcacagagcatattagcaaataccctgtgtgaggccctaatgacatatttggccctttccatctttggggctgtaatattccctacagatggaccctttggttaagtctccttatgttgcttttagttttcatcaatctctggttggtttttagaactactaaatggagccattaggtcattcaaaaacaggcagatgtatgtatgtttgtgagccatgatagggatccagaaatatttacataattttcatctattaagagatttaacagctgtgtytgccatgtagttactttaaaatataaaatgcaaggtcagatctcttggggatactgttttgtttttcttttcttatgattgctgttaacgatgtcatgtttaagtaaggaaagaaggttttgatattcctctaagagttaccagcmtgtggaggagttgtgctccaagaggatcgaaggcttagaattcaaatgtaaaagtgtttaccttcttaggccagtcatctgatcaacacgtaatgtagctgaattagtacacatttccaaagaatttacgaaacaagacaccttgcaaaactagcagtcaaataaaacagaactctaaaattgaatttaaagtacagttttgtctggctagccatatgtagaaagctgaaactggatcccytccttacaccttatacaaaaattaattcaagatggattaaagacttaaatgttagacctaaaaccataaaaaccctagaagaaaacctaggcaatatctcattcaggacataggcatgggcaaggacttcatgtctaaaacaccaaaagcaatggcaacaaaagccaaaattgacaaatgggatctaattaaactaaagagcttctgcacagcaaaagaaactactrtcagagtgaacaggcagcttacagaatgggagaaaatttttgcagcctactcatctgacgaagggctaatatccagaatctacaaagaactcaaacaaatttacaagaaaataacaaacaacccaatcaacaagtgggcgaaggatatgaacagacacttctcaaaagaagacatttatgctgccaaaagacacatgaaaaaatgctcatcatcactggccatcagagaaatgcaaatcaaaaccacaatgagataccatctcacaccagttagaatggcagtcattaaaaagtcagggaacaacaggtgctggagaggatgtgaagaaataggaacacttttacactgttggtgggactgtaaattagttcaaccattgtggaagacagtgtggcgattcctcagggatctagaactagaaataccatttgacccagccatcccattactgggtatatacacaaaggtttataaatcatgctgctataaagacacatgcacacgtatgtttattgtgacactattcacaataggaaagacttggaaccaacccaaatgtccaacaatgatagactggattaagaaaatgtggcacatatgcacaatggaatactatgcagccataaaaaaggatgggttcatgtcctttgtagggacatggatgaagctggaagccatcattctcagcaaactatcgcmaggacaaaaaaccaaacaccacatgttctcactcataggtgggaattgaacaatgagaacacagggacacaggaaggggaacatcacacaccggggcctgttgtgggggtgggggtaggggggagggatagcattaggagatatacctaatgtaaatgatgagttaatgggtgcagcacaccaacatggcacatgtatacatatgtaacaaacctgcacgttgtgcacatgtaccctaaaacttaaagtataataaaaataaataaataaataaataaaatacagttttgttttgtatcatgaatattgttgctacttgggaaaaacatgtttaatcaggcactaaaggggcagctgaagtgtttgatggtgattctcaaagggattcttggacccctcaagagttttagaagatagtgatgctagtattttattatgtataattatactgtaaaatacatttttgatacattataattacttctgtttatgacttaggtagtttttgccttgcaaaagggagatagggaaagaaagtttacttaaataattggaagcaaagggggaatgaggagaaagctaatgaagatgtgaatatttgtgaggaaaattgcctgtaagtgtgaatagggtgtgaatggagagtggatgtgtctggcagcacctcttcttattcttatcatcttactggggtgattgaagttgcaaacacatggcccttcacttcttttgtaaacggacataattgatccaacacagcatgattgctttctagtgcagcaattttcagaatactgccttctcaaagatrtggttctcctgattgattatgaaatgagataaaaatataagtccttggtttaataagtgatgaacaagcccataaaatactaggtttttacttttgctagagtaatctactaagtgagttattaagggcctttctgaactcaagttagtgtgtcaccatagactctaattagtctgaggactctaattagttctgctaaaaagtctcactgctattcggtgacaaagctcctataatgtggcatgcatgtagrcagttgtagtttccaaaaaagaaagaagtaggtggagcataggatgctcaaagtagacaatgatcaaagacttttgagagtcatcagtctaggaaagttattctcaaccctggctgggtatcagaattgtctgtagtgcttctaagaattatgagttatggccagacgcggtggctcatgmctgtaatcccagcactttgggaggccaaggcgggtggattacaaggagtttgagagcagcctccccaatatggtgaaaccccttccctactcaaaatacaaaaattagccaggcatggtggggtatgcctgtagtcccagctactcaggaggctgaggcagaaaaatcgcttgaacctgggaggcagaggttgcagtgagccgggatcgcaccactgcactccagcctgggcgacagagtgagactccgtctaaaaaaagaaaaaaaattatgagttgctggactgcatgatgatctactgaatgagaatccattctccccccagtaaacttttcctttatctcctttatctcattggcaggcactcattcacaggtccactcaagacagtcacggacaaaaggaaacaggattgtgaggatttagccccatggggctagagcactgctactgaaaaaaaaccaccctaactatatttgcagctttacggtgtgtaaaacttcagtttaaaaacaaaagggaraaaaggtctctgccttcaaagattataagctattcattcaaaaagaccaaacattgtaagaaataactggataattaatccataaagggcaagagaagtagagccagcttttattgagtacctgcctacctgtgtgctgtgtgctgtgtgctgggtgagtactttatatatgtcacttcctttaatcctcattttaatcttcagaggtcagtagtgtcactggcattctacagattaaaatactgtagttgagggaatttaggggatttgaattgcatttcctctctagaatggggtgagacagaagtggtgtccttctttcaggcatctaggkttgtttctttggggtgtgtatgtgtgtatgtttccatgtgtgtggcagcttaccaggctatgtcccaattaataaggagatgtatcatcctcattccagtttttcaaatgtgacttgaccaaaatgcattctattcctattctttgagtttatatgccagaaatggagtgggcatgtgtgtcttctcaggactaatccatgcatgaagctctttgaatcagcacaatattgtacagcctagttgcgttctgttcatcaagcatcggtcgatgatttattgacaatgcaaacaagtggtctgttcatgtgagttcatgatgatttgtgagtgcttcctgcccatctgctctctcattttaagtgtgctctgtaatataaaaatgatagtcatacaataattctattggggtagatctgtaccactacccagagatatttgtttgacttttactattattttacaaaatgggaatttctttcacaaagaagatgagttcattgtactttggctttttgtaagagaaagtgaatgttgtgacactgacatgaataaatgaattcatgttttctgatcccgtggaaaggaaagaatagaataatatcagcacgtggatctcataatgaaaggggagtaaagtgagtcttcagaaacagacttaaaataagctcaattcattgtaattagaaaatggatcttgaaagggccttgccaaaaggcgatgatgtgatgttggggtgtagaagttttttgacagtggactcttttatcacagaatgtgaggtgaggcagaggaaatatgattcatgttatagtgctttagttattgattacataggagtttgctttctccagctcttgttcatagctgctaactggcatacagaggaaatattgtttacttatttaaataatttttaagatagtgaaaattctgtatgtttggttaaattatacttggttgtttgcataggctgtctctccctgagacgctcacctcacttctctatgggtcagcgaaacacataccctgtgkaatcacctcccctataaaaccccatggcaacctcttccaacarttcatcctttgcattccatccaagtatgtcttgttatatccatagcatttagtgcatttattatttcctctcctgctttcctctactagattttgagagccttaaggactagagagtgactgattcatccttgtttccccagcaccctggagcaaagagcccagcacatagtagttgcttgtggtgaatgtaattcagggtgtcttaggactatcctgctcattatgaatagaggataaaaacagatttctaagttctccatctgccataaaattmtgggaagaaaaaatatgaagtattcctttctgcacacacagaagtcttccattttgcaattttctatctagtctgctgtcctttctctctcttctttatcagggctacacatcctctctcctggccagagcgtcatttgaggcgtgcttatgcagttctcattgtcttcaattaaggtttgggactgagattaccagcttggcttggtaaccctgttcacttattaaaaaatcagtcgatccttcatttttatgaaaagatgcaatgcaaaataaccttgatttagaatttaatgaggctgacatttaacctgagttcagttaggaagacaaacraaaaacacagacaaagttgagagaaggaaaataattacctacttgaatagtgtgggcaattctccatccatatgccccaggagaatatgaggtgggagatgcatgaattacctgaaatttcttttagcctctgtttatgattttagtctttcaagatgcaggtatgtttttcaggccttgtggtccccaaacacaaggaaactttctttatctgatggtcaaaagaagtgacgacctagtccttagtaggagaaaaatgtgcctgcatggactctttgtgagacagtgttgttggatactttatgaacattttaagggattctcatgagtaattttgattatagacgatttttactttatkcattgactaggaaccaaatgcaactttcttagaragacacaaaattcattgtccaaatagaccatagggtcagcaggctttgtaaacatgttttgtatgtgcctaggggttgagagcaggggcgggagagrttctggtccgttcatcaaaccaggggctggtgttaatgtttgatcaacaaaacacatgtaggcctaggctcygatctaggtccaactgccaacatagccttttcrtgcctgcctttcctacttcaggtagagagaggagaaaaaacctattgaggaaaaaagaaagaataatattagcccaagcagtggttctactcacttaaggagaatggagtatgtttatttaattttaactgaaaagtcctggccaatatttctaagsctggcttgggataacagaatgaatggccttgggggagagggaggagaaagaagatgactgattttagtgtctgctttatggtgtgtgctgtttaatcctcatgacaatcctaagtggaaggaagaactccccatgttaccagtgacgcagcggaagcccaggtgctactgaaggtcacgcagtcagcattgacraagtctacactagaatccaggcctgacacaacccaaagtctgtattttttccctctgcagtctcttaaaattggcaaaaggtaaaccttcatgcgaccctagatttgattggaacagcagatttaggggtcatgcaacaggagaatgagtggattataagtttttgagtccccagatctttggggagaaaacccaattctgttgaagtaggagctgttcaattggaggtgagatttttagtagggatttctaatgcattcttttttcccattgatggttgttaatacttcccctacacacmcacacacacacacacacacacacacacacacaagcataaatagggcacacgtattctcccatgtaagggctgctgtcccttctccctcccacttatagcratgtgtgcctctctgtagctgaaggttgccttgtattaggacactgactgatgagtactccccaccagggtccggagagtgtgcttcattcacctttcagcctctcacagttctggcacaggggagataaagatgttgatggtttgaggtgctttttggtaaataacataggcaaacacttgacacccctaggctaccacctgtcctgttgtgtggatacctattcagtgaagccagataacttttacaaatcacaatgaatacatcctcagcagagccagttgcctgagggaggttactgaatcttctgggagtcgtttgcaggcctttagacactgggctcctttctggaccatgcccaaactagtgacagatgcagtcagagtagcagaataaggaagtctaaagtcacccaagcctcttagttcttgataattgacatgtccagcatttcttgaccatcagtagaaaatactaaactttacagtacataaaataatcaattcattcctctgatggggcaactatttaagtcagtatggaactctatctttctgattgctgcattagtccctttttttttgtttattttgcttcttagtagaaaagaaaaatctaaaagattctcattttaagtgacttgagctatcagttaaattttaaaagccaattattttgaagcagtagagccttacraattctaaagtcacacactggaagccaaactatctagagtataaatatttccttttgagggggatactgacagattcttctattttatcccaattccagttcctgacctccactcacagacagggaggcaaggggaaggctcactaattggcaaggctggacaagcataaaggattcagtgcataaagaatcaagcttctgatcctctcaagaggtcacacgcagagtgtctatgtgctggacagctttggctgtacacaccagaagtgttccaggcgtaaggtttttggcaagtctcgttgcctacgttcaagtcctctctgagtcgcttactagtgtgtaaacatagctgagatatataatgtttctaagcctcagtttcactgtctgtaaaatggcaatgacaataactgtacccacctcacaaggatgctgtgttgtgaggtgtgaacgagccatttgtgtcagaacatagcacagtgctgggctcacactaagcattccattcatgtcagctactagctctttggaacttttcaactttggtccctagggctacattaaccctctttcctgccagacaataatctgaggttggttgctgctttcagaagaaacagtgtttgaaagttaagaaaaatgtacctagaaatctaatttctaatttcattgtcatgccttaacagaacacccagatgccttaaaagacttttacaaaatgcaaatttctgatccagaaaacttctcagccatagtgccaaagaacattatcagacccaattccctatatcccaacaaaaccactccccagtcacagattatccgacacaatttcattggggttctcaaatggcaagagtttgtttaaaatgcaaatctctgagccccaccctcagagaggccagcggggcagtggaatatgcactgaacacttcgggcactaactcrtgtgccaatggttgcacttggacatatactactctaggcctttgggctcctttcgtccctgcagcaccttctgtcctcaagacaggggctctcttgttttcctcatgcgagagctgttgcccagctagtccatcccactgaggacaaactctgactcaccttttaagatgtagttctctggctaggcacagtggctcacacctgtaatcccagcactttgggaggccgaggcaggtggatcacgaggtcaggagtttgagaccagcctgaccaacatggtgaaaccctgtctctactaaaaatacaaaaattatctgggtgtggtggcacacacctgtaatctcagctactcaggaggctgaggcaggagaattgcttgaacctgggaggcggaagttgcagtaagccgggatcacgccactgcactccagcctgggcgacagagtgagcctctttctcaaaaacaaaaaagaaaaaataaaacatgaagttcccaaccatgtgctgtgtagtgagcaccatggtggccctgcagtgtacaaaggtgaattggccatggtgtgtgttggcatggagctcccagtccagctaagaatacccttcagggccaagctgactccaccctgtttcctgaggcccagtcagcggtcccagcttctggtctgtgggctcacctagtttaaagacccccttgagcctcaaaggatgttcgaagcatgattcagttggggagttattggtcaacatggtgggacaattcttcactgtgtgggactgccctmaacagtacagggtacttagcatgtctgccctcccaatgctgagtaccagtggtgctccacagtcactgtgacaatcaagaaaagtaatgattgccacatgtttctgaatacccctgacctctggggaataatactgccccaagttgagagcctctgtccggtttaggtctttctcctcagtccatacctctgctacctccttaagggaccagttccctccaaggggcatgctttcttagaaaagtcatttgatggccgggcacagtggctcacgcctataaacccaggacttcgggaggccaaggcgggcagatcacctgaggtcagaagttcgagaccagtctgaccaacatggtgaaaccccgtctctactaaaaaaataaaaattagcaggacatagtggcatgcacctgtaatctcagctacttggcaggctgaaacacaggaatcgcttgaacctgggaggtggatgttgcagtgagccaagatcacaccactgcattccagcctgggtgacagagcgagactccatttcaaacaaaacaaaacaaaacagaaaagaatgtcatttgacagtgtacaaagtttatatattttaacatacaaatgaagttgacatggtatcaaccaaagggaaagaagggccattttgtaacaggcagaaaccagttgggatttaagaagcattttaattacccttactttttttctataaaggaaaatacttttatttctttcactgatgtgccggtgagagtcttagcaggcttgcctttgtaggtaaatatgatggcacttcccaatcatcatgtattgggatgtgaagttgtgtggagtctgaggctgacccctggtagtgtgaggaccttgggggattgccttggaaaatasagggtccagcccaaggctctggctttcagggtcgggggttgagatgaatttgtcacagctccrcctgagctcaccacactgggaagtcaaacagaggcaacagcttctgtttgctaagtgttaccacatgctaggcactgtgttgagtatggtgaaggacctcttaaatcttcagaacaaccgacgtttcagcattttacagctgcaaaaactgagtcttagcaaacatggtcttagagccacgagaatggacctgggacttaaatcccaagtctagagcctggacttgaccacagcagcatccagcttctcacccatctttcgctcaattcatccctttaatcatttattttaggattcagtttgattcccccaatctcaaaactttcaaggatgaacaatacttctcacacaaacacaccttctaccgaatgccaggaggggtctgcacttagattcctcagctgtcacagtgccattgagtctgaggctgcctgactgcttggttgtggttttttgacacctggcatttgtgtttaacagccccagtggttgagaagcagaggggacccacactggcagaggtggagggaaagaggagagggtgtagggaaagaggagagggtgtagggaaagaggggagggtgtagggaaagaggagagggtttagggaaagaggagagggtgtaagggaagaggagagggtggagaggtagaggggagggtgggggaaagaggggagggtggagagatggagaggagggtggagggatagaggaaagggtggagggatagaggggaaggtggagggaaagaagagagggtgggggcggttccaagatggccgaataggaacagctccagtctacagctcccagcgtgagcaacacagaagatgggtgatttctgcatttccaactgaggtactgggttcatctcattggggcttgtcrgacagtgggtgcaggacagggggtgcagcacattgagcattagccaaagcagggcgaggcatcgcctcacccaggaagcgcaaggggtcagggaattccctttcctagccaagggaatctgtgacagacagcacctggaaaatcgggtcactcccaccctaatactacgcttttccaatggtcttagcaaaaggcacaccaggagattatatcctgcgcctggctcagagggtaccacgcccatggagccttgctcattgctagcacagcagtctgagatcaaactgcaaggcagcagcaaggcttggtgaggggtgcctgccattgctgaggcttgagtaggtaaacaaagtggccgggaagctcraactgggtggagcccaccgcagctcaaggaggcctgcctgcctcagtagactccatctctgggggcagggcatagctgaacaaaaggcagcagaaacctctgcagacttaaatgtccctgtctgacagctttgaagagagtagtggttctcccagcatggagtttgagatctgagaacggtcagtctgcctcctcaagtgggtccctgatccccgagtagcctaactgggaggcatcccccagtaggggcagactgacacctcacatggccgggtacccctctgagatgaagcttccagaggaatgatcaggcagcaacatttgctgttcagcagtattcactgttctgcagcctcsgctgctgatacccaggcaaacagggtctggaatggacctccagcaaactccaacagacctgcagctgagggtcctgactgttaaaaggaaaactaacaaacagaaaggacatcgacaccaaaaccacatctgtacgtcaccatcatcaaagaccagaggtagataaaaccacaaagatggggaaaaaacagagcagaaaacctgaaaattctaaaaatcagagtgcccctcctccaccaaaggaatgcagctccttgccagcaatggaacaaagctggacagagaatgactttgatgagttgagagaagaaggcttcagatgatcaaacttctccgagctaaaggaggaagttcaaacccatcgcaaagaagctaaaacccttgaaaaaagattagacaaatggctaactagaataaccagtgtagagaagtccttaaatgacctgatggagctgaaaaccatggcatgagaactacgtggcgaatgcccaagcctcagtagctgattcgatcaactggaagaaagggtatcagtgatggaagatcgaatgaatgaaatgaagtgagaagagaagtttagagaaaaaagagtaaaaagaaatgaacaaagcctccaaggaatgtgcgactatgtgaaaaaaacaaatctacgtctgattggtgtacctgaaagtgacggggagaatggaaccaaattggaaaacactctgcaggatattatccaggagaacttccccaacatagcaatgcaggccaacattcaaattcaggaaatacagagaacgccacaaagatactcctcgagaagagcaactccaagacacataattgtcagattcaccaaagttgaaatgaaggaaaaaatgttaagggcagccagagaaaaggtcaggttacccacaaagggaagcccatcagactaacagtggatctctctgcagaaactctacaagccagaagagagtgggggccaatattcaacattcttaaagaaaagaattttcaatgcagaatttcatatccagccaaactaagcttcattagtgaaggagaaataaaatcctttacagagaagcaaatgatgagagattttgtcaccaccaggcctgccctaaaagagctcctgaaggaagcactaaacatggaaaggaagaaccagtaccagccactgcaaaaacatgccaaattgtaaagaccatcgaggctagaaagaaactgcatcaactaacgagcaaaataaccagctaacatcataatgacaggatcaaattcacacatcataatattaaccttaaatgtaaatgggctaaatgctccaagtaaaagacacagactggcaaattagataaagagtcaagacctatcagtgtgctgtattcaggagacccatctcatatgcagagacacacataggctcaaaataaagggatgggggaagatctaccaaggaaatggaaaacaaaaaaaggcaggggttgcaatcctagcctctgataaaacagactttaaaccaacaaaaatcaaaagagacaaagaaggccattacataatggtaaagggatcaattcaacaagaagagctaactatcctaaatatatatgcacccaatacaggagcacccagattcataaaacaagtccttagagacctacgaagagacttagactcccacacaataataatgggagactttaacaccccactatcaacattagacagataacgagacagaaagttagcaaggatatccaggacttgaactcagctctgcaccaagcrgacctaatagacatytacagaactctccaccccaaatcaacagaatatacattattctcagcaccacatcacacttatttcaaacttgaccacatggttggaagtaaagcactcctcagcaaatgtaaaagaatagaaattataacaaactgtctctcagaccacagtgcaatcaaactagaactcaagattaagaaactcactcaaaactgcacaactacatggaaactgaacaacctgctcctgaatgactactgggtacataatgaaatgaaggcagaagtaaagatgttctttgaaaccaatgagaacaaagacacaacataccagaatctccgggacatatttaaagcagtgtgtagagggaaatttatagcactaaatgcccacaagagaaagcaggaaagatctcaaattgacaccctaacatcacaattaaaagaactagagaagcaagagcaaacacattcaaaagctagcagaaggcaagaaataactaagatcagagcagaactgaaggaaatggagacataaaaaacccttcaaaaaatcaatgaatccaggagctggttttttgaaaagatcaacaaaattgatagaccactagcaagactaataaagaagaaaagagagaagaatcaaatagacgcaacaaaattgataaagggkatgtcaccaccaatcccacagaaatacaaactaccatcagagaatactataaacacctctacacaaataaactagaaaatctagaagaaatggataaattcctaggcacatacacccttccaagacacatacacccttccaggaagaagttgaatccctgaatagaccaataacaggctctgaaattaaggcaataattaatagcctaccaaccaaaaaaagtccaggaccagacggattcacagccaaattctaccagtggtacaaggaggagctggtaccattccttctgaaacgattccaatgaataggaaaagagggaatccttcctaactcattttatgaggccagcatcatcctgataccaaagcttggcagagacacaacaaaaaaagagaattttagaccaatatccctgatgaacatcgatgcaaaaatcctcaataaaataccggcaaactgaatccagcagcatatcaaaaagcttatccaccatgatcaagtgggcttcatccctgggattcaaggctggttcaacatatgtaaatcaataaacgtaatccagcatataaacagaaccaaagacaaaaaccacatgattatctcaatagatgcagaaaaggcctttgacaaaattcaacagcccttcatgcgaaaaacactaaataaattagatattgatgggacgtatctcaaaataataagggctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaataaagggtattcaattaggaaaagaggaagtcaaattgtccctgtttgcagatgacatgattgtacatttagaaaaccccaaatctccttaagctgataagcaacttcagcaaagtctcaggatacaaaatcagtgtgcaaaattcacaagcattcttatacaccaataacagagagccaaatcatgagtgaactcccattcacaattgcttcaaagagaataaaatacctaagaatccaacttacaagggatgtgaaggacctcttcaaggagagctacaaaccactgctcaacgaaatagaagaggacacaaacaaatggaagaatattccatgctcatggataggaaaaatcaatatcgtgaaaatggtcatactacccaaagtaatttatagattcaatgccatccccatcaagctaccaatgactttcttcatagaattggaaaaaactattttaaagttcatatggaaccaaaaaagagcccgcattgccaagtcaatcttaagccaaaagaacaaaggtggaggcatcacgctacctgacttcaaactatactacaaggctatagtaaccaaaacagcaatggtactggtaccaaaacagagatatagaccaatggaacagaacagagccctcagaaataataccacacatatgcaaccatctgatctttgacaaacctgacaaaaacaagaaatggggaaaggattccctatttaataaatgatgctgggaaaactggctagccatatgtagaaagctgaaactggatcccttccttacaccttatacaaaaattaattcaagatggattaaagacgtaaatggtagacctaaaaccataaaaaaccctagaagaaaacctaggcagtaccattcagcacataggcatgggcaaggacttcatgtctaaaacaccaaaagcaatggcaacaraagccaaaattgacaaatgggatctaattaaactcaagagcttctgcacagcaaaagaaactaccatcagagtgaacaggcaacctacagaatgggagaacatttttgcaatctgctcatctgacaaagggctaatatccagaatctacaaagaactcaaataaatttacaagaaaaaaacaaacaacccaatcaacacgtgggcaaaggatatgaacagacacttctcaaaagaagacatttatgcagccaaaagacacatgaaaaaatgctcatcatcactggccatcagagaaatgcagatcaaaaccacaatgagataccatctcataccagttagaatggcgatcattaaaaagtcaggagacaacaggtgctggagaggatgtggagaaataggaacacttttacactgttggtgggatgtaaactagttcaaccattgtggaagacagtgtggcgatagctcagggatctagaactagaaataccatttgacccagccatcccattactgggtatatacccaaaggattataaattatgctgctacaaagacacatgcacaggtatgtttgttgtgacactattcacaatagcaaagacttggaaccaacccaaagtccatcaatgatagactggattaagaaaatgtggcagatatacaccatggaatactatgctgccataaaaaakgatgagttcatgtcctttgtagggacatggatgaagctggaaaccatcattctcagcaaactatcgcagggacaaaaaaccaaacaccgcatgttctcactcataggtgggaattgaacaatgagaacacttggacacaggaaggggaacatcatacactggggcctgttgtggggtgggggtaggggggagggatagcattaggagatatacctaatgtaaatgatgagttaatgggtgcagcacaccaacatggcacatgtatacctatgtagcaaacctgcacgttgtgcacatgtaccctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaaaaaaaatgagggggatggaggggaagttggagggatagaggggaggtgggaaaaaaagaggcctggagctggtgttaggaggccagggtctaaaccccacttgaaaacctacctggtggatgacatgcacagactctctgggcctcagtttcccattcacatataagatggggaggcctttatccacttccctaagagggttgttgtgacaattcagagcagtgttagagtccaaagtcgggtgaatgcccctggggagtgtacaggaccatcctttatagtgtgagtagaaagtcttagcatttttattttttactcaacaagaaattaggctttacaaatatttgatgtatggatggaccatgacatccacaatcagctgcgtgttctgggcatgtcctcaaagaaagaagggactttgcaaacgggaaggggttgggagctctatcctcattcattcccttgcagcctttgtgatgttkgattgcaatttgccacttctggtgaggcgggtacgcagaatacattatccagcttaaactcaacaaaccctgtttcaacaaactgaagaagtggcttaaaaagttttcatgaattaaaagctaattaaaatctataatgaacaatatccacataaaccaaaaaatggcagagttaacacttcactgggaagaagtttttgttgtcgtcgttgttgaatcagccccagtaagatgtgaaaaaaaaaacagactaatgatatctgacaagaagtcggcccaagaagttcaaaattatcaaggtcaggtgcagtggctcatgcttgtaatcccagctctttgggaggccaaggtgggaggatcacttgaggccaggaatttgcaaccagcctgggcaatatagtgagattccatctctactaaaaatcaaacagttcggtggctcacgcctgtaatcccagcactttgggaggccaatgagggcggatcacctgargtcgggagttcgagaccagaccgaccaacgtggagaaaccccatctctactaaaaatacaaaatttgccgggcgtggtggcgcatgcttgtaatcccagctactcaggaggctgaggcaggagactcgcttgaacccgggaggtggaggttgcggtgagccgagatcgcgccattgcactccagcctgggcaacaggaatgaaactcggtctcaaaaaaaaaaaaaaaaaaaaaaaaatcgaacaattagctggrtgcttgtagtctcagctactcaggaggctaaagaggatcacctgagcccaggactttggtgctgcagtgagctatgatggcactaccgcactctaacctgggccacagagtgagcccctgtctcaaaaaaaaaaaaaaaaaaaaaaagaagaagactttttgaattaaagaaagatttacatctcctctcattaatagcactattgatttttatttgatttaacacattatttcattgttattacaaattatgtgttttaaatgcctattttgatgyataattctataatgtacacttagttcagtagtacatgtgtattacttgtatttatcatgtgtgaatatatatatatacacacatggtatgtgctcaaaatattttacagattagagtatgtgaaaaaaatttgaagaccactctgcataataaatgtgcaggggctgrcccatgagacatgttcagtaaatgcttgtttccatcctctttctccctggaaataaagtcgatagtgtgtgtgtggaccttgcttattaaaggaaagtggctgatttgatttctggaacaaggtgcatctcaaactagctggcagcactacctcggcctggccccatcccagctgttcacaccgagttccagacatttgtaggagcccggacgaggccagctggctgcctatcagtggccttcttctgtcagcactacacagttgtcacggctcacatccaaccgccagacagccaagaaggagacgccaagatttaaatctgcagttcctgacctccgcaaccacacccgattctttggttggtcctagacaaaaacaacggttttgcagatttgggttctctttctcaaactgccttttgatgatttatttgtgagatatgattgctcctcttgcaaatcagagctggttgcagtagctaactaacatttattgagcgagtagtatacccaggcttcagctaagtgctttctggaattatttaattttcacagcaaccatgtagagtaagttctgccactggcaccactttacagataagcgaatggagacttagaaaggttaagtaattttactagaggaacataaactaacagtgaaagtgagaaatctcagagtctcattggtctgacagctatgtaaggaactgaggggatgtaccattgcaaatcgtcaaaatggaaataccccaratgcaatgcaggactctggatgcgattctggaacaaagaaagaacacttgtgggggaaaaaaaatagtgcaacccagagtctttatttaacagtattgtatcaatgttaatttcttagttttgacaaatgcatcctggttatgtaagatgttaggattatgggaagctgggtaatgratagatggagagtttctgcactatgtctgtactgtttttgtaaatgtacaatgattccaaaataaaaggtgtatttaagaaacagaaatgccaagtgtatatgtgtgagtacacacgtgctcgcacatgtgcatgtgtacagttgtgcatatgtaagtctttgtgcatatgtaagtgccccttgctgcacaccccctgctgttctgtgtgtgctgctccactcaagcccctgggacttacatggatgtcagcgagaaggaagcctacacaactcacatgtgacatgcccgccatgctctcgtcatacctcacctgtgctgtagaacccctgggtcacaggtggcagtcttgttcccccataacaaatgccagaaaatgatgtgtgtgtgtgtgtgtgtgtgtgtgtgtgtgtgcatgtgcacacacgcatgcacgcacacacgctctggtaggggggtttcaggaagtcattcgtgaagatgcagtgtagcatccagaataaaataaccaatttacaccttaaacactcttctccagtaaggccactacagctgcctctgcttactaagtgcatttgaagagtcctctgctttatccgtactctatcctcctgaaaagaggcactgacctgaaagggaagcccaggagcttctaggcccagacttttgctttgtttctcaccatgtgctgtgtcaaaactgagagaatattttgatcaccttttagctaagagctatctcctgggcagcagcttaaggctagagtaaggacatttcacagtttaagagagagcagtcactccgccaaatggctctgaggtggccacaaagtgcttgacttgcaaaaaattgctccattaactagattcagggattttcaggatttatgggctaggctgtgctaatattactgtggtgcttctcagtataattgctagaggcctccagtgagcagaggaattgtgtgttcagtctgtcctgggtgacccttactgcgtagtcctagggagacaaagaaaacccactcaatccaggaggctacagaaatgatgtttgtggagatctcagtgggtatctaatctgtaacctcagggggagaactctagctggtctcagtctttgctggaaacagaacttactggatgtgtgtgtttactcactcattcatttatttgtttatttatttactgtgacagggtcttgctatgttatccaggctattcttgaactcctgagctcaagtgatcctcccacctcatcttccaaagtagctgagattacaggtgcatgctaccacacccagccatcattcatttacttattgagtgtctaccatgcaccagatgcccaggttaagcataaaggatatagagcaggacaatcaaaaagtctcagattcagaaggaggagatggataaaaaccagcaagatctaaagtagataatttgattatgataagcacaaataagcagagaatacattgatgtgatacagagggccatgtggggggcagtgtgattcctttagattgggtgaatcagggtgatggcttttcagttgacattggaagaatgaggaggaaggaggaagaagtggcagccgggtaggacagcaggtcttctctgtcccccsagttcttctgatgtcctgcacagaaacctgaggggtagagtagcaaaggagaaatccaagctcaggctgggaaagaagctcatggcaccaaggttagggcttgtgataacagggacctgcttcaagagaaagggaggtgggtggcaccattggtctcatggctgccacccacataattctaaaggtctcccaatgggagaacagccaccctggtaagtgtccagcatcatacaaggagtctctgcccattgtgrctcttgcttgagcccccacacttagccctcaccaagctgtgtgatttaggattcaggtgttagaacggagaaggcaccaggcctactgcaccatatcaatgaagcctttgctttggggaaaacagagctgggtacaaataccagtgccacccattcttccctccatgctctggacattcaacccatctgagccttaatcccttcatctgcaaagtaaggaccatgcagtcttcctggtagtgttgtaaggctcagatagaataaccagacagttccaggtgcatatggcactcagtgagaatccacttgctttatcctccctcactcccttccttcctccaggaataaagagtacactagttgaagaatatttctttgccttccttctttagcagctccaatcccagcctaacagcacaatgagcatcagatgtgcttttttgatgtttgaaatttatagtctctgttgaatgttggccaggacagcacttcgtcatttgaacaatttccattttccacaagctctctgtgattgatgacctaaccaggcacatggcattccgttccaccagsaatgtggccagtggggagatggctatgtcagtaacacctgtttgtggtagaccaacaatggcgccctaaaagatatatccgcatcaaatccctgggacctatgtgtgtgaccttatttggaagaggggtttttttttgcagatgcaattaggaatcttgagatgcagagaacatcctgtgctatccaggtgggccttaaatgcaatgacaactgtcttcataagagacgtatagggagmtctgacagatagaaggggagaaggcaatgcgatcaccactaggtagaggttagagggatgcacccctaagtcagggaatgccagcagctrccagaagcttaaagaggcaaaggatgaattgtcccctagagcctccaaagggagtgtggcactgcttatgccttggctttggacttctggcctccagaactgtgagagaataaatatctgttgttttcgatgggcgtgatggctcacgcctgtaatcccagcaccttgggaggccaaggtgggcagatcacaatgtcaggagatcgagaccatcctggcgaacacagtgaaaccccgtctctactaaaaawacaaaaaagtagctggccgtggtggcgggcgcctgtagtcccagccactcgggaggctgaggcaggagaatggcgtgaacccaggaggcagagcttgcagtgagccgagatcgcaccactgccctccagcctgggcaagagtgcaagactccatctcaaaaaaaaaaaaaaaatctattgttttaagccaaccagttcgtggttatttgtgtagcagccctagaaatgaagacagcctgcgagcaccttgccccacctggctgtaggtgacttttggtgccaccatttttgactcttgtggataaagagcagactatattctttttataagtaagtccaccttttacagaaaaattaatagccaggatcatggttttagaactcatagaatacactcctctcatcctctcattctttcccccacccattggcttataaacttgttcctatgaaataagtcagctgagttgagtttgtaaatgcatcttgaataaatgtgttgggtggggtcacaaacatgcagacacctgctggtgagtgttactgacctgcactctgaaaggcccctatattgatgatacttcttaatctcctatggctcttcttcagccctgggagcaggggagtgcagacttttgttcaacccctttcacagatgtgcacactgaagtcccagtgtgtccagtgacttgcycaaggtcatcagcactgtctggtggagctgggactcgaacccagtcctcctgctctcagctgtgggaaatggagacagcagttgccctggaagatgtttcctgtgctgcgtgtttgtggttgtctcaggatttgtgagacttactgttttcttgtgtcccctgtccctgtgacttatctttgtgcccactcagccatcaccacttccaacacacacccacacctgtggagagaatgcagcctcctagagctcatgtcatggcaggactgagggmagtagtcagttcttggtgctctctaatagggctctgaattgcagcctgggccgtgcccattcatttatgtattgtctatagctgcttctgtgttacaagaattgacagagactgggtgtggtcgctcacacctgtaatcccagcactttgggaggctaagacagaaggatcgcttgagcccaggagtttgagatgaacctgggcaacatgatgataccccatctctacaaaaaaaaaaaaaaaattagttgggtgttgtgatggaggctgagatgggatgactgcctgagcccatggggtcgaggctgcaatgagctatgattgtgccactgtctcaaaaaaaaaaaaaaatgttgacagaacaagttgattcaattatagacttgagtagttgtaacggagactataaagcctaaaatatttatagtgttaactttgataggacaagtttgccagctcctgcactagaggataaagattaacaggattgactccacatagaggagaggagaggaaggggcaaggatggaagcaaggagggagaagggktagagagaaagaaagagggaggggggtcactcagagacttcacaaagtaygttatttcctaaaaactgtaatgcccagtatctagtgattacctgtggcactgtcagccttctgcctgggaacaggaatcttgcaaagatcaaatrcagggcccagagccccaggactctgcattggcattcgtcagtaagttttgaaggaggcagacatctcaaaaccatcctaagcataaggcacccagctggtgatttgaagataggcatcttccccattactagttggcctcactttaaaaaatgttgtttcttggatagcatttttctttcacaagttggtttgctttcacatgtcaaaaaacaaaaccagggcygggcgcggtagctcacacctgtaatcccagcactttgggaggcgaaggtgggtggatcatctggggtcaggggtttgacaccagcctggccaacatggtgaaactccgtctctactaaaaaaaagaaaatacaaaaattagccaggcatggtggcgtgcacctgtaatcccagctactcaggaggctgaggcaggagaatcacttgaacccgggaggcgaaggttgcagtgaaccaagattgtgccattgcactccagcctgggcaacaagtgtgaaactctgtctcaaaaaacaaaaaacaaaaagcaaaaacaaataaacggaaagagagagagaggagagagagagagaaacacataccatttgccatatttgtggtttctcattcttgcgctatttttttaaacctttcattacattaggcctttatcagatattagcactggttcttcagttttccccctgatcaggaacttccctgaaataaatgctggtaagatcgtggaaagttcccaggagaaggatagaacaggtgtaccccagggaggctgagccagtacagagagacctatgggtttcacgggccctcagtagaactgatttcctctccttgtctcaggttgtcatcagccactgagcaagaccgaataagggatctcgtgaggctttggagatggatgcaggatctgttgcctgcgattcaaagctggtggaggacttgcttaggtcatgttaattagtttttctcagctctcaccaggtgtcattcatggaggttgcataaaagaaactcatacccaggkatgagctttttcttaaatattacctttctgaattttgaaatttagtgtagcattgagacatttaaacacatttttgaagcacaaaacttatttatcctagttcaaagccagatttggtttgacctgtcttggtggygttttctgtggttctgagatccaacccccaacttcgtcccttttgacctagtttatcacccatgtccttgggttgaaaatagtagtgtaatcstaagagaaggggcctgaaaggaagggaagagaaatcagatgtcagctggtgaggatgagaaatactgcaacaagggagcagcattgacccttgagagctacatgctaggtagagtcaagctctacttgccctaagtcaaaaatatcattgacttgtggctaaagcccagactttgaagagcaaagaaagcaaggatttaactgcaaaaatagaaaagtggctgacccaatgctgaggcttttaacaaaatttaccaaatagtttatttcagactgagaaagaaagagctcaaacaagcttaagcagcagcaaatgctatcagcctggaccatgagattgcatgtgccctgcagtgatcttccaccttgactgacattaaaactacctggtagtggccgggygtggtggctcacacctgtaatcccagcactttaggaggccgaggcgggcggatcacgaggtcaggagatcaagaccatcctggctaacacggtgaaaccccatctctactgaaaatacaaaaaattagccaggcatggtggcgggcacctgtagtcccagctgcttgggaggatgaggcaggagaatggcatgaacccgggaggcagagcttgcagtgagccgagatagcgccactgcactccagcctgggcaacagagsgagactccgtctcaamaacaacaacaacaacaacaacaacaacaamaamaaaaaaaaaacactacctggtagtgtttacagccttgagtgcccagaccaataagatcaaaatctctgaaggtgaggcctgggcttggtgctttttgatgatcctcaggtgatcttaatggtcttccagggttgagcactgtggggaaaattgaggccaagatgtggaggcatctaactggctcktgcatgttaagaactggatgagatgggaagccagacattagaaataatggggtcagggcaccacttacatggtattaatagccagaggtcttgaatcttcctccagactacagtgaagagagatacacatgttatctacctggtgatagataccaaagggaagcaaagtaccacactgaagcaaagtaccatggaaggactgctccccacttttgatgcatgataaagaccaacctgcctgcakgaagatgatggtgcacttctcctgaacttcaccatcatgatcacagtcaaagccagtgatgatggagtataatcacaccagtaaatgaagttcccctgctgtcttctgactcacttctaagtggcctggaccctggtggttaagaaaagtaaacccccaaagcagtcagtcattgtcggtttgctaacttgagcatcctgaaattaaaggactaagtactttaactgggtcacctctattagtgggtaaaaagctgtgtggtctttgttcacttccttaaaatgctgctatacgtgatggcaagcaacagaactagccacgagaaagcaacatggaaaccactgaagtcaagacttaatcctacctggttccccatcaataggtaaaacaaagtggttctgagcacaaactctgaagccagatgatcagcttttaaaaaaaaaataattaaagaatatttatttatttatattttattttagattcaggtggtacatgtgcagatttgttacatgagtatattgtgtgatgctgaggtttaggcatctaataatcctgtcacccaagccatgaacatagtacctgataggtagtttttcaacccttgatcccatcccttcctccctccttttggaatgcccagtgtctgttgttcccacctttgtgtctgtgtgtacccaatgtttagctcccacttacaagtccatgttgctgcaaagaacatgatttcattcttttttatggctgtgtagtattccatggtgtatatgtaccacattttctttatccaatacactgttgatgggcacccggttgatttcatgtctttgttcctgtgaatagtgctgtgatgaacatacgagtacatgcccttttgatagtatgacttatcctttgggtatatatcagtaataggattgcagagtccagtggcaattctgttttcagttctttgagaaatctccaaactactttccacagggcctgaactaatttgcactcccaaaaacagagtataaatgttcccttttctctgcaacctcaccgacatctgttgttttttgacgttttaatagtagccattctgactggagtgagttggtatctcattgtggttttggtttgcatctctctgatgaatagtggtgtagagcattttttcatatgtttgttggctgcttgtatgtcttttgaaaagtgtctgttcatgtcccttgctcactttttaatggggttgttttttacttgtcaatttgtttcagttcctataggttctggatattagtcttttgtcagatgcatggtttgcagatattttctcccattctgtaggttgtctgtttactctgttggtagtttccttttgctgtgcaaaagccctttggtttaattaggtcccagttgccagacsgacagctttgaattctggtcttaacacttcataactgggggatctaggggcaagttacctaacctctctcagcctcagtgtcctcatctgtaatggagggataatagaagcttccccccagggttatagtgagggttgatgaggtagttcatttaaagcactcagaactgcgcgtggcacctgtaaacactcccacccccagtaccttttcacaagtactattaggatgatgctgtttagcagcaattatcagcacctctcatctcaagttatattgctagtgacaaaacctttggcatttcagtgtatagctttccaatcttttccataactgtattttttcttataaaagtgagattatactgagcatactctttgctttttaaactgactatattgagaatatctttctatttcatgtaatctacagcttcatttgcaatgactgcataatggtgcagatatatcatagattatttaaccaaacacctgtggtttaatacttaagtctctctcttttttaaaagcaatgctgcagtaaatatcattaagtaaaagcactgctcattggcataatttcccctttagaataaattcctagaagtgaaatgtgttgttcaaatcgcatataaacttgaaagtgtttgctattctatatgactgccaaattatcctctagaaagattctaccaccaccagcagggaataaaaagtcagtttcccctcactatacttgacactgggtattacagtttttaaactgtaatcttttgtatttgttcttgacctaaagctgagctctgctgtttggggcttggcttctctgaacttggtgctgattcttgctttaactggagcttcctactggagcatcctaggtgggctctcactggctcaaacaaccctatgaggctcttcttagtcttctaggactagagcagggctcagccaagcacatggtgctggcaggacacttggagctgtccctataccagcagcaatcttttgtcttgcttatttaattaccttatcctaaagtacgtstttactagaaatttgctgtcctcagtgagaagcagtacctttcccttgttccctgctgaaccaccagggtcactaccagcagatcagagccacttccctgtccctgggggcatcgtcttagactttggtcaccaccaaagaggagacataagaagaagggcaggaagaggtagcattgagcaagagctctggatttgccatcatcagctgaggattctgaattaggaaacatatctatttaggtttaaactacaaaatatgcaagggttcctattccgagcctctcagaaacatccctctggccacaggcaactgtcactggtgatggttattctctcagaagatgctgaggatcagggtgtctaaggagtagctttgctttaatctgagcttggtatattacattttccatgttagcctacctaatagggtgggttcacatagaaatactagaaaacacagaaggatataaagagcaaagatgaaagcattccaaatcctaccatctagatacaacctatgttgatatttagcatgtatgcasaggatagatgctatcctgtagcatgatcatttatatgcatgtgcgtacacatgcatttactttttataaaaatgatataatactgaacatgctattctgtagtcagtttttaaaagaatgtatctttttttttttttttttttttttttttagatggagtcttgctctatcatcaggctggagtgcagtggcacaatctcggctcactgcaacttctgcctcccaggttcaagtgattcccctacctcagcctcctgagtagctgggactacaggtgtgtgccaccacgcctggctaattttttgcattttagtagggacagggtttcacaggttggtaaggatggtcttcatctccagaccttgtgatctgcccgcctcggccccccaaagtactgggattacaggcgtgagccaccatgcctggtgcccccccctttttttggggtgggggaaacagggtctcactgtgtccccaggctggagtgcagtggcacaatctcagctcactgcaacctccgcttcccaggcttaagcaatccttccatttcagcctcctgagtagttgggattacaggcatgtgctaccatgactggctaatttttgcattttttgtagagatggggtttcaccatgttgcccaggctggtctcgaactcctgagctcaagcaatctgcccgtcttggcctcccaaagtactgggattacaggcatgagccactgctcccagccttaaaagaatttatctttaatggctgtgttttatttatacattttcagtcattcattatcaataaatactgattcaggcccagtatgtgttaggcatgattctaggcaagagagagaaaccatgaatgagagacatggtctctgcccttggggagggtgtaatgaagttcgtcagttttgtgctttgtggtttctttctatgcgttatgtttttaaagtcctcttccatcctaaagtcagacaatcactatattttctcatgttttcactttttacattgcctgagtccatctagaaattgttttggtggatgaaaaattttctacttttaaaccattggaggacagcaatgaccacaaaaggattaaatcctctttccttatagacaagtgggcacaacttggctatgcagtaattctaacatcagcagtgcaaagaagggaagtacagtgttgattcttcatgggagactgatggaattataatagacttctgttcttaaggtagaaaattatcatttttttaacctgaaaakatagagtaatagtctatgataaggacaaattaccccaatatgtttttaaaacattgcaattattaacaaagtggtagtttctttcatttaaaacccccttgggccctaaagatatagctaacaagaggaaaaactgtcaaaactcttattaggtggttgagtttattttctgctcacaattgtatcatttaaaaccctgagaaactgttttttggagagcaatttgtccctattagagttttatgtgttcaaatccttgacttagcagttctgctggtagaaatccaccctatgtatggaatcacaaaagtacgtctaagatgaacatagaggaagattcattgcagtcccgtctataattgcaaacaaagcactgagaaccacctaaattatctattagcagcagactgctaaagtaagttaagctacatctgtgaatcgccatgccgtagttgcaaagaatgtggtgggattccatgtgctgaatgaaatagtaaaatctctaagatacatcacgaagtgaagaaagtaagctgaagggcaggtcttttgtgttaagaataaaagaccccaacttatgttggtgtatccattttttcctgtaggatgcataaaggactaataggaattgttgcctgaaggaacaaagctggtagggatgaggtgaagagaaagtcaaatgttcattttattcctgtgtggatggtgtgaatttttctaccctgcatgtttattacttttatttatgttttgtaatgcttactccatttatctaggcagggagattatagacaattggtgtttccttctttatacttttctatattaaaaaatgaatatagatcagaaatgttcaccagatactggcatctaagaaacaaacaaaaacatgatttgtcaaagtcagaaaaggagtgtatgtctctgtttggaattatgctaatttcttggagtttgcgttcctttgttgtcatcagaatgctgcacattgtgttctctttctatttttgtgcacactatcttgttttgtatttccaaccacgacagctatgttcagttgtgccccatcccctcccctgttctgtggcctgcggtgctgagaactgcragcagccaatgggactgctgcttactgtgagrtccrtgcagtgtccacccccgcttcctgccctgagactgcctccaggcctggcacgtcttcctaagacaggcctatcaacccagtggatccttctgccccttcctcctcctgtcctccaactttagggagccatattctgatatccagagatcctggatttagagcatctcctccattcttggtaaattgagaaccttcccaactgctgcctcatctgcagtagttcctttcagatgaaaagttaaaatgggagagaaatattttgcatttgctcttttcattagactattcgatttcyatgtaaatgtcttctacagggattgaaagaaaygaatatattggttcaccagacattgctgaaggttccaacacagccttgacctatttttgtttgaaattgagaaatgctcacaaatgtaagaggcctccttttttggagattggagggatttgacatcaagatgttttgcattttcaacagctcatttgccctggatggcttttggcagataaatgtggaggtggcagtgtaataggtttcatgtgtccagagtggaattcacccagagccaaacaaaagctagtagctctgaacatgtctcttttcatggtaaagtactctggagtgagactgtttaagtttcaacccctgtttggccacttcttagctcaagggcacttcccttacagtagctaagtttaggttgtttcatccataaaatggaagattttaaagtatctacctcaaagtgtgatgaggattaagtgaaaaactgcggggcaattcttactataatgcctgacatagcaaggcatcaataaactcagttgccattattattcttaccattatggtttataccactaccatcattgggattattaggttcaaccactacacaactgaattgttgttgcatgagtaaattgcagttgtttagacaaaatcctaagccaaaaacttcgtgctaggtagaaaggaagcaccttcatttattaagtccctgcactctaccaggtgatgtgttagttccatctttgctgtatctcatttcaatcctgcagtagcattttgcaggtagttctatttcagtatttcagacggagttccaattgtttgatgcttactagccatgtgaccctgtctctttatcttcctgtgcctcagttttctcctctgtaaaatggggataatgatagtacctaactcattaggttgttgtgaagattaaacatgttaaatcacacaaaacagtgcctggcacacagtgaccactatgtaaatgtttgctagcattactttataactcaggaagggcacatgtgacagtctggaacgtgtgaagtcgttgttctccttagcactgtggaatgttagtgatgctggaggaaacttagagctaagctggcccaacctactcatttcacaggctggggatccaaggcccagaaacaataagggacttgtctaagtcactcagggagttcgtggcagagcccctacctgatacgagatctcctgactctgctcacgagacttcatggtgggaataaggcaacacacggagagggatgagatggagatcacattcttcgggagagtttgattctgttattcctgccatttgggactttttcagagtcctctaccattctgcctacctgtacagaaagtgctggatttttccaccacaaggggcttatcaatgtggtgtcataaagcgggtcttactttctcatcagagcccrtatcagaccacttcccttcttggtctttagaggaaaccaaagtgaagcactcctagcaaagaatttgatgttatgaccatcaaagcaaaagtatagctctatggttaaataattacttaaagggtcacaccgtgggcagaccttaaaaaacagacttaagatataacccatatgggctataaagtatctataaaggaccctaaatggaaactctgctgtgttgtgcatttgacttggcactaataggccagatatattaactgttgggtgaaattaatgataatattkcatctaaattctatgggatgtttcttaaggttttgggtgttaaattaccccttctaaaatccagtattgaggctcgaactaatcaatgtcttctttttcttttaaaaattctcttgaccatattgtttctattacaaatgaaacatgaaggtagaaagtagaataataagttacaagaagtggagaagggagtgtgtgtagtggaggatgagagaggttggttaatgggtacaattatacagttaggtagaaggaataagatctaaggttggatagcacagtaaggtgactttagttaacaacaatatattttagattttaacatagctggaagagaggactaaaaatgttcccaacacaaagaaatgataaatacacgagatggtggatgtcctraacaccctggttattatacatcctatgcatgtaacaaaatattacaggtacccaacaaatgtgtacaaatatcatatgtcaataaaacaattaaaagtaaataactacagaaaacaatacaaagctggcagttccttcttttacagatagatggcaagctcaagtccaaataatcagttgaagaaaagagaagttatgtagatggaaatgctggtccaaactaagggatgaggaataaatagagttgtggaattatccacttcacctggtgatgttgcgggttaaatgggtacatggctaggcagaacaatgtagaaaacctaccttacttgttcttctgaccaagccttttaaggctgtcatttaaaatggctctgagttctgtttcttagttttgtaggatcagaaaatcacatgccaacttagctttcagctacttatctacaaacccaagtgtctatttatttttcagtggatggacactgcaggggtcttagcaagtaccatctctccatttagctaactacataggaagcctgaatagaaatcaggattatgattggtgatcttgaagacagagccaggagagtgagttttaatatctgatggtgttgagatgagataactgatctcgaacagggatgtgtctgctgagcaaactcagcattacttgttagctggacaggcgattggacaaagctgagtgagcacctcttcaattttttttatgcttgattactcaggttttcagtttttagacagactatttttcttttttttcccctcagatgtataaatagcattgaatctgcagtagtgttagaaaggtaattataacccaaccatgyctgagatgacattgtgatttcttaatagaaaaagcttgttgggtccccacttgcaagttgatttttcataatttaattctcaaaatgtcaccttatttcttggtgtaacccagataaaacctaggtatcctggcaatccagtttcagcatgaagttatattcaaaggaacacaggctagttggccaaagtaatttcagtatccttactggaatcttctggagaacatcagaggggattcattttataagccacagtaaaatatctcaagattctcttttcctgatttcctggccttaatatctcagccttttcattttaaactcttgaactttaaactgtctctgacccctttcagtgctttacttcttcatctcttctttccttttctcgatcatttttccccctaaatagcatccccacccattccctttccaagtgcaactatataaaacagtctgtttctcgcagtttttcagtactttacctctttctctgattcttcatttcaaaagcctaggaatcctctggcaaaaagtcacttaaaaggtttggggcaaggrmacaagattccctttagctcacatggaaggaagtcaaagctgaattatcttcatctagcaatagaaagaataaagattgcaacgtttacaatttaatatattttctttaccctcctcttgtctaaattctgtgatctcatgatggcaagagggccttgagtaggtcttctggtcccttcccactgctgtgccctggggcgcgaggtatcagcgcaagctagaatgggggttcagtggaggaaaggaaacaccctatttctgcttctgactaccttccctgcttagcctctttccctgtctccctgtttctcacacactcagttgggacacccaccttgtccacagccacagcctggcatctcctagtgctccagttgcagcacagtcagcaggagagaagagggagtctcaaggagcaaaaaggtggaaataggctttcctaacaacaggtgcttgccatgtctgtcttctcatcatatttattgaacagaatgtgcttcattctctacgggtgctctttaacaatagtttacgtgttatgttacgaacatgttatgattataacatgttctatcatgttataatccttccagaaaatacttgccaggaaaatatataatttatagaaagtgaatgaaagtggcttgttagccttcccagatagtggaggaatctggaagtctttctaatggattgagatcacgtcattccagatgtctcttgaggcacactgccccgaatggttgctactgtcagctcattatgcttttccctggaatttccacttcccccgcctttctccccagaataagctttccatgattctttcccagaattagccttttcaactctttcctcatatgcatagcaacagtaatttatttcatgtgggttaatgtctttagcattaggacacttctggttttatggaytgatggccaatgtgtttttaataatgtattttgcttctattgaagtcatgagtacaaattcgtaattcatttgaatgagggatatggacaaacaggaacacaagtggaagagagaaaaaagaggatagtacactcagagatactcagtaagcataaattacatgtattcatcatacaatattctaggctttagagatgtgtcagccaagatccttgtcctcaaggagcccatagtttgttagagagagaagatgtgtaaatagttaagtgtataaagtgctacagtgcttgaggtctaatgtagaaaaatccacagcctgtggggagggaagagaaaggagggagtgatgcaatctatttggagggaacagaaaaatcttctgtatttgtcagtactctttgagttgtaagtggtagaaacatcactcaaactagcttaagaaaatgggagatttattagtgtatataatttaggaagcctggggatggttctggcttcatgcatgactagatctgggactcaaacaatgtagtaggacccttttttctctttcaactctgcctccctctgcatgttgactttattttcttcaatgtagatgcatttcttttatgtgacttggaaaaattgctactcagaagtacatcatctcagcttaatcctagtggtatgttttttcacttctctcctggtatccgtgtgtctgtccctagaaatgtctctaactggtgtttctcagttcacttagctatcccttggatcaatagctattgcaaagaaacgaggtagcatgattggcctaacctggctcacaaacaagtcctagtggcaggaatgagctaaccatgactggcatttccaccagagccatttacagtgagggtagatgtgtttccccaaaggaaagaagactaggcagatcaaaattgacagatgttcattaaagcttcatggatatttaaactgtgccatcatagatgaattgttttttgtcaaatgaagcagcagtgcacatcgattattgttagaggaagcaataagaacaaaactaagaggacatgaaccagccgggaagatcaggagwctgcaagtagtctttgaggttggatcatggtagggggccatggcttgagatgaagctgtgaaatagacaggagcctcactggctatgctagggaacctgctctttgcactgtaggcaatggggagacatccttggttttaggcaagggtcggaggtggtcagatttccattttagaatatcactctggcagcagtgtggagattgagttggagaagccaagaatggatgcagggagactaataaggaaaccactacagtaatccagctggagataagttctgtaatgtgctaaagatgctaatatggaatagtctccatgtccaggtaggagatgaaggaaggagggttaaggcaatactcaaggttatagtggggaagcaaaagatgtggaaactggccagcagaatcaacatgacttggtctttcaagaaagtaagtgtctaggatgacttagatttctgacttaagtagtgtcatttgctgagatgaaacatagaagaaggaacaggtgtgaaggtagagggtgggggattgcttgagatggtgactgcatgtgtttgagtttgggggagtgactatgaatagttggcagttcagtatagggatctgcagctcaaaggagaggtagagttgtagagtggatgagaatgaaggcccgaagagttactggttttgtcctggttaagggaaggagaaatctggaaaccagtgggctatcccggtgaggagcacagctcagacctcagccatcaaacaagtrtcagaaactgcaagtgagttccttaatggtgtcctatgcaaacttgttgtcgtttgactcatatctaattctgagcgtaggctggttgcctcttgtccacctagaagtgactttaagaccatcactatgggctgggttcggaggctaacacctataattccagcactttgggagactgaggtgggtggatcacctgaggtcaggaatttgagaccagcctggccaacatggcaaaaccccatctctagtaaaaatacaaatattagccaagcgtggtgacacacacctgtaatcccagctactcgggaggctgacacagggaaattgcttgaactcaggaagcagaggttgcagtgagctgagactgtgacaacagactgagactctgtctcaaaaaaaaaaaaaaattcactgtgaaagggagctcagctagtcaaagaatcctgaaatagctgtggatgcacagtgggtccttgtcatggggccaggcccagggtcatcagttagaatgcagttgtaaacatgctaatgctgctgcctggttgtatgtgctaacaactgcttagttccaaattctaacccaataaggagtttcctcaggggaaatgtatgactacagcacaaatgggctcagccttactgctttcccactgttaccccttcctgcaccagcgctcttctggtccgtgtgactaaaagccaaaacaccactttgcctaaccccccagatcctattagttttgagtctcatcaattctgtttcttccatttgtccttctctttccattctgattggtacagctctaagctaggaggcttgttagttcatccatccttactgcacaaccaggtgaatggaacatcctcctaaggcacttaaatgatatttgaatccacaggtcagcaaactaggacccgtgggccaaatctggcccactacctgtgtttgcaaataaagttttattagaacacagccacactcattcatttaaatattgtccaggactgtttttgaactacaatggtagcattcagtagttgcgacagagactgtatgtcccacaaaatctaaaatatttacttttgttttataggaaaagtgtatcagcccctattaatccaccttatgtatgaatgccagattaatgttcctaaaatgccatttcaccatatcattctgtagcttagaaccctgcaatgacattgcattgtccatgcaataaaatctaaacttcatggccctccatggtatagtcctagccaatctgttgagtcattgatctctgttcctaaaggcaagccctacaaccagttagattttcctcctcattgtccctggaatatgcagtgcatttctacccttgttcacctagttccttttgcttggaatgtattgcccatttgtatctacctaaatcctactcattccttttttttttttttttttttttttttgagacagagtctcactctgtcgcccaggctggagtgcagtggtgtgatcttggctcatggcaacctctacccactgggttcaagtgattctcctgccttagcctcccaagtatctgggattacaggcatgtaccaccacacctggccaatttttatatttttagtatagatggggtttcgccatgttggctaggctagtctcaaactcgtgacctcgggtgatccacccacctcagcctcccaaagtgctgggattacaggtatgagccactgtgtgcccggccctaaatcctacccattcttaaaggactaacatgaactctacatccttcatgaccatgtcagttacagtgatcaccaatgagcctgctgcttgagcatgtaaaggtccactgcccatactgcctggtaagttttcttctgctcagagaatggttcaccaatatgatgatgggcaactctggagtgaggactttctgatggaacaaagtcacagctgtgggaaagcctgggaatggtttggaaatgacaagacatgtaatgagaacacatgacactcaattaatatttgtggaaatcttgagtcatcagcctctcatatctatgacatacatcttggttctgtatttaaatgtaggacaactacatatcttgatagccagtgggaatgactgacaaagtccagtaagtctactcttgagagattctagaatgtagagatagcagcyggaccaggaagccctagctttatcatgtgccatctctgagatgstggatgtgggctgttcccactgtgcctcacttttcccatccactgtcatatattttatggtcttgcacacactctgggattaagtaacatcaattatgcaccattgattggagttctttggtaaatggtactacattcctaaaatattcatgtgtcttactttgtcagggagattatatccgtgacttagatatcatattctagtggcttaagattatgagctaatattttgtaaggtctgggcattgcacagaaaaccttggttgtaatacacattattattacattgatttgaatagcaatggtacartcatagccccggaaacatagcgactacataaaataaaagcttccgttaacactgagcacagcagccaggcttccgcattgttgttgtccctaggatttggctgttgtattgtcaaatgccattatgtcttatctaataagtttctccctgcatatgtgagtaaacgaaaatgctccagtatagtaaatgtctcagcaaaccactcctgtacgctttggaaacagaacattaacaaggaaactatcatgagagcagacctttctgttctcatgaatcacattcatatgatgtttattgtccacattggagaagtatagagaagaaaaatatgaagggtacactctaatggaaaggttatagtggaaatgcaaggaaaatatatccctttacaaccagcttctaggcattacctagaagtaaaattatgacaataagactaacagcaaataacattgagcacttactctgtgccaggtattgttctaggccttttacgttacatcatcttatttaatccactccacaactaagtggtttggatgcagttattatctccactttatgtacgagaagaccaagacccagggaggtagaagaacttgtcagaagtcagacaggtagtgagtggtagggctgggagttggacccggacagacagattccagatttcatatttatcgtaacctcagctgccccacccacatgaaatgctaccccaaggctagtggcagcaaatataacccatttcatttgcattgtttggtatgtccaactgggtgatttgtcctacaaaatttgaaacaacgtctgcttatttatgtctgtgattttgatcaaataaatctcacccagaatttcccactgtcttattctatggtatttgcagtttgtaagaacctctgtcttttggattgagacgtttttattctttgtgtccaaattaacactgcacagaacatggttctctgtgtgtgtgtgtgtgtgtgtgtgtgtgtgtgtgtgtgtgtctgtgtgtgtgtgtagaaaccgtcttttcttttggattaaattcttgcagcctggctgagtgaggagaatttctcccactcttcgagcctacagcagacatgttaggagaatgctgctgcttgcaacacacccagagacggtggggcaggtgacactgcgtgtgtgcccggtgtctctggaagtgtctatacagatgtgtgctgctgctgctgctgctttctgccttaaaatttctggagccaacacccacccactcttacagcctctgtctctttattttcaaggaaaaaagaaagaggcagactgaaatagaaggcaagcgacaacagcttgacgagcagatacttctgctgcagcattccaaggtaagcrgctgatcccaggaacctattccattattagacatgcagatcacactccggagagctgggcagtgcctgccctgccgtgaaggygctgccgccaaccaaaccagcctttttcattcaatcaggaaaccatctcttggcttttcttgtgaatttctcaaattcagggcattattacagcattccartttctgcaagcataagattacagtgtgcatgtggacagggtggagggtttgtgcgtgtgaagtgtggtggctatatatagaaattggatgagaatacttcacagggtgggtgaggcagcatttcaggattgtttctcccatgcataggtgctgggtgtgtttgctcagagaccccaaaagatatatttcacggaacgttctttttattcacttaaaaatattagtatttcctttcttgatatggagaaaagggagattaaacgatgtgatctgataaaagaacaacactgtgtatttcagattattcatttattttatttgtactttaacaattttgaaagtgttctgtgagagcaagcagttggtcaaagatggctttgaaatgatttgactcagacgggtctccatggtaccatctaaaaagagagagagagagagacagcacacaagagctgtttattttttctttaaaacatgatgcacttaagcatcgtaattgattacagctcaggagaaagctctgtcactgtcacaaggaccccactggttgcagaatgttgcttttcacatgttcagagaataatgtgaccacattccaatggccagccgggagttgttgcttgcctttgactgctcctgggctttttggcaggaaaaccttctcctgcttacctcatgttgctgtgacattgcctgcacagagctgcattgctcagaggactgggtgggaaggtggtgctgactttcggggtgatgctcggtatgaattatctagatttttttcaacaagataaacctttatggctacttttcctgtccttttctagaaaacaggattgtgctaaatgaatacccaaaatgagaaccatcagcaagcgagttactgattgaaaatagcagcatgacctatatctgcttagcatgtttatcagtttttgccatttaccttaaccagagaaatgtgcttaaaaggaagaaaagcagcatgatactaaggatattgcctgtttctctctgttcatcatataaattcattgacagatctttctttgtaggagcttgctctgtatccccggtgctgttgctctttccccacaacattcctgagggaggatggagggctaaaattagtatcctcttctcacagagagggggccttaaaaacacctaatagaactgagtgaattgttcaaggtcaatctgcacagagctaggtctctggctcagagtacagtccattcagtacggtgcttgtaagagaccaacatgtactaaaacctcagtgaatttctggttaaaggtgaacttttaaataagaggaccgaatgaaaaaagagaggctgctttgggctagacagcctcactttaagctcaacgtagttctttgcttttgtattccctgaatccagtcagggaataaacatatgtcaaaacatcaagggattttttttctttggtctcccttctcatgatcctgggtgccaaataagataccaagggctcatttattgctgatgtccagtgcagtattagtatattctgttcatattacatctattcatttttttatttgtttgtttgtttgagatggagtctcgctctgtcgctcaggctggagttcagtggcatgatttcagctcactgcaagctccgcctcccaggttcacgccattctcctgcctcagcctcctgagtagctgggactacaaatgcccgccaccacgcccagctaatttttttttttttttggtatttttagtagagatggggtttcaccatgttagccaggatagtctcgatctcctgacatygtgatccacccgccttggcctcccaaagtgctgggattgcatattcatttttcgtctatgcatccattcatccatctttccatccatccatccatccatccatccatccatccaatcaacagaaacaacagtagaaattaacttggtcttgtatgcggaagmagtgaggtttttctcaaggacttggaaacaagggaatcagctagttctttatggctatcttggtaaaattctcacacagttgatgagattggctatctgaaggaacacccaacactcgcaccatggcaaccttgctattgcagggcaggaggtgggtgaggtggggaggactggaggtgatggtaacttactaagtggaggtgagtgcattgtatgtctctgggaaaggcttgtgtggacagaatgagggtgagttatttgccttgaatactgaaaaaggaaagctcagaggttccaaaggtggcagtggttgtctagtactayctgcagagagacccccagctttgggaggtcctgaatttctgtatgctggtgaggtggggtcagtggtaaggtgaggagggtcctcaggccacagtgaggcccaagtgaaacttccctcaggaccttgcctctctttgttctgaattcatcctccctataattattcagttattttgatatgaggaaagggttgcctgattgaaggatatgatcactttaggcactaggaaggaatatgtttcactttaaatcaataaactggtgactgaacttgaatagcatgggactttttccctgtaatcatccagtttgcagcctagtggcctcgcccctggatggaagtacattcgtggaggttatattttcttctctgtgagcctctccaaggagtcagccagttttctcctggtagcctgttagccaccgtcagtaacagtcaccatttttttgagtgcctaacacgtgcctggtactttaaacacataccctcaataatgaccacaagacagttattactctgtcttacagctatgggaacaaactcatgaggtcaagtgatttgcccaagaccatagagactataaatgagggagcctgagagaaactcctgggctgtctgctttcaaagaccgagctctttccaggccacygttctctttgaaagaaatgtttcctttggaataattcatttagtgagatgccagttaccatcattgctgtctctcttactctaaatatattgtgatggactccagaaaatttagatcatgtggagacatgtcacagtgattattgaagttccttgaagtagagaatattaggaaatatgtcagtaatcaatatttgtttcactaatttgcaaaatcctagatattctctaagaaaaaaatattctccttgcattagagttagttgtcatgtttataagatataattttcatattctttatataattctcatattctatgtcttaagataaaattctcacatgtggcaattatcagatagcctgtggacacttattctcatgcaatgagatgaattatttagacagattcacctgtctgtggtcaaagcaaataaatagaatgcaagatagtagttttggcattcatatatatttttagaagacttacttattgcaatatttaggaacatatagtgagcaactctacaaaatggaatatcatcactttgtatatggacttcgagcaaattccacaatacagtaaaagactaaagtataaaatggtaaaatactaactgctacatcccagtgattaggaaacctcaagatactttgaactccaggccaaattaaactcagatgtatttttaaagcatccttagctatacgtagtgtggtgtaataatttctaagcattacaagtagaactagtaagcaatttttatagctatattatttttgatgattacaaaaggaaagaatgtataatcattgcaaaaactaaattaaaaagtacagcaaaatataaagaaaaaacatatgtactctatacttaccattcagatagaacccatgcagaggtaaatccttctatacttttttccccgatatatttctgtagattaagatatgtaaccatcattcacagggctcaccaacctgtgggtaaaatgaaattatattaacattagcattggaataacattaacctttacctcttttttatgtgggttctttttaatacccatacaaaaacttataatttttataaaatcccatggagcattcttttactttaggataactgactttgatgtcttccttgaaaagaatgtctccatctcaaactcttagctattatgtttcttatacttcaatagcattaattcatctagaatttatttacagacgaggtatgcagtaggaatataactttactttttactgatgctgagctgcttgtctcaatgtgatttattgattaattcatcctttccttcactgatttaaatgtcttctttatcacctacatatttctgacttacatttgagtctaccatttatggattatttttattccattaatctgcccattcctgtgccagtattgttctcatttaatccctatagctttttaatatattgtaatatttcataagacaagaactatcattattcttttgaaaaattgtcttggctttttatttcataggaacaattatttatttttattgtttttataatgagacttgtgatgatatggatttttttaaaataaatcagctactatatcatactagagcagaaggaatttaatatttccttctgtcccttggttgaattrccagagatttgtctattttattggtctgttcaaagtcccagcacagagtaggcactgagtacctactgcaacatgaattccttggagacygtcatatttacaaaggtttgcctgacagagttggccctgtcagaatcaaattgctaataccacgtcttcaatacataaactgcctttgaattacttattcatgagcggggaaccctcactagagttttcttctaatccaagctataaaaattgtcattatatttggaagaccacagccttttcttccaagaaagctgaatgaaaaaagatgaaaggctgaattgtgaccctgtgaaatatttgttgtcaacccactaaggtcatttgctgaagagcctgaaggtatcagaagacttgctacaaagatattacagtgtctttcccggttttgaacatttagcactaattttagactttttcttgttactgggatgtgtgaaagacttatttcaaattttaaaatattgaacagataggcacagtacacagtgtaaagtaaccttagatctcctcccttgtttccatacccagagcttgaatggaagttaaaacctgatttcttctatcagaagtcttgggtcggcttctccctgggtggactgaagcatataacaaaatctcaaaaccaaaccaagatcttatttattgagagtcaagaaagaggaaggaaagagtgggaaggataggggaagagaaagagggacaggacacagataaatgactgaaaacacaaacacagctattgcctcatgctgagtttaacccactttctgttagaaaactgaatttaggccaggcgcagtggctcatgcctgtaatcccaacactttgggaggccaaggcgggcagataacctgaggtcaggagttcgagaccagcctagccaacatggcaaaaccctgtctctactaaaaatacaaaaattagctgggctacttgggaggctgaggcaggagaatcacttgaacctgggaggtggaggtcgcagtgagccaagatcacaccactacactccagcctgagtgacacagtgagactccatctcaaattaaaaaataaaataaaataaaataaaataaaataaaataaaataaaataaaataaaattgaatttagccatattccaaccatcatccactagaatagccaatatcagcttcagccagattacaaatgaatgaaagatccagagtaaaaagtaaaatcatgaaagtacacaaaggaatcacaggtgaatatttttatagtgagggtaaggaagtcttatctatgtatgacatcaaagccagaatgtgcaagtaaaaaagattgccagttatgactttataaaaataacaaacatctgaccaggaaacaacaggagacttattacaagttctcattcacctcctacttccccaatctgccccacccagcctctccagacatgcctcactcttcaccggggtcacctcaaaaagtggtatctaggctgggcacagtggttcatgcctgtgatcccagtacttgggaggctgaggtgggaggatcatttgaacctaggaattcgagaccagcctgggcaacatagattccatctctacaaaaataaaataaaaaataaaggaaagtaagaaaagtgacttcattgcagttaccttagctgtagatgaaaaagattgggttagatgatctctgtgatctttttttagctttagtgatccaagattttatatttgctaaagtacagtgtatgtgcatgattttccaagaattcctcacatgtcagcctccgtggatgaataaaagatacagtcctgactgtgagaactcaggggcaagtgggggagagagagcatcaatatggaacccaccattagaggagctgaaaaatagttttccatgttatgaagtggatcagtggcacctgatgattttgtaaatcctatttgagcaaaaaagaaaaaaggattcttgggtgatcttacacagaggcaagatagyagagtgtacctcttggcttcaaatcccagatctacagctcactcggtgtgataccatggataagtcagttaatgttagcacctacctcatgggatgcttgtgaaagttaagtggatttacatgtaaagcacataaagcagtaagagttctataagaattatcattattgtcaccatyatcacccagtactatggctgcaaataccatttatgtatatatgactgccaaattgagaatcccagtcttccatgttcaactgcttttctgacatgtccgcttagatggatgtcactttcatttagaagcctctgaaacttaacatgcccaaaatgaaagattttattttctgcttttctatcatttgttctactcttccctgtctccagttgatgataccactattcaccctttcactcaaaccaaatatctatgcattgccctaatccttccctttttctcagcccacatctaatctgttacaagtcacactgattctacctccagaatgtaccaccatgccttttgattcttctgtctctcttctgtttcaagctaatatkctctgtcacttgaaccatgcaataaactcccatcacttgtacttwgtaatcctgccccttgcaatgtgttcttcctattgggcttagaagacacagcaaactccttaacaaggctacagaatcctacctaatctggcccctgccttcttctccatcttcagtttgttctgccctcccaccccaacctcacttattatggtccagccactcgggcatttgttccggtccacaaacacaccaaactctgtcctaccaccaggctggtacatttgccagtccctccacctggaacacccctccggatctcagatctcagcttgaatgttcaagtcatcagagagacctttcccactttaaatgtcctcccctggtccctctttgtcacattgtcctgtctacctcttcctaggcagcatcatagtctgagattatcttgcatccttgtttattgggatgaaggcttgagtgagagtagggacttgcctgtcttcctgagctgtgacttcagggactggcagagttcttggcacctaggaaagggataagagagccactgctcctgagttggggacacagaaggagaggatggggagttcttttagattatggtgtttgaccagccattgagaaagcttgtgtattcttcaagcatttggatagtcataggtcctcatgctgtgctactcaaatcgtggtcctcagtctggcattgccagtgacagcatcacctgggaggtcgttaaaattcaaattcccaggccttatgcgagacttagagaatctgcatctccatgggtgggtcctggaatctgtgtcttaggaagttctcctggtggtccttatgcatactgaagtttgggaaactcagttcttgctttttgttttccaaagctggccaggccagtagagccagaaacagatttactttgggagttccttctgtcctcctttcagaagcccctgtcaagtttccctttgtccagctgccagctccccacctgctccttccttgtattgacttgccatgatgacattcrtttgacaaatgtgaagtttgacagtccttagcaccttgggaggagtttgagaccagcctggccaacatggtgaaaccttatctctactaaagctatgatactatgttagctatgatacttttttttgatgtatgttatttagacaataaaggccacaaacagagaaaagttttttttaattttaatttttttatttctattgagctctgcttccgctaaattctgaaacactgaggcagccaatacaagctagcacagtataggggaccctgtgctttggatggtgcactcagtatacaccattccatttggagacatgttggagacaacataagggggatctggagtcagttaaggaagscttttgaattggtgatttcccctgaaagcatgactttggagccaagtagaaaatcaactatgctttttcggcttcttaaaaatgtctaaacacctttgtgaaacaggattctctgagaccaggcccactgccttttccagttttttttctttctttctttyttttgagacagagtcatgctctgttgcccaggttggagtgcagtggcgtgatcttyggctcactgcaacatctgcttcctgggttcaagcaattctcctgcctcagcctcctgagtagctgggattacaggtgctcgccaccacacccagctaatttttgtatttttagtagaaatggtgtttcaccattttggccaggctggtctcgaactcttgacctcaggtgatccacctgccttggcctcccaaagtgctgggattacaggcatgagccaccacacccagccccactactgcctttgtctgttggagcctctcttcctggctcctcctgttgggatgttcttaatgatgtcatgcctatatcaagaaaagagatggaagtagagggacatgcacctctgggtgaccagagtcaccaggctgctctggccagagctacctgctgatggtggcagctaagttggtgagaagtgaggggctagacccttcatgtgatggcaggaggcactgtgtgaagaacagcagagagaacattccaagagcagccatttacgttgcaagaagttgtggctgcagaacatccctgctggtgtggagacagccaggactgtccatggctgcttttccagaagggtccacaccaacgccaaggcttccaggatgtctatcccccagaatcctaaggtttttactatctgtggtttggacatctttagcacaggaagcaccctgaaagtgtggtccctacccctcccaaataattagagagaaggaaagttgagaatttcccagttcatccatttactcattcattatagggaattgggctacaattccattgactgaatgaataaatggatgaattgggaaattctaggtgacacagtgaatgtgaaggtggataaaggacagtcctagccttccaggaaccagcaggctacagggggaacagatgtaaaaagaaagaatttgaggatagtatgaaagggccatagagtgtgtctcagagccagtagaggtggaaggcttctctggtggtattttacttgttctttcttaggtaaataaagcagaggccaagggaacaggatggacaacaacaatagtaaacatttctatagtactaagtatgtgtgtggcccttttagcctataaactcctttaatcctcataacaaccctctgagctgggcactgctattttctccattttacagatgagaaaactgaggctcagtgaggcgaaggagcctgtccaagctcactcagctggtaaatggcagactggttccagagctcaggctgttagccactgttcagcatggcctcttgcagtctctaccctcttcctgagagtaaatttcagagccaagttatagttcaagaaaagcaaagcaataatcattcttctacttcagaattgctaccaatgaacaatttattttgtgcctacaacagattaagtatctgaataaaaatataaaaacatgaattgattaaaaaatggcctctcataatgtgcaaaacagggtctgtyggggaaattttgagaggtttttgtggagaacaatggttctgaatgttttgtagaaagagcaaccgatttgccccaccctttcccactttccaatggaaaagaatctctgataaagctttgataagcaaccaacgtaagcaaattgtactgccctcttttacacatgattttatactatcatacgatgccctataatgtaaaaactgtacattttaatacctaccctggtggtagatgcacactatttatacagagcacattcaacaggcagcatgtcaccagtgatgcatagctgtttacgcatrttgaggtgtgggggtggatcctgtctataatcactgtaagagtatagttaggaataattctatgtgaacaaactcaagtctttaagcctaattattaaaaaattacaggtcaagtaccataaatttgcctatgtgctgcaagagtaatcaaagagatctctacaaacaatgatttgtaatgaaaaggcaagaataacatcaataaaaaccatggtcacctgaacccacactgatgatgtattgtcaacacagagtctctcctggaagtgcaggaattccaggttgattgaacttgctcctgggcatggagcagggtgtctacagcaccagatgacccctggacttctcaatagaatggtgaatcaggaccattagtgaagtctaacttactaatactaagtgttggtaatttttttttgagacggagtttcgctcttgttgcgcaggctggagtgcagtggcatgatctcagcccactgcaacctctgccccccaggttctagtgattcttctgtctcagcctcccaagtagctgggattacaggcrcatgccatcacacctggttaattttgtatttttagttgacatggggtttctctatgttggtcaggctagtcgcgaactcctgacctcaggtgatacgcytgccttggcctcccaaagtgttgggattacaggcgcgagccacygtgcccagcccagtgttggttatttttaaagactcatcagttcataataaaatgcccttaatgccgcatacaaatgagagtctatggaattgtgcatccttcgctcataagagcttcagggagtgctccaagcctccattccctggctctcagtctttagaagagttctttcctttcacctcgctcaccctgcctgatgagatcaaacgaaattctggacagaggtgatgccagtgagccagggagccaaagagccaggtctttattctgtgttaggtggcttaatagtcattgctcctgctgttcctttggttgcttactatttctgggaagaattgttcatgtgccctgcatcctcactgtggtcccctctggtgaccactgacctgcccatgggcatggtcactggtccttagccatgatgtacagggtcagtagctgctgccgtctgccatctagggaccatataagtggaacctgaatcaaaattatcctctcacatctacctctccttgctcttccttttagggaatttcaacatgcttttttctggaactgttttcatttcccttctcaaagcagtaattgctgcctccaaaccattgacctgaaacaaaagctttttattccactgtactgtatcgtagtacacttgcaaacatgggatgtatggtttttttttttttttttgacagggtctcgttctatcacccaggctggagtgcagtggcacggtcacagctcgctgcagccttgacctacctggctcaagcgatcctcccacctcagccttcccaagtagctgggactacaggcgtgcaccaccacacccagctaattgtttaattttttgtagagacaaggtctcactatgttgcccaagctggtctacaactcctggaatcaagcaatcctcctgcctcagcctcccaaagtgttgggattacagacatcagccackgtgcccatctaggggcatatgatttttataacatttggagattattactgaagatgattgggagtcattaaagaagggagtcattgaagaagagtcttgacaatctttttaaaacactttaatatggaccagatattaggtggtcttaggaagttttttaattaaattacagttgcatagaaaaatgttcttaatttttagagactcatactgacatattgttgggtaaaatatggttgttatttagtttaaaatcatttgatgagaaacatatgggaaaatatggcaaaatgttcataattgttaaatctagatgaggttacatggtcattcattatacagttctatttttaaatttttttaataatagaaaatgatatagagataaatctccttgggtgttgatctagagggaagtagggagccatgttagtgaggaggtgaaggcagcgattcaggcagcgctggtgaggggtggagctaaaacagcaccactgcagagggagaggacagtgtggactgaaaagtatcatcttgtctgttgtcttccctcacttccacagtccaaagtgcttcgggagaaatggctgctgcagggcatacccgctggaactgccgaagaggaggaagccaggaggcggcagtctgaagaggatgagttcagagtcaagcaacttgaagataacattcagaggtaggtggcttccagcccagggaacccatgctacagtttttcagtgcagtaaccactgctctcctctaggtggcctttctcaatactgttaccttctcctgtacttgagaattttcttcctaaacaaagcacattgatgttgtttaaacttttccagatgacccagagttatgacacagagtactaataattttttatttttatttttaacttttattttaagtttaggggtacaaatacaggtttgttacataggtaaacttgtatcgtggggatttgttgaacagattatttcaccacccaggtattaagcctagtacccgttagttatttttcctgattctctccctcctccctcccttcaccctccaaaaggccccagtgtgtgttgttcccttctacgtgtccgtgtgttccatcattagttctcacttataaatgagaacatgcagtatttggttttctgttcctgtgttagtttgstaaggataatggcctccacctctatccatgtccctacaaaggacatgatctcatccttttttgtggctgcaaagagtactaattattgcactgggctgtaatacagcacagtgatggcttcatgggcccacaaggtgttgtgagcagcttgccccttcactaggtgctccctttgagttcttatattagctttcatctttttcctccttcgggtcaggttgttagctgttattgctgctgtagtgagtctgttttcaaatttgctgtatttggtcaattcgaaatgtgaaaactgtagtcaacagtcttgggattgaaatgaagagtgtggaagtgctgagtgagagcacctctgtaggttatgtgcccgtgctctaaaaattaactttgtattgtctgctttcactgctcagagagtggtttctttatggttctcaaccaggatctgatcacttcaatctgggagataagcgacctgtctgtgggcaataactggccaggctcacacaagagcaataatgtaggtttttacttgggagctatagccactccaggtcccaggacacctagccagagagatatgagatagggatggaaggtggtaagcatagatgccttagaaccaaatctgtccctccaacccatcccaccaaattctacctgaaatctcaccacctggagcttcatctctgtcttctgagcttatgagctctttttttttttttttttttttttttttagatggagtctcgctctgtcactaggctggagtacagtggcacaatcttggctcactgcaacctccgcctcccgggttcaagcgattctcctgcctcagcctcccgagtagctgggactacaggcgtgcaccaaccacgcccagctaatttttgtatttttagtagagatggggtttcaccatgttggccaggatagtcttgatctcttgaccttgtgatccacccgccttggcctcccaaagtgctggaattacagacatgaaccaccgcacctggcatgagctcttttaaaataaagggtaatagctaagctgctaccagccatttataaccaacagcaaattaagactctgagggcacctgtaatagtgtcactaaagggaaaagcaagccaagtaaatcccaaaggcatacgtcagcctatgtccctactttgcttaggtcctcacatgtcttaaagagctttcagagcagcttggctaaacattgtgaaggaaactggccaagaaaaagtttggagggtttgtgtgtacatatacatatgtatactcacacacacccgtgtacatgcacatgctttttcttagaatacaaaggataaaggctaaactgttaccaaccatttatatcatatacatatatatakagagagagagtaggtgttattatagacagaaggcagaaaggatttggaaaataggataaaattagttacatgaccttttctatttttctttttgtttcttttttttttaagagatgagatctcactctgctgtccaggctggactgcagtggtgcgatcatagctcactgcagcgtcaaacttctggacttaagctatcctccgacctcagcctctcaaatagctgggaataaaagttcatgccactgtgcctagcattattattattttttttttttggtagagaaagagtctcactatgttgcttaggctggtcttgaactgctggcttcatgtgattcttcccactcagtctcccaaagtgttgggattacaggtgtgaaccaccgtgtccgtcctattctgtttttcttaagtgtcactgggaaacatggtcttccaatcaaattggcagtttaaccttggcttraatgcaaatatgttgttattatggtccaataggtggtaactcgcacttgtagaatgagccattgcgtgtggaggctagagtcttaaactgagactcagtttctgggtaaattgaccattggaaggaggtgttgtgggttaggggctggtttattattcaggtggtcatgattatactcaaagaaaagttgttaaagttctttttatcctttacgtcctttacgtcaatggaataaagagcacactcaatgtatgcaggcagtctcacccatttagagctagaatcccaagccagaggaaggaaatcacaatagcctacaggggtggatggtgaggcctggattcaggggccatttcttgtgtcttagtcatgactttgggccaaatgggcactggatgtgtgctgagatgagctgtgctccctggagctgctttctgtaggagcaggactgtggtgagcatcgtttcctctgcagggccttctgagggaggagtttcttctaccctggaagtcagcttctgcttctcttcatcttgctggcatcttctctaccacaatggttattagtrtctttaatcttcaatcccatgggaagaaagagctgttatctctcttcccataaaggacactcagtcacctaagacatttctctgtagttgaacatagcttagttctcactcacagaatgacatttgaatagttctaaaggctcaytgcaaacatgagcaccctacggtgttacaaagtccctgtggattggctggcatggctctgctgatagggctgagctcacctacgtgactctaatctgcgtgttgcctgagtccactcttgtttaccctgcactaacaggctaaccatgatgctgtctctttctggcaatgggagaggtacaagagggctgagcagaaacaaggcctaggctcagactgcccacaagccatctgccaaaccaagtcaatgagcaagcccaaaaccaagggaagagacagccagccaacttttagtggaaggaacacagatcagggaagggtgaagaatggggatgaataattcagttttccaggagcatgattgttgaattgaaaactgcaagcattcaggaaaatggaccggcattagggaaactacagaaaagacatttaaaaagaaagaggactggctgggcacagtggctcatgcctgtaatcccagcacttagggagaccgaggcaggtggatcacccgaggtcaggagttcaagaccagcctgctcaacatggcaaaaccccatctctactaaaaatacaaaaattagatgagtgtggtgatggtcgcctgcaatcccagctacttgggaggttgaggcacgagaatcgcttgaacccgggaagcggaggttgcagtgagctgagatcatgccactgcactccagcctggcaacagagtgagactacatttcaaagaataaaaataaaaataaagaggactaactaaaacaatgcaagaatgcagagagaaaggaagaagagagtaagagagaatatgagtgacttcaagatcaaatttgcgatctgatctttatataataggaatcttgaaaactataagatcagatgcagaaccattaaataaaggcattttaagggaaatcttcattactcaaggcaaaacattaatctgtagatctttagatttgggccccctagtctaagtcacccccagcaatcaattagattctcctaaagagatacataaactggttgcaaactataaagtatattagtacagttgtgccctgaaggtattttcgtccttgttgttgaactaagaatagcttgaagacactgaaggaggaatagagaatagtaaccaaagaacaaggaacatttctacaaagaaagactaagggaaattgggccatttagtttagataacaaaaggataatggtatcataactcagaacttcaagtgtatgtaggatctaggccatgtcttaattctttatgtgcaggccattttgaatatggcaaagacttcaaataaagcatgcaaatttctacttagatgtctatttccctagatacctcctagaagaaagaacataatcaccttttaattcttattctgtgattctttacagtgccagtaactgtacaagaagttccaggtttacagacatgtttttttccaaaatgttatttataaattggtggtggtttggaagggcgaatgttgttcctctgccagaattattatatgtggtgcttagcttttgagggcagcccacgaagaaggaaggaatggaggaaggaaggatggaaaaatgtaactagaatattaaaccctgggcattagaatcacttgggaaggtttttaaaaataagaattaccaggcctcattctaggaaatttggatttagtgatccaagtaaggagtcctgtaatctgttttttaaaagggtgttccagataattctgttgtatggtcaggttcaagaatgattgcagtaaatggaaaaaaggatagaccataaatgaaatcccattttaatacctagaaaccccccaaggagagtgggaagtaaatcatgtttataagaaaactggcttcacacacaaggataaaggacaacccaacccttgattcagactgtttctgagccttcctactttgacccaaggatatgtgaaacctgctttggggattcctgtaggtgagagtagctctggcttagagctgaagtctctcctccataggccccacagtagagctaagctttcatttgaagtggattagaaacagccttggtttaccaggctaaagatgatccaggtcaggaaaactgtgtgctttaccaaaggccagaaaattctaccattcttccaagatttcttgctaaaattcaaagtaatgtggtcttgaaggggtgacaccaaagcagctgcaaaggaagaggaaaacccggctgccacagtggagaaatagattgtcattcttttgcacagcttttccctgggtaatgtcaggattatatttttggctccctggaaaccagaattaaaataggctaaataagattggaattgttgaaagcaaaatctgtagacgtttccttttttgaattttttgaatgtccacatcttctgtatgctttgcttctttttggagtgacgtattgagaaagcccaagagattgtttctggcttgggcccattgccagccattgtccgtgccattattgtgtgtggtgggtccctggaggccacatgtggacctcgggttgatactttcggagattgtaggtagttcgagccacactagccctgtttacttcatgtctgccccaagcatcaagtcttgttgtttaccttgtcactttcccacttaagattctctttcatttcactgggttttactaaagtgtttgaaatacagggtttttaacttcctttgattagtgagaaatatggggaaaatttatctcccaaccttatcagttgggggcagaccaaccccagtgaagatgagaaacttcatggagtattaaatgaaaatgggatgagctgtcacaaagccaggatgttaattctagctctgctgatcatttgctgtgtgaccttgggcaagtcttttgctctcttcagtctcagtttcctcatatcttcagtgagccatctctcrggatcttccagctctggtattctgagtttctctaatttgaggagttggttagagatctcttttctcaacagtgtacctgtkccgagaaatgttactgttatagaaggaagtggttttggaaacgggtcagagtggaggaaagaggttgagttctcaaaaaactaaaggctaggtataagtaactgattcatcacagagatgactaattcatcagaacagctgtctgttctaaaatatgtcacatcaaataktcattgaataaaatattgaagtctcaactgctaacctagagagagccaagcagcttttaaaaaatcaggatagaagtgtacttttcatttccacattggacctgtgattctctgagtacctgtgtgggtctctggtaaataccagaattcacttaattttccatattgttaggaggctcaaagccaaaggcgtagagacattaggcataagcatatgtatcttattaagcatctgtatgttatgttgtggggtttggcaaccaagaagatgacagttacttacaactgttctagaaaaggcaaccactgaaacattcattgaaatcacaaaggacacttgcttgagattcattgtgttcttcacatttgctatttttaactccatgattcactgttcttttgagcagggaggggaacactccacagtggcattccacatctgtgcacttccagccggggtccccaccccacgttcagccacatttgcagcccaattattgtttccattcttttgtttccttccaaaataaaactatatatgctatgtatacagtaaactatatagtagtgtctctatattgtgtaatatttcctgttttgtcactcccttctgggtagcggcctagcttttctgcctccatttaattcattaattttctaatttaagccttgtaatactcccatgaggtagtgatgatgatgatgatgatgaagagagaagagaagcacaggaggtgaagtaacttgctgccccccctaaaaaaattcaatggaaggacatacaagatgaatgaaaaataattttaaaaaagtgaaagagcaagtatttgaactcaactctgcctaattctaaagcatgttctcaaaaatcccaacagaagttgttattttaagctaaatttttttgagacctctgatattgagtgaaattacactaacgtgcacctcgtgatgtaggaggagggacaggtaatgtgattctccctcctcaacctccacacatgcttcttcagaaggcggtgcatcagacgcaccatgactctggaggtgccggtcttcagcctattgtgggtggtcatcatgatggtgagactgcccccttcaggttctttcatgaagtgcaggtttcattttgggcttggctcctttctgtctcttttggaagccctttgttcctgattgcactttctagcctgtgtacagtctaaacctctgcgggaaacagtgtgtgcttctgaaaagggctccagcatagcaaactcactagaaagccggacctcagagcttgaccaaacttggctggagtcctagttctgtatttacaagttgtttgatcttggacaagccatgtaaactctctggacttaagtgtcctcgcctgtacattggggaaaactatacccaccttgcagtgctgttgtaatgtgtagaggtcaggtgtgtttgtgaagtgccaagaacagcaggttgtcagtaagaatagtgctgttggctgggcactgtggctcatgcctgtaatcccagcactttgggaggctgagacagatggatcacctgaggtcaggagtccgagaccagcctggccaacatggtgaaacctcttctctactaaaaatacaaaaaattagccaggcgtggttgcaggcgcttgtaatcccagctactcaggaggctgaggcaggaaaatcacttgaacccaggaggcggaggttgcagtgagccragatcgcaccattgcactccagcctgggcatcaagagcaaaattttgcctccaaaaaaaaaaaaaaaaaaaaagaatagtgctgttcttattgttgtttcttccatccccctacagcagagtttcttaacagctgtgctattgacatttagggctggatagttatttgttgtgagtggctgtcttgagtattgcaagatgtttagtagcatccctggcctctacctagtggcttccaggggcaccattgccctttcccagtcatgataataaaacatgtctccagacattgctgaatgttgccttgggggacaaaatctctccaagttgagaactactgctcaaaagcctggcattatgtgtattgatactaagatgagaatctcaccaccgagtagttccagaatacagaaccctaaaaagatttatgaagataacattagtgattctcagtgcaaaatgacaaagtgtttcagttacttgaaaataaaaggcttctcttatgcactgagccatgaaagtctgttcagagttaaaaagaaatagttgcttttttggtttttgcattcagtattgtgctgcttttgcaaaggcaataattttatgacagttcataaaaccatggaatcttagagtatgcataactgacatgttatgcggatcaactcctatctgattcttgaatttgcaatgaacgtaatgagtgggagtgaaaaaacagtctctccccaaagcctgaaagtgacaggaaactcatttacttgcaaaataaaacccaagtatatactggaacaactctaattattacagaggatcctcctttgggatgaaagttttgttccctgcagctcctaccctctctctggtccctgccctatcctccaaggaccacacagaaaaagccctcttcactgactgaaaaaatctagatgcttagggtttgtggtcagctttgcaagctggcacaggtaagggaggaaacactctgaaattgcagtscagcatttcaacatttcatgtgtgttacttagcaacaatagcaggaggcctgccagatgtaccagagtcatcgtgcctcgctcaggttttgtaggatccattataatcatctcattattggtctggcaaattgggtttatagtgcccagaactatgaaaatagtagttgaatttcttccatacactgaggccatgtaagagccatatttgggaaatacatgcatttcccagccctcagaacaattgctgcaatggaaggaattctgcaaagtcaacttttttggtagccagttccaggctttttggcctatgattgccacaccccaagttttctctctacaaaaagctttgataatagtctttttccaattttaggtcaccttgcatagcccctctggcttgtaacgtggtcatttccaaccgttctacattcttgatgaaatgaaaacagcaagcttcctgttgacatactcttccacagttttcatgaattatgcattttgaaggcagcagacaagatggtgtctcagtcctttccagcgattctccagcatggaggtcttatttggtacatccatcacaagggcccggagccaagatgatctcttgagcacaatccccacttcgtgtttccccttttcactgtgtaggccacagggaagagtactgtgggacccgaggctgcttgatactcatcaaggcccgcttcctccagccttcctagcttctctttccctcaggtctaggcgtggagccctccaggacagcgaacgggtgataaaatatacaaactgtctctgattatgggattttggctccttagccaatgcatgcaaggatggtagaaaaaacactcatcttccttctactatcctaaaagcaacttccgacatcaagaatttttttggatctctcatccaaaggtataaaccttaacagtgggaaattcagaccaggtgagaggaaagggttacacactaagagatgacttaggtttgggtagtttcatcaggagaggtctgcctgcatcctggttcctgtccttgttttgggaaactctttttagcatacttggagtacatattcagttaaacttgcaaagtgaagaatcagagaatggaggcctaaatgtgattcacctgaggccacacgcagagtgaggagataccagtgtgcttcctgcagaagcatctcccacatctctgccaagcctttttatctcctttgaaacagaatctctaatggaataaaccactccagggatcctagagtcttgtgtttgttcctcctatgcagaaaggcaaaggaaaaaattaaataatatctgaataccgcccagtgcacagagagtacctgtgaaattacagggacattcagccagcaaagaatgtccccctggccagggtgcctggaggaaggcttttaagcattaccatgctgtacagcatggggctgccagcttgaccagattctagctggaaggatcaggcatctttaaagaccggtagcattcagggccattgctgggccacatggctcctttgtgcaattagaaaatgcagttccacagggtaggcagcacttagaaagccactggctggacttcacctccctttgttcccttggctagcatcttgggcaacaacattctgtacaagcatgcaccatggccctgctggcttcttggtctccacgtgcctccttcttgttggtcattaaggttatgccattttcccccattattaagtaatgtcaggtaaggtctgaggagatggagatgaagacttttacaggtcgcaggggaacactgacatgtcactcatcattttgtgtgtgtgtgtgtgtgagacagagtctcactcactctgtagccaggctggagtgcattggcagaatctcagctcactgcaacctcccatctcctggattcaagcgattctctcctgtctcagcctcctgaataattgggattacaggcacccgccaccatgccaggctgatgtttgtatttttcgtaatgatggggttccaccatgttagccaggctggctttgaactcctgacctcaagcgatctgctcaccttggcctcccaaagtgctgggattacaggtgtgaatccccgtgcctggccatcacccatcaatttttaaatggtggagtagctcccatgatggatgttatgaaagggtctatgggtgcatatgaaagggagtggtcattactactcagtccaggtaraactccctggatggagggtgaagacaatgtggtttgagttgttaggtaaatgtttccttatcatttttcattatatgttacatttacattctgttcatccctaagatataactccttaagattacatctctcagatgtaaactccaccagagtaaggactgtcttggttacctactgtgttcatttcctgagactgatgtaacaaatttctacacgttcgtggcttaaaacagctccagaggccagaagtccaaaatcaagatactggcagggctgtgctttccccagagcatctagaggcaaatccttccttgcctctctcagcttagtgggtccagacattccttggcttgtggctgtgtcgctctaatctctgcctttgtcttcacatgggcttctcctcttgtctctgtgtcttctcctttgtctctcataaagacccctatcattggatttagggccctcctaaataattcaggataatctcttctcaagatccttaaattaattacatctacacagacccttttatccacataaggtcatattcataggttctgggggttagggtgtggacatatctttctagggccatcattcagtgtactatatctgagtgcctagattactgttttacacctaggaggttgctcaataaatagttttcaatttaatttatatgtttcagccttagtttatccataagcttgccatgaggttcagaaaccatcatttatatccagagatggtataaggcagtggttaggggcatgaacatccgcgtaatacttgctgggttcaagttcagaatctctgcttgctgcctgtataatttgaggcaagttctttagcttctctctacttcagtttcttcttctataaaaagaaataataataataataaagatcaactttattggggaggggtgactattaagtcaagatatgcaaagagtacccagaactgtcttggactttgtgcccaataggttttggcttttattataaaaataaaagaatgatatgacaatgtacaatatataaacaatctcaaattgtttgattttatcagactccctctccactttcagaaacagctgagagggctgtcactgcactgagattagcatggcattccagaactcgggcccggtaagcatccaggtccaagggtgccttggaggggtacacctcacctttgcagtccagggcagaggaaggcagggaggctaggagtgcagcactgagagagcagtggccactgccttacaaggccaagaagcgtcccatctccccaacaactgtcaggttccttcctgccctggraacagctctaatctgtctgtttaccacctacctgccagccttcagcaggaattccaggactgctgggcctatcagctgaagtagaggatgaaaaagaacaaatccaaaggcagaagaaataggacaatatgatagatggatttgacaagaatccagaccaattgtgggcagaccaagttgaaaagcgtgagaggctagagttatctcagcaggggtttcgttttgttttgttttgttttgttttgtttttgagacagtctcactctgtcgcccaggctgaaatgcaytggtgtgatcttagctcactgcaacctctgcctcctgggttcaagtgattctctcgtgccttagcctccagagtagctgggattacagttgtgtgccaccacacccagctaatttttgtattaacaccgtagagatggggtttcaccgtgttggccagggtagttttgaactcctgagctcaagtgatccatctacctcagcctcccaaagtgctgggattacaggcatgaggactgtacccaaccatctcagcagttattttaaaaaatgtttagccttctgatgagaacacgtggacacgtggtgcggacaacaaacactggggccagtcgagggggctgcggggagagagatcatcaggaagagtagctaacacttaggtggtgggttgatctgtgcagcaagccaccatggtacatgttcatctctgtaacaaacctgcacatcctgcacgtgtaccccagactttaaaataaaagttgaaggaaaaaagttcacttttctgctttccagttgcttatttaaaaaaaaaaaaaaaaaaaaagaagcatctggctgggtgtggtggctcatgcctgtaatcccagcacttcgggaggccgaggcaggtggatcacctgaggtcaggagtttgagcccagcctggtcaacatgatgaaaccccgtctctactaaaaatacaaaaaattagctgggcatggtggcgggcacctataatcccagctattcggaaggctgaggcagggagaactgcttgaacccaggaggcagaggttgcagtcagccaagatcgcaccattgcactccagcctgggcaacagagcgagactccatctcaaaaaacaaacaaacaaacaaaaatgcatctaagttgtctgagtgatgtcctgctcaagtccataagggacttgctttattacagaaaagtggccaaacccagtaatattgaaagtatggtccagggactgcttctggtcaggcaactgtttattaccagtctgtgacaaagacagaaattgccagtaaggtgtttagaaactttaatagcaatatgatatcccaatgggtgatcaatggacccatcttactgaatagggtagagacaagtttgagtgtcgttgcactcacgtggtgagctgcatgtgtcgtgggctgagtgctagtattggtctgtgatggattgggatcagacccttgtccatgaccataaaatcttgagcaatattgcagcaagccaaatggcaaagatgactatgtgccccaagaccacacttttttttcctatagtttttttaagagagacacggcctcgctctgttgcccaggctggtcttgaactcctaggctcaagcaatcctcccatctcggcttcccagagtgctgggattacaagcataagccactgtgccaagcctccctaaatgtttaaatcttgtcattgccaccattctgcaagatttacctttgaatctagaaaagaacttggagtctttctactaggcctatccccacaccacttcccatcatagaggtgaagaacctgaggccgggacacaccacaggactctcagaatgacacagccagtcagattttcctggcacaaaacccagtgttctttcaaagccaccattcttttcctgtaactaatgcaaaagcaaatcttagcccatgacagggaatcacagattccaaatgagtgccctcagaatgactggtttccttgaaagcagctgtttcataaacatgactttgcgggggcakctcaggccttccatgcagtggagtctgctggtcttggggctgctctgttaagcaaaggatgggaaccaaaggtactgacattttaatattagccacacagatgtcttggcttgtaatctggagaaaatcagtcagtgtcccagctgaatctgtaaataggaacgacaataagatttgctctctctcgggacatcctaagaatttttgtcaggctagaagaggcagcctggagagatttgtttgatctgggaaagcagaagtcaaacttggtttttcattcggtaagatccactgtggttaaaatgtggtcagagggctcattcagcctcctacttcaggtcgaactatacttaccttctcttacttttaaagaaggaagggagattctgtaaatgagtggcttttcttttagtcagtgctgtcatatgccatgacaatattgtatttaagtctgttctcacagtgctaataaagacatacctgagactgggtaatttataatggaaggaggtttaattgactcacagtttagcatggctggggaggtttcaggaaacttacaatcatggcagaaggggaagcaaacacatccttctttacatggcagcagcaaggagaagcgctgagcataaggggggaaaatctccttgtgattcatgcctgtaatcccagcactttaggaggttgagttsggtggatcgcttgaggtcaggagtttgagaccagcttggccaacatggtgaaaccccgtctctactaaaaatacaaaaaattagctgggcatggtggcaggcacctgtaatcccagctacttgggaggctgaggcaggagaactgctcgaacctgggaggcggaagttgcagtgagccgagatcacaccattgcactccagcctgggcaacaagagtgaaactccgtctcaaaaagaaaaagaaaaagaaaaagaaaccattagatctcatgagaactcactatcacgagaacagtatgagggtaaccactcccatgattcaattacctccccaccaggtccctcccatgacacatggggattatgggaactataattcaagatgagatttggatggggacacaacraaaccatatcaaatattaatagagtctggcagggaggaagcatgacttcatactggtggtgagtcagaaggggcatcttcatattttaaggaaggtggcacttagattccaagtgcgtcctgtgtgcagtggagtcatatgcagctctaataaagaacattattcaggccaggcatagtggctcatgcctgtagtcccagtttgttggcagcctgaggcgtgaagattgcttgagcccaggagttcaagaccagcctgggcaacatagtgagacctcatctctacaaaaaatacaaaaattagccaagcatggtggtacatgcctgtcgtcccagctactcgggaggctgaggcgggaggatcacttaagtccaggagtttgagtctgcagtgagctatgatcatgccagtgcactccagcctggacaacagagcgaggccctgtctccaaaaaataattaattatttaatttaaatgttcgaaagaacattatgcagatgcttctcaggcttctcttcagatggcaaaatctcactggttttcaaatatcctaactgaaatgttcagttccagctatcttttgcttcatccagtaattagtttcaagtttttttttgcctctttttagatatgaatcccatgctaggtaacaaattatagtgacaggaaaatgtggatttttccataaagtttaaatattcaccactcaaccttttagcagaaagctctgggaccaacctagcataagtatagagttgagggttaagagtaagcattcttcccttcgtcacttatgtggccttgaaccaattagttaagattttgtgcctcattttcctcatctgcaaaatggaaataatcataaggtatactttggggattagtgtgaggggcaaatgagttaacatgtataaattgcttaaaatagtatttggcagccaggcttggtggctcatgcctgtaataccagcactttgggaggctgaggcaggtggatcacgagttctggagttcaagaccagcctggctaagatggtgaaaccccatctctactaaaaatacaaaaattagccgggcatggtggcgggtgcctgtaatcccagctactcgggaggctgagacagagaattgcgtgaaccccggaggcagaggttgcagtgagccaagattgcatcactgcactccagcctgggcaacagagggagactccatctcaaaaagaaaaaaaaaatagtatttgacaatgacgatagctgctgttattatcatgacccaaatgctatatttgcttcaagcaaatggaatgattctcagaccaaattttttcaccaggcatttattagaaggaggtttcatgtaattctgaattatgctccgaatcatattcacttcattcaatatgaaaagcaagtatagatttacagtttaattgttttgagacagggcaggattcctaatcacatttttagaaatgacttttgtgtctcatattgttcatctcctctatcctctcaccaagattccactgtgtttcataccagcttgttcagttgaacaaggtggagaagcccatttactgtttggattaaatttttttatcaccagtgtatgaggatttgcattaaataaattataggtaattacattaacaaaccaagaagacttacagttaaagagggcaaaaatataatttacttwactgctctatgaaatctatttgtggatttctctcttctcaaaggagaattaatcagagaacaactttgttgttattgttgttgttgtcgtttaagaaaaaaaagaaagaatgaatgaaagatcacatagtagcagtggtaccctattcaccttgcaacagttgtactctgcgcacctgccccaggttatagcaacatcaaggtcaagctcccaatatttcaagtacaaataagacttcacctgtgcacaaacatgtgcttacacacttccatcctcctgaattttctttccagactrttttacagataaggaagcagctctcaaaagacctctctcagacatttgaaaacacattttttttcagagtgctaaattcatgcttcttattttatatatgttagaaataaacacataaataataaacagtcttgcctggactggttcatgttcaattcataggcrctgagtattctttattaggacatactcactattgtttgttgaattattgcacttttaagaaatcaatctgaagattaaacattaggagtctcgataaaaaacaagtctctatactttatgaagatcttaggaatttctaactgactttggaacagccatttgttaaaaaacactttcccatcccaaactccactgactccatttttcttctgcactaactctcccttcctcctcccccatatttggagcagcgtctctatgtcccattcactctcctacacctgccaaatcaccagtgactatttaggggctaagtgcaaaggagacttctaaatcctcactttcatcaactgttgagcagcaacggaagctgctgaatgctccctatttcttcttgaaacacactctctccttgtttacttgagatgacactatccttcctctgtccatctgggaaatattggtgctttgaggttcttgacttggggctcctttcttcacttctcccattctctgagtgacattgtctgttcccatggcttctgaaatataggcattctttgatctaattttttctccagacctacccatatagccaactgccccctaaccatatccatttggatccccccagacacctataactcagcatgctaaaaattcattagtcattactttctctgattgattccttttcattgattcttaatctcattgaaaaacatcaccatgcacccagttgcccaagtctgaaatcaggacattgtccttgcttcttttcaccctttcaaatcctctatctaatcagtaattttatataataaaaggattcttgattccttctacactttttctttcccacttccatgacagtagtccaggccaccattatctttcatggggattgatgcaagagcttctcacctagtctcccttcccctagtgttgtgtccttctgacctaacctctgccacccagcagaagtatctttcaaagttcatatttgatgatgctactctccagcttcaaaccctttacctgttttccttggactataagataaagttcaacttccttaatttagcttagagagtcttttatgatrtgacctcctcttacttctctggccttgtctctcataattgtgtcattccattgctgaccactccagcaactacctgccattccttggatgtaccaagctctgtctgtgtcccgttctttggatctactgtcccttctccaaggaacgttcttcagctgctctttatgtggttaactcctactgaaccatcaagtctcagctgagataccactttccctgagccctaaaccctggtttaatgtttcctgtgggcatatttaccttagagcttactgtgtcatagtacattggaagctgatttttttctctatcctcctctagcctcagctgcctaggggtaaasacactacagtgttcacccttgtattctcagatcttagtacactgccaggctcaatgggttttcaaacatatttacataaagaaagaaaacaatgacaaaagtrcagatgacatgcccatggatactctggacataaatgcttgtaatatttctctctgtaagcgtttccagtgggaagttcagcttttgtctcaattactctgattggcatgcaatcatgacaagaaactaaaggaaggagattgttttcttgacatttactgagaagtatagacaagtactgccatgaacaaacattcttgctaacaattcttgctctaaattggttgatataacatccacttgagtcaaaatgattaagtaggtatccattgagtgtcatgcatcgcaatggcaaagcattggagttacagaaaataagtaaaatcatctcccttgctcttacagatctgacagtctaggcacccaatagatgggtaaacaagtactgagagatgtcatacttgtcctcaagatagtagaaattcaagaaagtagtgaccatggaggaccttaggatttgggcttttaccccagtggtgtttggctgagttaatctttctaaaatgtattcatcattcaatcaagtgcttcttctggaggccaagcataattagagatacagagatgaaaatgacagtcattaccctcacaagacctataatctacccaataataatgggaggcaagcctttagagttttttaatttggagttttcagagatttcctgaagcttctggactgacgtttctattgtacttgagtcccatcatttgacattagaagatctccttccaagaaatatttcttaccaccaaaagacagttaactttkacttcagacagaacattctkgtctgcacccagaacctttaatacctgaatcttttaaatcagtgatggtctcttcttctaaaaagtaaaaggtaaatcaaattcagtatgtctcaattaattggaagggagtttcaagctcataggaaatgaactacgaagccatgttgggatatgaactgaatggttgctattgagatggagcaaatgtacctggatatcattaggtggaaccagactggaaaatgggggtccttccttgacctcagtgaagatttggccctttcagcctcaagtagtatcccagctccagaactggacctgagttactggataatgctgtcattaggaaactgtgaccacctaggagttggactgctaaatgggcaatgtcagcaggytgttacagatactctatgcagaccaagcttatttggctcttctcagctcagccacctgttgtaaacagctgagaggggcttagctccacgtggaggttgtcactatctctggtatgttgtctctccctgggaacggacatgagtgtggaaacagggaggacacagttgattcctgctttcactgagtcactctgtccattaggagaaacagtccaggcatggccagccaaagggaggttcttcgcaggatcttctgtctctttgaagatgggataatctcaggcctaaccacagaagcagttctggagaagagtcagaatagcagattggaaacagctcacaggggcctctgaatgctaagtggagggacttagaatttatcccagaggccacagaacactattagaagtttcagaggtataataaaggccgttgtgaggttaggatgctggttcaatgtcacaattagagcaaggcaggaggtagagaagtcaagggcagactgggaaccagctgggcaggccactcattttggttgaatttggcaagactgaggaagacaatctaccaatagaggatggatgagaacaccagaaagcaaataaaacaagtcattcaaaaatcccaagatcatcgtggctgggccagagaaagaatcagacagaagcagcgcacggctctggagagttgcagggagaagcattgctgcatccgctgtctccttttctttttctttttttaaatatcagcaatatcttggatctgaatagagttctatcacagattagggtttctctttccccagggttcccaaagactgagcaggatcttattacagatgcagcgaaaagggtacgtttttcagtatcagactgacctcatctgaatctcagcctcacatctcattaactacatgggaccttgggcaagctacttcacccatctgcaaagtgggaatcaatgatatgtatctcatttggctgttgtaaatcttaatcaagttaatatatgtaaagtgtctcatcagtgcctagcgcatagtgagttcccagcttctatagcaccctttcatctttctctccttacagcatcagagagcttgtcctctgtggctcccgtttctctctggccagaggcagagcctccatgggagcatgggagggatataatcagaacagcagcattctttcattatgacgtcaattcagccatccctcaatttactgagcccctgaaaggccatacagtgagccatcattgtaatgaagtaaaagtagctggatactccaggaagcccttctagtggcactttgttaggtgagatgtgtcagcattgacttcttttgtaagtgctacttctgttgaattcaatgcgttgaaaggtggaatgcattgatgaatgtattcagtgccttggccacttctcagttagcttttagagtagaggacctcatggccacatgacagagtctaactgtcagtttccagacatttactgtgcccttggccctgcttggactttggaaatccaaagatacatatgaccgacgcctgctctgggaggaattccctgtccatgtggaacacatctatgcccttctggtccaagtgagaagagaacatgaaggagcaagtgtgcatgcccataagtgccggtccctactcagttctcactcagtcccacagatacccaggtctactttatgtaggtccttgtgttggtttctggcattgctgagatgacagaggccccagtctctggagcctcagagatttcatggacacctttttctgcttgagctcatgagccagatatcactcctggcccaggtcactgggttaccagatgcacgggtgaaagagctgctcttgagcaaagggcctgggacacacatgccggagaagcatggtgagccagccgcagggaggaagagcactttgcaggagcatgctgtgcggggtcttgctgctgcttttcagaagcaggagagccatgagccttggggttcacatcagcaccgagactggcctttggtggcagggaggatatgcgtaccgggaggggttggccatactggaccacagggccactggttgggttgttcataattgatctttggggacacttactgcaacccatttattaggtgccccctctaaagtgatgatctcaatgaagatggttcacataggcccactacttctagaaggcccgaatccctggaccttcccaaccactttttctccctgttcctgggttacatggcttagctggatatttttgcacacagcattaagggcaagtgcactgttcctttgaaaacaacaagggaacaaggagttcagtgttgtggacatttaatgaactttctcctcctaagtacacaataccaaatcagcagaatcacagctgtctcctcccagctttacctaaattcccacatgtgctacctcagttagggaactatgacttcacctgccactagatggccctccatgtgcacataagccgctcccacatagcgaacttgcatcagattttctggatttttttttttttttttacatgtagacacacatgtgcatacacaatcttaacttttaccatccttgaagccaataatcaacactttagttttccttctggcattcaaatgatagaatgtattctcattctctggaaaatcagtttaacatcagaatctacagatattcctgaatattgtgggccacaaagcacatattaagatgaatttgaatttattctattaaatagtatgctttggtttatcttataaatgytgtatttaacagacttgtttctaaattaaatttttttaaagcactggaagagaaaggaagyacaaacatttgaatagtacttgctccatggaggcgggcagtgttctgaggtattttaaacattagctcatttaagcttcataactttgatgtaggtattccatatgcatcattataaccattttatagattgaggagaaaatcagattgcagcatgaaaggtgtttagattcccttttgccttcctgtcaattttcttacctataacatgggaataaaataatccctaattgctgtgaaaggatgttgtaaactctaaagcattacacaaatgttgttattattattatgacttgggtttcatgggaatataattttcttatgtgctcaggaggcttgtgatcattcattcattcacatgaaaacatttatgcaggtcccaggtcattgcctctgcatgagacgtctcataccgagatgcctgtactatttctaaaacaaatctagtctgtcttgaactctcttatagctgagggttccagggaagttgctgtgtgctttcagcaggtaattctcccttagtctcaggatttagaaatgatggatgtggtaggacaacttcaggggtgggacctctgctgaacacagaggtggccggtgctgatttcacataagccaagccagcgggaagaggcaggctgttttttaaaattattattctggagcacgatgtactatctctgtatccaagagttcacatttcaagtggactatcagatcatctctgtgacagagggctttaattaaaagcataagtctctgggtggattttaagtggcattgtttttctttggacgttatgcaagccacttctgtgctgtaaaagggcttttaaaatttggcttaaggaaatttgctttacccctcaggctttgatccctgcgtgtgaatcattttgtatctggaggttccaatttgcagtctcctgggtgtaaggaaaattctaccctcacagaacattttggatttgaaaactgagaaatctgcatcattctcgacataatagctgttgtaaaatagaattagggctgttaagtctatagggataaagttcaccaaagaatattttaaactttagttttagttcctaaagtttttgtctccaactcccataataaatgtactgggacagtgacctacccactcaacacctgaagctcagtgttctctgcactcaggccaggtggactcagccatcgaggccattgtccctgtccagcctcccagggggcacgcatgagccagggccaggatacagatacttctgcctcaacaccatctgtaccaccagaaaagggccccaaaggcccttctcactgccatttgtaaggcaaaatgtctctattttatctaagacaggaaaaaggcagagagatgccagagagaatgcaacgactgtgcccgtgagaaaccaacagtgcagggtggcgatctacccgcagcacatgcaggatgcagcgttagatgctgactcagtttctcagccatacaggagaaaagtttcagcatttctcaaactccatgaccatccttcagtcggctaccccaagccccgttttgctgcagccgggtgagggcagtaatgcagctcagtaggttaaggggccaggctgtccttggacttcagatgatatcagttcagtccctgggacatcttaaattagggcctcaagcttcaaattcatgccttggccaacacgttaccataaatgatcacagggagaagaaacagtcaggccagggatggtggcaggttcctgtaatcccagcattttgggaggctgaggtgggaggatcacttgaggccaggagttcaagaccagcctgggaaacatagcgaaaccctgtctctactaaaaataaataaacaaataaacttttttacaaaaaagagaagaaatggtcagtttacgttgcatttccttcttttcctcaagaagaggtgccccgtggtgcctgggacagctgggccatcacatggaagtggctgagaggtgggctggaaagaagaggaaaatccagggctcccaccaaccccagccaatctctagtcactgggcaacctcaatctacttctggtcatagttttacaattttgcgggggtaggggggatggaatcttgctctgtcacccaggctggagtgcagtggtgcaatctcggctcactgcaacctccaactcctgggttcaagcaattctcctgcctcagcctccccagtagctgggattataggcctgtgccaccatgcctggctaatttttgtattttccgtagagacggggtttcatcatgttggccaggctggtcttgaactcctgacttcaagcgatccacctgcctcagcctcccaaagtgctgagattacaggcatgagccactgtgcccagcaatagttttacactttaatattgccaactttttttcagcccagcctgtgcagccacacaaatgcaaaaaggttagcttaggaagttgtcaacatcattatactataaaaatcaataaatggaaccttcttgcttcccacagtagtccatgctaagcttggcttcaccatcccttgcttggacaactcctaattgttctttatggtttcactctgtaaccctttcatacatccaaatccgttcttttcacatctgtccacatggtctttctagaacatagccaatcctatcactgacttaaagcaaacacataaacaggcagacagacaaacaagaaactcaaatggctttctgttactttccgaatcagactcattagtgtggcattcaagagccatcatatcctgagcctgatcctccctgtcactttctttccctcatgagtgcactcagataggccagtcctacagaggtcctcattcactcacttgagcctgccttgcacatttctgcatcaaagcccctttgtccatgttatcatcctagcttgaaatgctgtctgaacacctctatgcyttgatcatttttctcttcaagatcctactgacatgttccaacctcctgaaatcctgccctgcctccccrcaagcagagttactcagactctcttctttgcattcctgcagcattttggtcttgcaatttgagctctactgtgcactgcattgtaactattcatatagcttcctccctcatgagatgatgaatttctcaaaagtagagactgggcagctgttactgaatatagcccaacacttgcttgataatgctcgataaacatgaatgagtgacccagaacatttcaaacttcccttccaagacctgaaagactcatatttctgggtgttttaagctctgtgatttctgctctggtcacctgggccaggaactgcctgcctctattttcatttcaggcctttctctctctgccagatgccttgatctctgagccgagtataccttgacccaaagccatgatgcagccctcagcttctgagaggaaggggtagggttcagtagttgcgcctctgagaacatgacagagaacaatagcaggaagcagccaagcgggaaacaatcagcccggcacaacccatgtggaggagcttcctgattggcttgatctggtgggagcaggaactcttacaataactctggaattatcccagtgggatgacaaatttctccactgaggagaagctgtcacctggtaatgtcaagcacggaaaacacagttagcaaaaaacaaaacaaaacccaagacaaagttctcttgaggaagagcagtttggatcagttggaagcctcccagccactgccatagcaccccatgccgacctccttcctagtctctgtttcaggtacaattaagtcgtcatctctaccttccggatagatatcattctgccgtccatggctcaaaggtcagaggtgctgtttattctttggtgtccttttgggtagtttagggaaatccatgctgtaggtgaccacaagagagaatgttcccttttagaactatattsattgagcacaggctgtgtgcaaatactcttctaggcactgtggatgccatagcaatacatgctgtttctgctttcatagagcagtgatttccaaatcctgtgtatcctatggaaagaccaagccaggcaaggggtggagtgacaggagctcccagtcagctttctccttaaaccacagcagctccctttgatcaagatgttggaaaagaaaaatctaccccaaaaagaggaaatgctgaaaacatttggattgggagtggtttcatttgctcttaggcaggacacactgcagggtagcagttaatattctaggctctagctacaagcagacctgggtttgaatcccagctctgccacttactggtggaaggtcataagttgcttgaactctctcaacctcaagttcttcatctgtcaagtgcgaataacagtagtagatattttaccaagtgcaaagaattgaataatgcttacaaaccatttagcatatcatctggcattgtctattacagtaaatgctcagtaaatgtgaactattttacccctgttgtttgacgttaattttttttcaatgaatgactcattgagatactaactcatgcgtcttgaaaacactaccagtctctccagagtaacctccaatatggacaacaggcaaaaatatggtgattattcccagtttgggcatttgtgaaagatgtggctgaggctgtatggatgcgtgtgcacacacmcacacacacacacacacacacagaggccgatgggaaaatctaactcagcaggaaagctatcacagagcgctggatttaggcacaatgagtaaacagggatttggaagagaggaatgcaccacataaacaattttcacaatctggtatgaaagcccagatgcttcctgcatgaaggggtgaactcagagagcgtcacagggcaaaatgaagtaaatgctgagactgtccatcattctggcccaattcctacatatctgtgcatcttctacttatggttttatttaggtgagaataaataagagtacctcatagtagataagaatagtacattacacacgcgcgcacgmacacacacacacacacacctggggttagatgaaattgtatatttggggaacttggggtaaagagtacagagccacacagcagttaccttctgcatcctcctgcttcagagaaagcaaataagaccagtttctttttaatctgttgtttttactaagtccaggattgatgttaatttgaatttgttcttttaagattcatttttgactgaaagaactgagccggaaggtctgcttgaggctacttccagttgagaaacaatttatgtgttcattgagacagtcatttactcaaccaacacttactgagaactttcaatgaggcaggttccttgctagatacaggccagctagatgctagaagccatcatcaaaggaagatgaaaaagtgatggtaattatcctctagaggtttgtaaactggagttagggaagggagcccaaaatccatgaatgagtgattaaaatacagtgggataaagttggtggtagaaatatgtccatgagatatggcagcaaagaagaagagcaccttcatgggaaaagtccaaagaagacttccataaagagatgatacctgagcagatgctttaaaaatgagtagtaattacccatgggaaggggaagagagagaacaagggcaatccaggcagaggggtggtatgagcaaagtcattgagccaaacaaggaaatcttcatttctgcaggtaaatgagaggctgggagtgtgtcatatccatgagctttagcagagagcccatgaggggttttcagcaggggagtgctattgtggtgtgtctaggcacattctggattttagggtgatggggctgcatagaagcagagagattggttagaaggttgttgcaggcatttaggagagagcctatactagggctgaagagaagcagctatgaaaagagatttgtggggcaaattggcttggtggctaataagacacttagttgacctggtgactaataagatacatgtacgtgatgatagtaagcgagggtcaagccagaggtgaagacaacatctaggtttccctcctaagtagaatggattaacggtggtaccagcatctgagctagagaatagggaggagcagctctatggagaaagatgagtttggtcctgtatatgttgtgtatgtggaccatccgggtggagacattcaaaatacaattgtacataaaggctggagttcaggagagatgctgaagatatagtttggatagatttaagcatgttcggtaggaattaaagcatgaggctggacatgagtagccaagaattaaatgttaatcaataagaacaataaaacaaataaacctttagtggtagagtaggagaagaggtgcccatatggagaacatggcgtcatggtctcttcatcatggaggaagagtgatcaaatatgtttttaaaaacgaagaagtcaaacagatccacaccaaagagggtccgctggacgtggcagtcatggacttgactaggagcagacgcagcagggcatgagggcagagggactgaggctgaggcatggacttgactaaaagcagatgcagcagggcggtgagggcagagggactgaggctgaggcatggacttgactaggagcagacgcagcagggcggtgagtgcagagggactgaggctgaggaggggtcaggatgtgaggatgttgaggcagtaagagatgactggccttggggaagtctggaagagggattcagcagcaactagaacaggatgcagggtcaagagaagttcacttatttttagtatggaaagagataattcttgtttattgactagcaggaaggaggcatcttggagagaggtgaagacacaggggagaggggatagttaatggggtatcctcccagatcagtctgcacaagctcaggtgcaggggtggaggcgctggccttcaacagacagtctgagtcagaggctggaggtcagaaggtgtggctggatgggactttttctcttcctagaaaaaagggacatttttagggggaaaaggagggggtttaagctattgagaaaagtactgctttgaaatgaaataatctcactttcctgtaatcaaaactctttatttctgatgaaacagactcaaataagaatcacaacaaagaaatcagtgctcagctcaagcctggaaatgatttcctacacggaaatccacttgcacagattctgatagtgtgagtcatgtgattccagatggagtaaatacacatgaaaaggagagaaaagctggtgtctccatgggctgaagcacacttatggagagagaaattttcatttatttgtatttgggcttcaatatgattacatcaccatcaataatgaaaagtgctgccatgtcccagctgtatacttagatcaagatataaatcagtccaatattgttcttttttctcactgaatatctaaatttgtatatttgaggggaaagtagaaaaaccaagccaagattttaaaaattacatttactatcaccatctccaagttacattcactatagaatcctttagaagcatgttcttgggtagctttgctttttatgcactcaacaaatatttattgagcatctgtatgtacagggaagaatgtgaggtacagtaacacaaaatatatagtcctatctcttaataagcctgcacttgggagarggtatagatagggttgggaaggataaatatatttttaacactctaatacaaggcagagtgtaccaaaagttagaaatgctgtggagaatcagaatgaatgaacataccaggctgggttggggggctgggggaattatggaaaacattcctaaagagatgtaatttgatttgggcttttattatgatatctgttttcagacaatggagttgagagtggggagtccttcctggctttgtcaggagcagtttgaggtcttggctgaagacaggaaggcataaggctggaaaggggtgggagcagaacatggagggtgtgaacttccagccgaagaagtttgatggggtttgggaaggaggtgagagggagccaccaggaaaggatgtgagctggacctttggaattcttaaagggacccttgtcttctctgccatatttctgtctcagggatgacgtgaggaaaaaaaaaaaagaggaggaaatgggcttgagtttccactgacaccttacagtcaaggaaggccctgttctttcataaggaaaagtggaaatcctctgtttacttaagggccattaacatgttttcatattaaaataccaaatgatctgccgtgactccagatagactcatctaaataaaaggaagctgtttccttacaaattgagtcacaaaggataaatatttgtggagtgccatagaaacaaatgcgctgtcttcctgaaatgtggaaaatgaattttgtagcattgatttgcatgaaaacaatattcttcccagtgttctacctagaatattgaaatggaggtattaagatagatgatagataggacagatagattgctagagagctagattagatagatagatagatagacagacagacagacagataagatagatagatcgatgaggttaaatattcttaggatggaagaaggggtcagataatcacatctcagacagatctggaattccaggcagcaggaactaatgaagtggtctcttcagagttttaccatgggacgaattcacccccgattagtttttattctttgagtcacttctctcaagacaaagatctttgggcaagagttcagttggcctagcttagatatgtttctactccttggccagggatgtgagccttctgaccaatagtttcaccaaatctacaaggaaccctagagagacttttttcccagtggaggagctggatgttgttcctaaaagaaaagggcagagggaccctgggcaggcaaaattttcagctgcctgccaccttakcccctgtscccacactcacttytgaaccacatgtgatcagtcttctcttcccaccacataactgaaacttcaaggtcatgggtgagctctatgttgttaagtcttatttataggagcgatcagctcgctgcactgcaaggctggaaaggtgtttaaaatgtatacttaggcatgtcttggctctttctgatataattcagctggcaaaggctctggcaggaagccagacggacacaaatagcgcaccaaagagatgctaagacatgggtgattataattgtgcaaggagtagaaacttctctgctgagactttggatgtggcagagatttggggagtagaaggggggcaaagcacagttccagccaaccccatttacaggcgttgattagcagtaatgaattcacaaccttgcaattgctcatttttttttcttctgctgctgagtcatggataagactctaagctctgattagctgtgatccctaattctcagcacaattctaagagcattccttcaaattcaacaatatgtggtaagtgtcttgtattaattaggattccatgtggatgcaaggaacagagacccacaataacagtggcttaaacaagatgcttatttcttttttttttttttttttgagacggagtctggctctgttgcccaggctggagtgcagtggcgcaatctcggctcactgcaagctccgcctcctgggttcatgccattctcctgcctcagcctcccgagttgctgggactacaggcgcccgccactacgcccagctaattttttgtatttttagtagagatggggtttcaccatgttagccaggatggtcttgatctcctgacctcgtgatccacccacctcggcctcccaaaatgctgggattacaggcgtgaaccaccgcgcccggccaagatgcttatttctcccttcaataaaaatccacaggtctgcagttatgtaaacatccacaggcatgcagttaagagctgtttggtggctgtgccctgtgaattccttagggacccagacctgttccactttaaccctaaagactgatccttgtcaacagtgaccaagatggcagtttgtgcctcagctgcatacatgtgcatttcaggcaaaggatgaagaaagaactggagaagaaagggctaaagaagattctaggagctgacatatagcactttcacttacatgcctttggccagagcatgtggctacaaaggatgctgagagatgtggcctttactctgtgtggccatatgcccagctcagccacaggaatgacattgctttgagagaaggggaggatggaaattgagcaacttagcagtcccctttccacttttacttgtgctgaattcataaacatgtgggcagctttcctctcctctgagcagcaaacacttcttctgaggttcttgttttggcaggttggccagacaggcaccccacttgactgctcaactatgaaactgcagttcyagagaagagaacaggtctgaattaagcaccttaagccagttggtcagcatctccttttattcggagagtagttactgagattcaaacccatgtcaactgagtagcaatgtgtttggctatagggtagggcgtaaccctagtctatgtctctcaatagtgagttatttcataaaggctcagcccatcgtcaggaatatgctggtcttgcgtaagcctttttcagaagtgttcatagggtcctgagaattttgtgagcacttctttactgcttctcttgcctcctcttttagttggtgctgagttcactgcatgaagggtcccaggagtcctctttccccttggtttttctactcctttccttttctgctctttctaccacctcctactgctggrcctctttgtatctgtactccaccatggaaaataagttttgtttgccccagatcttcccatttcccagagtggagcctttataattcatgatgtttactaaacttgatctctgccctttcaagggatggaactcagataatgaaagatatagggagggatacattgcttaaatctgtgagtgggcattacgatgggcctaagtgtcccaagagggattggcttgccatgggaggtggtgagctccccatgtgtggagaagttcaagaaggtgtgaaataatcgttgggtggaggacagttcaaggacttcatgtttctggagagcaattaagttcaatggcttctactcccagtctgacctgtgcttctgtgagcttgaaaaatatatattgtgttgcaatgtgcattctttagggaatgaaggtaaaagggcaagtggtcatgggaggatgtcaaggataggggcaaagggtactggttccccagccagaccaccagggtccaaattctggctgcacatcatctctgcaaccctggacaagtcagtgctctttctgtgtatccatccatctgtgtcatgggagttgcagatttttttacttcatgggatattgtgaagattaagtattataatgtacgtaaaacactcataacagttccaagcacacagtaagcactcaataatcctaatccttatgattattattgttacatatattactgtatctagcaaaaacaatattagaattgttagtattataataattattatcatcattgatggggaagraaaaatgaagcccacctgagttcacagrcaagaccctctccaaacagtaaaacaattaaaaaccaagttgtatttgtctgtgctcctttggattcaactgaccaacacccaggcaaagggaaaatatattggcttgctttttttttttgagatggaatcttgcactgtcgcccaggctagagtgaaatggcatgatctcggctcactgcaacctctgcctcccaggttcaagcgattctcctgcctcagcctcccatgtagctgggattataggcacctgccaccatgcccagctaatttttgtatttttagtagagacggagtttcaccacattggacaggctggtctgaaactcctgacctcaagtgatccacccaccttggcctcccaatgtattggcttttgtaagtaagaagggcaaaggagtagctgaggatctgggaagcaggaactggagattgaatggcacgggtccccagcagccagcatgctctgtcttcccttctctttgtttgggccttgcaggaaggtaggctctcagcagagccttgaaggccaggtatttgagagccaggcaagtgaagcagaaggagagcatgagtgagccattgggagtggggacggaaacggcgagaacctatccaaggcaccgtgctgagctatgaagctggagggcagcgcaggctgtgacccaaaaaggccacacaaggccacatgctcctgagtgacaggagggacatgtgatatgctgggccttggcccatgctgtctcctctgcctggctcattttctcctcttttctacctggtgaatgcatccttcaaggcccagttaattcatcatctactttgtcgagtttttctcaccacctgtatcagttgagaattgcattyagctatgatcacaacagaggcttaagcccataacaagcaatctggagccaggcattccagaagtggtgtactctttccatcgtgccctctgggacccaggcaatgtctctctttctgcacactcagacatactattgcccctgtggacataggattactgctctgcctatagcatcatatcccttgcagtaggtagaataatggacccccagagatgtccacaggctaagcctcagaacctgtgaatatggtaggttccatggcaaagaggaattaaaattacagatggaattagagtttccaaacagctgactttaaaatagggagatcagtatcctggattatctgggtacactttgtataaccacaagatccttaaatgtggaagagggaggcagaaatcagaaggaggggtggctgcagggaaggtcagagagatgcaacagtgctggttttgaagatggaggaagggacccacaaggcacggaacgtgggtgacctcagggagctgaaaagggcaaggaaatggattctcccctagagcctgcagaagggaacacaacgctgccagcaccttgattctagcctggcaaaccccgtgtcagacttctgacatacagaaatataagataataaatgtagattgttgtaagccactaagtttgttgtagttgttatagcaggaattggaaacgaatgcgtctctttagcaccaggtccctgtacctggcaggaaggaaggaaaggcaaatgtcacttaagccaacgctcctttccttttttttttttttttttttttgagacagggtctcactctgtcacccagactggagtacagtgttgtgatcatcactcactgcagtcttgaactcctgggctcaagtgatcttcccaccttagcctccagagtagctagaactaagggtatatgtcaccatgcccagctaactttttattatttgtagaggtgggggtcttgtcttgccacgttgctcaggctggtctcatcctcctgggctcaagcaatcctccagcctcagtctcccaaagtgctgggattacaggcatgagccaccgcacccagccctcctttcccttttagggagttgtgtggaagtcccttcggatcatttttacttacatctcattggccagagctgtcccatggccagctttatcttcagtggaagctaggatacataatttttttcaggtgggcatgttgccatccccaaccaaataaggattctgttagtttggaagagggggagaatagatattgagaagascactcagcgtccccaccacacactcccaggcagaaccaactattctacagcatgttgttctttcctctattattgctatttttggtttgtattgtaatttatgtgttcacatggctgtttgcattacttgaccaagaagtctcatgagcagacactgtgtctgatttatttctccatccccagtgctcagcatagtgcctgatacagagaaggtgtttgcatgaagttagatggatgaatgtctaaataaactttgaaataagagcatgatcgatgcacttcccagagcgagagttcctttctgttttcttgtgaggatgatctattggggttaggtacattttataagaccatttggccatgattgcaacctcatctccagtaaattaaacctacacagctgcagtgtgtcacctttccttatggcttattacagtttgctttttgctcagaaggaactgagcaagcaggttagaggctgttatgtgcacctgccacagcctacggatcctcaattaaccttgcgtgtaaattacacttcctgcccattctttatttttagcacagcaacatctacttggctcttccagagaagactgcattagatttcagtcatgaaactacaaaacagtggcgtctgcagcctggctgggatgactgttgttaaccccatgacactctgttccttgsgaagctgctttgccccaggactcaggttttcctgagaaagagagcagcctggactgaccacaccctcagagcctggcccaaggccacatgtgaacttatagaaaaatctgctattggatctgacataaactctccatttccttcattcattgcatttgggttgaaactcagttgttgttatcacaaaggtttcatttcgttccttttttttctctccctctctcttcgttccttctcagttacacagtatcatgacccaaatctttagcacctgaaccatatagcgcagagccttgaaacccatagggccagggcaccccgtggagacaggccagccagtgggcatcaggtcgcagagaattcttaaccacttaaggttgcttcactggaagaagtgagttactgagagacagccattttcggttttagtcagccatttttatcacgatcttgtttgttttagaatcccctgtagtgcctagctcggagtccaaccaaacaagctccataaatgttgattttgaatttaaatagatgttggggtgctcccatttccccttcactagacacatgggaagctgaggccctggcccctctttcatgccacagcctgggagatgctgccttctcagcagaaagcctcaggaggtattttgaaaagggaatttgttgttttcattctggttagataagttacaaactaattttttaaactgggaaaatattgaaaattrttttttaaaaatgaaatcacctttaattccattactcagagacaactatcactgacatttttctgttttttcagtcttaattctcatgaaggtgtgccctgtttccctccagatttctcagaggattcaggattagggaagggaggagagggtgccttatgttctttctaatcgtttagctttgggtattattgggatatatataaatacattaacacacatataaatatatgtgtatatatattatataactggcatatacattattgggatatatattagtaggatgtatatatatatatgtgtgtatacatatatgtgtgtgtgtgtgtgtgtgtgtgtgtgtgtatatatgtaaaatgtatacacacttctatttgacctgtaccagttcattattaccacaataatgctaactaacacgccctcaaattcagtggcttaaacccaaagtcatttattcttgcccacacttctgtgagtaggctgggtatttgctgatctaggctgggcttagctgagtggctctaatttcaggtgcttctgaactatatagctgagagccctgaaacccatagggccagggcacactgtgcctatctatgggtttgcctcaggtctattccatgtgtgttctttctgtggtccaggctgaaggggcagcagctgcccagataagttattgtcttggcattggaaggggtgcaagaggacaagctcaactgggcaagcacttttcaagcctctgcttgtgtcttatctgctcacatcctattggctaaagcaggtcacatggctgcggccagtgccaagggactgggaagtgtaacccatctaccataagcctagagcaaatcacatggtcaagattgacatcagtggcttggggaagcatgtactcttcccatggaagtaagggaggaaggaagggaatatttttgagaataatgtaatcttttttttttttttttgagatggagtcacactctgttgcccaggctgaagtgcagtggtgcaatctgggctcgctgcagccttgcagcctctgtctcctgggttcaagcggttctcctgcctcagcctctagagtagttgggattacaggtgtgcaccaccatgcccagctaatttttgtatttttagtagagacgggctttcaccatgttgatcaggccagtcccaaactcctaacctcaggtatacgcctgcctcggcctcccaaagtgctgagattacaggcatgagtcatcgcaaccggcccaagaataatataatctactgcacaccctaaatatctgctaaagtactctgtactttgagatttaaatcaaatctgctcaggccaggtgtggtggctcatgcctgtaatcacacctcwaataaataaataaataaataaataaaacctgctcagagcccacctggttggtagtatcatccagtctacacagggaacctctagtccagagctcctctactcattgaattaattcagtttctggataatgtgactgtctcgtgtgttgttcctatttcacactcatgtctctttacttactccccccaaaataatttacacagatgtgtgtagaagattttgctgaacatctggaccagcaaagaagttttacatctttatgttcgtatctctagattggccagccccctctccataaattctctttgcgtctcgcccacacacagcctctcaagttaaagcttgctgaagaattcactcttgtctccaaaattctgaaagtcttatcttggctgggccacacctttgcgcaacttagctcagctttttaaattcattcaatgtaggtgtattgagcatttgtgccctctgtctgaggaatttataatctagtaggggaaattaataatgtatgttactatttggggccagaaaattctttgctgtagggtgccatccggtgcactgtgggatgtttaccagcatccctggcctctacccactatgtgccagtaacaccagtcccacccccttgagctttggacaaccaaaatatctctagacattgctgaatatcccctgagggacaagatcacctcagttgagagccactgctctaatatatggtagacttgataagacttctgataaaacaaaataatgtgctaagaaatgttcagagggaagcgatgttatttcctggcagtgaaatctgtgaacacctcatgacaggtggcatctgagctgagacttcaagaatggttgggagtttgagttgagtttcctagaggaggaaaagacatggggtacatgtgggcaaataagagtggctctatttgactaatgcatgaagtgaaataggcatgttgttagagtggagctgataggtactgggaggctagataccatggggacttataagctgtaggacttctacttttaccctgagtgaaatgacaaatatttcagagctgtgttcatttggaggaggttaatttggatatagggcttgccttcataacccaaagtaattgctgcaaagattatccctccagaggtcacttttctgacacccaggaaggaaacagaaaggccatctgaggggcacagtatgtcgctaaataaattcatgcctggatcttggtgttccttacctttcagaaaaccccactctgaactccttattttaggtctaagtctaatggccagttcccgagagcagattaaaagatggaaaaagagggccaggcacggtggctcacgcctgtagtctcagcactttgggagcctgaggcaggaggattgcttaagcccaggagttcaagacccacgcaggcaacatagtaagacctcacctctacaaaaaaaaattaaaaattagctgggcatggtggtgtgtgcctttagtcccagctccttgggaagctgaggtgggaggattgcttgagcccaagaggtagaggctgcagtgagctatgatcgtaccactacactccagcctgggtgacagagtgagactctatctcaaaaaaaaaaaaaaaaaaaaaaaaaaaaaaaaaaaagatggaaaaggaggaaggcaagggaggggacttatataggcagacacagactcagcagcaaagcttccagcacaacagaggggaaagagaccaaaagaaaaaatgaatgaatgagtgattgaatgaatgaaccaatgaataaattcagatcaaataattcaagaggcacagcaatctagagttttagcaagagaacatttatcccttcattcttcctgaagacattgctgcatatcagtgccatcctactctgccaatatatgtaatgtttaacaaggtgggggatgtggagaacactttagatcccatgtggtaagagttgctcaatggttaggaacagggtctagagtcagagcacctggcttgaatccttgcttcaaggctctgtggcactaaagcctgctttactaggttacttcaccttgccaagccctactgatctcatcggtaaaatggggattccctactcacagggtcattgggaagtttggataaaataatccacatgaattcttagctcagttcctggcacagaataagtgctcagtaaayackggtggtarttattatcatttcactgaaagaatatggctgttgagactttccccaaatcatagctgcagctgctattctggaatatttccagagtctcctggcagtgctgaaatttcccttttataaaatacataggatggctgtgaaaattgaggaaagttccaaaaggcaggggcagttgcatctgtcttcttcatttcccttctttttggcagtagaatccagaccacagagggagaggacaccaggctcccaagggtactggccaccagctatttcttggcaacatacttcctttgagcaagaatggccctttactttttgaccaacctgagagagcacttactctgagccggtcaggagaatatgaagctattttccttctgatgttatgtcctatgctatgtaaatataatctccctccaaataagaaaggtgcacatgcatggtgttggcagggaaacatcgaaacatattgcatagtggtggctgtgaaccagtggaggcagtgctgtgttgatttcccttgaccaatgtctgcccagtggcagagctggaaacacaagatgctgtgtaatgtaaaaccttggcctggctcctcagcgtaatgtaaaacaaaggctgccaggaaggtacaaatcgcccaacaggaaggagctgctctcttgcccgtggatggcaggacaataaagtaacttgtcctttgtttgtgtgttttccaggctggagcaagaaatacaaacgctagaaagtgaagagtcccagatatctgccaaagagcaaatcatcctagagaaactgaaggaaacagaaaaatccttcaaggactttcagaaggtgaagaaaaccaaaacgatttctcaaagttatttccatggggaagtagggcctagcaaaatggtgctaactgggaaacaggccagtgggcattgatgagaaatctgagccacgaactctatgaaatgaggggcagatgtgtgaggaccaggggccatcctgaagctaagcatgacatatctttgggtgtgggaccatctggcctgctgcaaggcatagggaagagtcattagattaccccatctgcctgctctccggatccctgatatgccttgtgcctgaaaagccttctcttattggactctagaattctaaaaccaattctgatgaagcagaataaacatgctctttgtggctttaattatagtttgctttttgagtctttcattataaaaaggccagaagcaacaccttatgaagtggacaagaattccaaatacaaagagtgtaaatacatgacattttactgtatatagaaacagatggtgcctgtaatcccagcactttgggaggcyggggcgggtggatcacgaggtcaggagatcgagaccatcctggctaacgtggtgaaaccctgtctgtactaaaaaatacaaaaaaattagccaggtgcggtggcaggcgcctgtaatcccagctactgaggaggctgaggcagaagaatggcataaacctgggaggcggagcttgcagtgagctgagattacgccactgcactccagcctgggcgacacagcaagactgcgtctcaaaaaaacaaaaacaaaaaacaaagacaaacaaacaaaaaaacaggtggtgccgtgtatcaaagagtagagtccgtaaaaccagtaggctctgaacaaacatctcaggacctccctccattttataactgtttctgctgtacctatgagtgacagaaaagcaatctaatgaaatcaatttaggatgggattttctgatatcattctccagcatgaccaaggatatttgctagatcattgaaataaatctctattgggagaaatttagtataaattgggaattataattttggaattctaaataaattgtccagaagaaaagagatcgttgcgtttccccagcacagtcaaattctgggctggggcatgggagaaagatgggttaagtctttaaagatgggaaaagatgggattgtacccccacatgkagagtaacgctctgccttgtttttgttcctacagggtttctccagtacggatggaggtaagtgctctctgcccckactgtagatgaatgttttaatcctggtcagcttagggggtttcattaacaggggcttaaggaagaggtactgtgttgatttgtaaaggcatcagaagaagtagcagcgctggttgcaggccactgaggaggtccacattccaagccttccctgcctctcttcttcaggaactatctcttggctcactgtttctcctcttacaaaattggcctggctcttctccttcccattagtcccaacactcactgcttgggcctctcttgaaaggtacccagcaaagaagagtactaacatcaggacctggtcccttgtagggatgagcccatttgtcttggtggttaggtcctcaggttgaaacatacgtgagaagtttaagaaatttggggaaaatatttggtgtttgggaaacctttctacagcctctggattttctttgctttctctctctctctctctgatcagacaactgtcgtttctttcatagaaacagggctgggcaaaaacttccctccctgtgtgggatagttggttcagagcataggaaggtaggagtggggtcctggcttcctggtggcaagagcaggtctttcaccttctctaccttccctacctttcctctgtcctctcctctccttacctggactgtggggatgaacttgagattgtgtacttctcacccttcaccttgctccctatcctcagctgcaaacccatgattcctactttcatttggccctcagctagacctgctttacaatgcagggacttgttggaaagaccagatattgtctgctcccctggctcttagaaagtcacattctagggctgggtgtggtggctcaggtctgtactgccagcactttggaagactgatgtgggaggatcccttgagcccagaagttcaaggctgcagtgagctatggtcacaccagtgcactccagtctgggtgatagcaaggtcttgtattaaaaacaaacaaaaaaggtcaacctctagactaggaagatgatcaggagccaggataagaattggcatcagtgttttcccagcgtcatttggaaatatacggggaaaggtttaaaaatgtgtttctctggattagtcaaaggtatttgcatgaaggatagttctgactttggcaaaacaaacaaacaaacaaacaaacctgtgatttttaatttttttttcccctagcaagagacctggattttgtctccccaggtgatctttaggaaggtactaaattaaacttcatgctctgagtacatgtaggcagggccaagtcatgtccaagctagcaaggactctaggaaaagcggacctacaatacttctaggaagtctctatggtgtgaccaagtcagggcacttgttctgtgctttgggggtggggcacggattgaggaagtggccttggggaattgtgggtacagcatggggaggatggcaggcttccctgagtctgggaagacctgaggcatgccacacaattagcaataatacagtgcatgtcaggctgggatgaagtgtgggacactgacccatgaacacctacccaaagagtgcatgtcggccttttatgctttcactttttttttcccttcccttctcaaatcaggaatttccctagacatctctctgatacttagggaagggaaagaccctgtatgtcatgttcctgaggagtctgtgtggggcatggagacctgtcatactctgtgacttgttaacaagcaaaaatgcagccgcatcataaactctcaccacctctttcatttttacctcaaacttctttcattttcttctgcattgcttcccattgttttcacttatccacctaagccatttgtagaggtggtaagaagcctagtcataactgaaaagagcctgcagggaaagttgcccacagactccatcctccaggatgggggagctcaggcttaagaggatgcaaaagtcttagggatctcatttcttgggaagtggcccagggaagagtttccgtggtcttacctgtcaccctgcattataattcctgccatctgtggttatcaccaagcctgggtgacctctttatctgtcataccacatctattagcaaagaaagaagtttgaaggcgggaacacatacatcccagaatgtgattgatgtatatagagtcacaatgtggtgaagcacatcccagttgagggactttgggatgtctctttatcttctcattcttcaatttcaaaggccccgagttgccaagaccctcttagaatcatccaacttgctacaaaaaactaaccagatattattatagaacaatggtgacttaagaaacacagttaatttctgatgcgtgcagattacagaatccaggtccagttaggattatgtaactatacagacactgcagataagcagcaaaagcatcccaactcgtgaggtgctatgagatagctgctggtgtctgtgtgtgtaatgaccccatctcaggtaacctaagtgtgtccctctatgcatggcagaggaaatagaggtaccgtactgctggatcaccagtggcttttgattgcatgatagcctgggcaatcaagaacaatttattctattcttgagtagaatctcctggtcatatacattctgacacccactctcctcccccgccaacacacactgttgttatatagcagaacgctcatctattgggtgggttggttttcactgtcttaggcataatgtcttgtacacctataaattgcatatagtatatatctggtgctaattctgttctttacccactgaggagggagctgatgcaaaactcttgccagaacaggcaaaggaaaatgtctgtcctgggcctatctcagtccttggtgtatgatatggatcttcttaggttcccatcccataccagtctgtggtggcttagagcgtttcccacatcaaaaccttcataccagttattcgcaaacctcaatcttcagttgcctgtaagttatgtgtttgtttgtttgtttatttattttgagatggagtttcactcttgtcgcccaggctggagtgcagtggtgccatcttggctcactgcaacctccacctcccaggttcaagccattctcctgcctcagccccccgaatagctgggattacaggtatcagccaccgcatccagcctaagttatgttttaagaagagttttcatcaatttgtttctctggctttagctgtttagattcttcatagctactgtaaatatttcagcgggattagaactaagaagcagcactcatctttaatttctactctataagttactgctttccaccttctctgtcagtggggagaatagtgttagactattctgactttggcaggaagagggcagcttattaattgaggccacctgaagaagtttttcccattgaagttttggcaagcctgtttgttactctttgtgctggcctatcagacacttcctgtctatataaccttagggtttagtacttaatcatatattgagggggctgctctgtcctctttctgatgccccattctccactcccttatctttctctcgctctcttttttttttttttgagtcagcatctcactctgtcacccgggctggagtgcagtggcgtggtctcagctcactgcaacgtccgcctccagggttcaagcgattctcctgtctcagcctcccaagtggctgggactacagacacacaccaccagtccaaatttttgcattttagtagagacagggtttcaccatgttggccatgctggtctcaaactcctgacctcaagtgatctgcctgcctcagcctcccaaagtgttgggtttacaggtgtgagctactgcgcccagcccattcccttatctcttaacagaagccatgtagcccaaccctctaagtgctgtagacttcaagcttgtagccagtaaacatctggcaaaggtaactccatcatccattcccatctggcagggagctatctcctggaggaggctgagacataagccctgggaatcacatgttctttcagatggaaaattccctgtctgtaagtagtttttttttttttktttyttttttaaactgctaaaacattgagtatgcagacacacatgtgaccagtccatgagatctcacatgggctccagcctccatcttatttgaatgcagaaagtcaaattcaccaagatcccattccacagatttctggaaattatcagtgaatcwtggaagttctacaaatctgctctggtcatcccttctttcctaaactgaccctctagtcctagattactgcttcactcttcccacggacaattgtcacccacctgcccctaccccctcaggactactgacctcaaggtgctgctctttctagttctgccttgtgctgctttggggcacagacccttcctacagccttccacagtgggaattaaaggaaagagaagtctgtgacctaagtttaagaatcatggaggtggctcacgcctgtaatcccagcactttgggaggccgaggcgggcggatcatgaggtcaggagatcgagaccatcctggctaacacagtgaaaccccatctctactaaaaatacaaaaaattagccgggtgtggtggtgggcgcctgtagtcccagctactcgggaggctgaggcaggagaatggcgtgaacctgggaggcagagcttgcagtgagctgagattgcgccactgcactccagcctgggtgacagagtgagactccatttcaaaaaaaaaaaaaaaaaaaaaaaagagagagaatcatggaggtgcagttcaacatggagaataatgcacaacttcagacatgtggcttcactcacagcccctgactcaaatccaaaaccatcttcagggggtccctgcaggctgctttccagccatctcccagcccaccatcatctcaaaggctcaatttccttccttgcagtgaggggtgccttcaaccatgtctgccttatccaggatccaagctccaacacatataaggcacctgagagggaaagcaacttgagcctcactccaccctaagtcctgctgttctaatcttcctttctcattccttctccccaaatggttaatatggaaaaatctatttttttttttttgagacagagtctcactctgtcacccaggctggagtgcagtggcacaatcttggctcactgcaacctccgcctcctgggttcaagcgatcctcctgcctcagcccctctagtagctgggactacaggtgcatgccaccatgcccagctaatttttgtatttttagtagagacggggttttgccatgttggccaggctggtctcgagctcctgacctcaggtgatccacccgccttggtctcccaaagtgctgggattacaggcatgagccaccgcgcccggcgaaaaatctgttttcttagcgatactctacctttgcctatgaacataatggtctaatgtcaatacattctggattgttcagactcatttgcaagtcagaaaagggtctggttggtctagaactgaactaagcctagtccagtgtgtgtttgcaatcctcttcagcaagaaatgaaaaagaaagctgctagaatggaagcagtacgagtggggatgcagaggaggggtcagtgatgagaaatgcggaggattttgaacagaggcagaggctattgaacagattggataccagcagggggaagagtgaagggtgctgctgaggatcccaggtgaactgcagtgctcgtgagccaagatagaggacaggagaagcagcaggtgagcagagatacaaggtccattttgcacatgttgagtttgaggtgattgtgggatattcagtatagacctacagtgagcagttagatgtaaccattgatgactgatggacgttccaggattttgtgatatggtcgtgatgcaaggaagggatcacatctcatggtgcccagctttcyggaatcttcctgctttcactttcccacttctttctggggtgtacccagatttgtcttgtcttacctcaggggtttcctcctttcctctgataccttggcatgcttgctaatgttcatgctccccatgtctcacctccctaaagaggcttgtcgaggtatttgcccaagcaaatctaatgggctccttcttttacatagcaacattccctgcaactgggctaatggtgggctcaaggggtattgtcatttagaatctcaggactttctagctgaaacaccagcctgcagtattgaaaacatgagatcaattctgaagtctgtttatttgttgtaatgcatataaaattggtcttttgaatgaatcaggctcataaagctatattgccagttcagggaatgaaccccataataatcagacacagaaagctttatttccggttcagagaatggatctgtttttcagtactgtttaatgtacatttctagttccatgttttctatttgtcaatcccaccaagttgataatggctcccacaagcccatctctgaatcttccccccgtccctgaactcattgtcctcctagaatctagagatttctgatgactcttctaatacatagagccatcctggggcttgagctctctggccaggatccctcctgcctcagctactctgctgaataccagtcactgggcaaatgcttgtctttgtttaccctgatcctcctgttcagtggccgcctcagcggtccattatgtagggcagacaagctgctgtctcggcagtgaacccattgggcctcccaacactgtgactaattgtattccctgttctctgctaccagatgcagtaaattacatttcctcccagcttcccgacctgccaatcctctgttcacgaacagcagaaccatcacctgggcaggacgggaccagcagagcggctggtaagtcctggggacctttggacgctaggatggtccaaggggcttgcatttcactgagctttattaatgagatgagtgccctgctatccttacatagggggagctcaccttcagcccagcctcagatgcagccttcacagtggccacacaaggcaggcaccggccccagatgggtaaytgaggaccaaatgggaaggagttctgaggaaatcatacggcatttcacctccgacttcgggggagtctttctttggtgtttgtggtccttatatctgtgtttattctcaaagttaatctgtattctgcctccagggattttcattttcctcattggaaatatacaaattgagagagccatccatgatggaagctggatgggaaatattttcaaagcctgtggtatctttacagaatcctttgggaattgtgctatttgtatattatgaatacatatattcctaagtcttcccatttctggaattatttcttagccactgtggtatatttgggaggaaaagaagcaatttaaagcacacatgttacttgctaatgtgtctcacaattggaaattttacaaataatatatttatgagtgttgagtgtagggagaaccatgctttgctctgcttaatgcagacatgcctcagaaatcagaactggaaggatgcaagcaataaatctgtacacgaacccttatgatctacacagaaatgtgctgagggctgggggttaaatggaaaaatgaattgcccaaggttgcatggttagttacaacataggtgacttcaaatatgagtatcagattctgctttgcatattctaggtaagtgtatgtttaaaataaatcacataatggcagattttttaaagtaaaacaatcatggatgtttaagccagaggatatcttttatataggccaacctgaatatttcatgaagcaaagaatccctacttattttaatacaaaagtaaaataaaaggcaagtaagaattaacatagttgtcacgtccactggctaatttaaatatctgttgggcatctctgtaaacatcttagcagattacttttatgtacagactcacagagtcctagagatggttgggactgtaagtggtatctggtcaatccagagccagttccacatcttcctggacagtgacaggatggataaacaggaacctgcaacctgcagttatgcttcaaaggactcactggcagtcactttaacattggactctttaagtactccagggtacacttctgaggtacacttctgaggtcaacttaggtaaaatgtgtttaagagtgacaccccttccctctggttattagagacatgggtgttgatggctcctgatagttgtgggtaaacaacttctcaggtcctctgcacaagttcctgcacttcaaaggacacaggatatgatccaacatatggatcagcttatgggagggtagggacaatgtatgagaaataattttaagagacagaaaaagaatttgagcagtgtgggtagtcaaagagtttaaagttcaagagtaacacatgaatgtgattgtagtgctgtgtaagcagcaatacacattattaccacaacccagctccctttatctttgaagatcctgcaaaacatgattttaaaagccaatgcattttcaaaagtataatgtgatcagaatctttttcaaagtaattttacatatgtttctgctgattagttaagagttaatttgcgtaaatgcatctactgtgggattacatataagcagagctatggaaggaattgtatttgttacgatgaactcctttgtccaggctgtttagggaatgggatgttcagattcatgatcaattatggttaatggtgactacacagagcatgtgtggcttaccaaccaagggtactcactagaattctcctagatacagtccatcttgctttaggaatgtccttttggaaatttatataacctcagggacattttgacaaatgtcacttgtcattactgagtagtataacaaatatcctggttgtttggcgtttggaaggtttgggactctgtataaatgggaatttatttagaatcattgcttttcagaattaggagacatctattccaatcctttatccaaacattgaatccttaacatagcagccctgtgaagaggtcctcaaaccctggtcacacacctctgtgattcatgtttaatcttcctccaagtttcccattccatctctggttggttctgactattgggaaattcttcctctgatggagccatcatttgtctgccttcatcatccacccacttatccttatcctgcaccctggagctactcagagcacatctaagttctaatttcccttcaagtgtagaaagtcactgttatttcctgtttttcccagatcctcactctaaatcccctttgtgctcacagtcccagtctctccagctggtattgagatgatgagattgcctttagacaccctccgccatccctgtccctcccctctgcacgctcttcacttggttgctagtcttcttgatgtatcatgctcagagctacccaatgccttcagagctaggctgctcacccccaaaatagagcacgacgctgcagaccacatggctgactttgctggcaatgtggcctttcagcttcagttttgaaaggcctcaaagtcatttcatgtgtgccactgctcagcctcactccgtttatccatagaattgttgtttctgagtcatttcagttgaaatgttcagtctgtttcccctagctatacatatactacttcacctgttcatacatagaaggacctacagaattcttttgttttttaatctcgaaagacaaaaataagcatgagctatgcacttttctgtcctttgtagatttgctatgactattaaatttcttcttgttagattgtctctcaagaatgttgcgggtttcatggaggcactgaggaaccacagcaggaagtgggggaagggaatgatgtcatgggatttgacagggctctgacattccctcccatttcaaacacgcgcagttcctccatcctcatgtttacatattgtgtttccacatcagatttcacttgaatctaggcctcaacaagttttgaatgtagaaaaccctcttctctattgttagggtctttgtagctcatgattatggtatcctcatagcctcactttgcttctcagtttagtaccccctcaaatctgaaaaagcaatcttttattattttttatcatctcattgctaaaaatgttgcatgttggaaccaaagtcagagccctgtggcacaccattagagatctcttggccctcaataaccctaaattgacatctttggggtatgatcatgcaaccactaacaagttaattgtcttaacacccaaggcacatgtttctgtgtagtccacaggaatataagggattttgtgataatccaaatactctggatcttttcaaatgcaatttgcctattctttccagagaccttgaacagaaaagaaaatgagattaatctgcatagtttctgcttgattaacccatgctggctcttagtcatctctggtctttgaagattaactttagaatttagctagccatgatgtcaagctccttcgatgtagtttagaatcccctcattctcatttttgaaaatcagacctttgagtgtcagcttccagcacctttcctgatgttcaagattcttgagacaaattcaacaagggaactgggaccctgatcccaaagcactgagagcctttatatccctgcagtgctatgttattttccaatcttctctgctcatctgggcttcacttccctttctgccactttctttctggcactttacaggctgaaaactctccttcttgaccaaaaatagaagcaaaatcagacacaagaaattggcttgcctttattatccatcaacatcacacccttgctgacttatttttgttactactgaggtgtcttggaaaaacaattgattcacagaaatttttgatcactgttttttttggggggagttacaattttttattgatacataataattgtacatatttatggggtacatgtggtattttgatacattcacacaatgtataatgatcaaaaaagggtaatgaggatatccatcatctcaaacatttatcatttctttgtgttgggaacattcaaaaatcttctagctattttgaagtagacaataaattattgttggctttagtcaccctactctgtattgaacattagaacttattccttctatctaactatatttttgaagttggagattgtgctttcggatgagagggagaacccattctgaattaatttcctcatttttattgtcattggcatcacaatagccatttttacatttccagcccaaagataatatgtgaacacatatttatatgtataaccatttgctcgaagggataagactacccatatgtgtgttcattcaataagtcaaccatgtgcattgcttgtctatcacatgccaggtgcaatgccaactcctggatgtttctgttactgagatgaccctgaccccccatggatgacacttatgatctgcttctctcctactgtactttacgcatcactgactcgtgaaccacgcagggtgttcacagcaccataaaatatcaaatctggataactttcattgtacaaatgagaaaatgaagccccaaaatggggtgtgatctggataggaattcagatcctatctttctccctcctcccatctccctgactaatgacagcggaacatgtggtgcttatattttagatgtgggctctcagcctgttcctcctcccgtaatcacagtgagtgaaagaaagtgagctgggaaaagcctgaatcaatgattgaactttccatcctcctggaatagtcttgttttgtatgctcttggactgatgctcaaatgtattcatgtccattgctcttcccgccttgcttgtgtcggttactcttgttccctcttctctaggctccctacagcccttgcagttgctttcactctgccaaaggtgaaggcaacaggcaacacaggcatgtgtagagccagggggataagtctgaatcagaaccaaacattctctgctcctcagacccatctctctgggccctgcagagcaatcgcttctctgctcaaaactaccaccttggtttttaggtgggcaccttccccagaggcctcacactccgctccacacctgggtgttttcagaacctagagactggaattctcaacctcaacttaatgtctctactccttcagggcgtttccctattgatgaaagaattattagggagcaagaaccaagaaaaccaaatgcggaggcccaaaatcaaagtatccatgcagtcattcatctgtatccctttgaataagctagcaacattcgttcttactctctttaataaaaagagcatattaaaataaaataaaataaaataattcttaaaaacagcatattactcagctgtctcgctggcttcttggaaggagtagcaaatatgctttatatactccaatctcattgtcatcagtatatagggtttggaaatcaataattaaatacataatttaataaaaacatacttccagatttcagccagcctatcagtgaaacttccattgaattgtcttctatttcttttccttcttccccaggtccttcatccaggaaaatttccagagctttccttcaaatacttttctgtatgtccatgtatgtttcaagatttctttcagggctccccagaaagccctcacccctcaacagcactccctcctcattttttaaataagatgaacaaaggcagcaagccctttgaccctcatcattatacaaattgtagtgtacctctgacatggagaarctggagagaagacagggcaggttagagagtatgctctgtgctttgtggttagagacaaagggatgataagtgtgagaggccattggtataaacttttggcagcaacaggaagtagaagagtttttaaaatcttgtgcatcaaaaataagacattgcactgaaaacrtaagtcttatgttcctattggttcatatgcactctagttcatgcttttgtatattattggctgagaactgaagcaaaatataaatgcttactcataaagatgacatttaaacattcacacctcttgcatggctttctaaaaggcctagataacattctcatatatgtatccatgaaaacgaaatattgcctttgggttaagtcagagcttctcaaagtgttcgcctttgttctctttactggaggaaagagtgaatgcagaaaggaatgtagaatcacactcttaagtgtgatttgtggttcctctgaagccttatgttttatctaggaaaaaaatacatatgcattttgtgacataacatatctaagtttattttattataaaattatattaaaattcttaaaatattctatgctcatattctaggaatattggaagaatagtgtacaacatgtaaatataaataggtaaccctagtaaaaccatgtcacatgtggttcagtcccagagccatatcacatttaaagaactacagcttaaaattgcacaccaaaaaaccattaagaaggtgttctgttctttaactatttctcctgaaggatattaaaagggaccttggccgggtgcggtagctcacgcctgtaatctcagcactttgggaggctgaggagggtggatcgcttgaggtcaggagtttgagactagcctggtaaacatggtgaaaccccatctctrctgaaaatacaaaaattagccaggcttggtagcatatgcctgtaaccccagctacttgggaggctgaggcaggagaatcgcttgaacccgggaggcagaggttgcagtgagacaaagtcgcaccgctgcacttcggcctgggtgacagagtaagactctgtctcaaaataataataataataaaaaataaataaaagggacctaatttatatctccactaagtaataattctcatattcacttttctttcctccacatatcacctgctctaaagcatcatttaccaccacaaaatactccttctctatgcatatttcatacagtttttactctctttcccactaaactccttctttctcatttgtgtattatgtggatatacttaacctttccagcaaagaacttttcatcatcatctctcctttcttccaggctctgattctagaacaggcaaagattaaaatgacagaaaattggaccaacaatgatcagcattctcattggtgggaagagggagagggatatctgtaaacatccccatgttaataatttgtatttttatcctatcacatatggatataaaaatagaaatattttgttccatattctgtattgatcgcaggccagtgtgtggatttgttcacagataactgaatgtttgcagaataataagatattgtacctacaaactaacaattattactttccttatttataactgtgtcccatgagtgtgttaatagtgataagatatattctaatcccaaactgctttttaaaataagtgttatatttcaagaacaggcttttggagtccatgcaaattttaaatgcctattctattcttctgatggcacattttgtgagaaatcaggaactaactgagataaatgtttatttggatacacagtcattgtgtgtgtccatgcacctctatgacaaatgctggttggcctcccattgtgtcacttgaagaaacttgagatctttatgctgaacaagtgaaactttcaaaatggatctgatgaaaaccaaacatgggattttgtttcataatctttttagttaagtgttaaccaggaacagagtgtatcttattatgcaagcagatggaacaatatcatcactgttattttttcaaacaagttcaaacattaattactgtgtgtaccatttcattggtgtcatattatacaaagtatttgttactagattacaacaaccatattagactcttgaattattagcctttgtttgagagatgtgtatattgggtacctgctatacaaatggctctaaggtaggtgctgacagggagggggcatcatggataggtgttgggcaagaaactaaccctcaaaagatcctaaaaatctatgaagctgatgaaacattcccacagataattatacaactgagtggtaattgttaagagccttcagagaagtttagaaaaagtattgagaaaattttaagagagggatgacttagagatggaaggatcaaagaaagcttatggaagaggaggcagttgaccttggcgttaatcaatgggccatatttggatatgtagaaactcaaaacaaagacatttcaggagaagggaatcttaacaaaagcagaagatatttacgtctgggatggtgttatttggttgtgctaaatggaaaaggagcactagaacatatggttgaaaagatagtttggatcttcttaacacagggaacttattcagaaagaggtagggactcaagacaatgacaagcagatgggctagatctctagaagtttggaggagcaacagaaggctatctaggcagagggacagcaggcacacagatgagcagccgtgggaggaagttgagtgtcctgggaatagtgagaagtcgttatggccacaatgtgtaaagaatgagagagcccacaagacaaggctagaaaggaagtttgcagacacatcctgaagggaactatatgccatgctggggagtttggtgtttattttytaaagacacaaggaaccaacagagggtttatgactcaagtaactgtgggcaggatggagcacaggctggcaggggtcggcaaaatttttgtataaatggccagattttaactattttagactttgtggaccatatagtctttgtcacacattaattgktttctttctcttttctctttccttcccccatcttttcctccctctctttyttcttytccttcctcttcttttttyttccttytccttccccttctcttcttcttcttcttcctcttctttyttttttttttttttttttttaaagaaacaaccctttacaagtgtaaaaccactcttagctcctctggccatacagaaacaggctcaggctgtctttggccctctggccacagtttgcagtcttctagactagagcaagaagacagaagtgttaggtaaaataaaaagcaaggctgttgtgcagagagcagaggagggcctggactaaggccttggtgacagaaatggtggtgaggagatggatgagatatatctgaagtagaatgatttactgtcagtgagtgtttggctgtaagaaagtaggaagaaaagaacaagtcaggtgtgattctcaggcctgtggcttgagagactaggtagcagtgctgctgttatttggcatggagactgtggaatagttttgatagaagaagctggagtcagtttggaagctgctgagtttgatgggttcgtggcacatccagataaagggcacctggagcctggtggctctatgggcctgatgcacagtttcttcccatccaggaagactgtgaagaaaccagtttggaagtatgaggtgtcacaagagtctataggacaggaaagagctgtccttagcaaccccagactggcagcaagagtkgggatgaattagaaaggatacaagactgagagacaggggcaaggggagggggagaccaggtaggaagctcttccaacaatctagggaagaggaagtgaatgtcttacattgaccagtagcaatggaacaaaaagaagacaacagatgggaaaggtattaatggaacaaaaagaagacaacagatgggaaaggtattgtgggcagcaggacttggcactctgtgcatggaagatgaaagaggccttctgcgatcattgtcttcaaattccagtgtcctatgtgatgttacttctgtcttgttcttttcttagttcttattttaggtacctagtttagtgactgaagtactcacagggcacataatatgaatgctcccatgctttttcaattgttgaaaatattctgttgtatagtacagtggaggatagccatgacccacctatgaaaacctttgtggaaatgtagagaaaacgaaaacacttgatgaaagaggttttttyatttatttaaaattttggacctggaacacattttaaccaagggtttgtaaattgtctgtcagcctgggaagccctcagtcaaggtagtttgcatgttgccagcctccatgaaattcttcacactaagatctaaagtctcttgtgcccttattttagcagatcttccttaaatgtgtgagtgccattgagatatagcaaccgtgcatctgtcttccaagtgcattaaactgctgtgttacaatacagatataaccatctttattcacagtgcgcacctcactctaacactcaagatgcttggcagttagaatagaaagggcacaaaacctttttttttgtctgtttggcaattaaccattcactggctttttttgttgtaacatgcacttcctttctcttgttttcattcaagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgyggctgagcttgtgtccgggaggccggtctcagacaccacagagccctcatccccagaagggaaggaagagagcctagctacagagccagccccaggtacccaaaagaaaaagcrctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctakccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttgtcataatggggaattcaggcttagccagtacttctatgggatgagacctataatcccacctatagcagcaagtaactacccttcatgatgatagtgtacatggagctgtgattatgaacatgctgcctttcctgctgccattggcattctctctgtaaattttattatgtgtggtatcacactctccaaaaatgcagggtatttggttacataaccaaactaattaaagaatcagtaatgaaattgcaaaaccatgatcttttttgagctaatgattagttgggctttcctttaaaataatataatcaggccgagtgcagcggctcacacctgtaatctcggcactttggaagtccgcggcgggtggttcacctgaggtcgggagttcaagaccagcctgaccaacatggagaaacccccatctctactaaaaaaaaaatacaaaattagccaggcgtgatggcgcatkcctgtaatcccagctactcgggagactgaggcaggagaatcgcttgaacctgggaggcaggggttgcaatgagccgagatgtgcactccagcctgggcaacaaagagcgaaactccatctcaaaaaaaaaaaaaaaaaaaaaaaaatcatataatcagttcccttttaaatagaaagaggaggaaaaaaaaaaggaaaagggggggtatctcatttgtatacaaatagattttcaatggcatttaataaaagattctttaatggttaaaatgataaagattaattctacatatcttgaaaaatcttaatgacttctgtattcttgacttcttaaaaatattttctttcttttagtgtgcaataagacaaactaaggggaattttttcagcttgtatctcttttacccatattattttccttgcataagcaaaaaaataataattgcctctaaaactgatttgacagtgttcagtgacatcatttaatattggtgatggggtggaagagaaggtagggaatgcccttatggccaaacctaaaacacagtttccttgagccttctgagcaatcttagaattattcagaagctttcaggaaactcaaattctattaatttgatttggttcctttccaaaatgttaatagacatgtatttgcttaaaacgtctacctattccatttaatttcctgctgataaatgtattttatctacaagcaagtagaatattttgttttggttaaagtcaagtttttataaaaggaggggaagtataagagagagtttcctagagatacaatatcatctctggagcaaaatgttgaggccaagtgtaaaaacagactatttctctttacttcctgcagaatttcatttcaagggaccacagcacacccttgaaaattaccatttatttaatgccagttgaaccaatgggtagcaaaagaggagggagggaacatggtcatagagacaaaatctaactactataccaggtcttcctttgtaagaaatattagccctgccaatataaaacgcagatggacatagacagaataagcatcgaggactttttcttatttacttgaaatctagaagctcagtcatctctgctcatccctggacccactggagagttttactcactaacaggtcctttcctggaagaaataacctcatctcctgccatattagtttacaataaaaatcattccaaagtgagccatttcacattgcatttttgccacatgcacatttgctattgaaaccacagattctcagcataagtaagacataggtgtttcagaaacttcataaatacacgatctttcaggtgctcctcaatttcttaatcaaggtatattgaactccagtgattaggatagaacctgaaaacatcctttgttctattggatagtacaacacagcaagagcacacagttatttgtataataaaacaacttaattaatgaggaagatgggatgtttgattcctgctaccaccagttcacttcacaaaggccttcttctggtattaccaggaaaactttcctgcattttctagggaaaaagaaaagtcgtttattaggagcacaatgcagatatgtatctgtgttttcatagcttcagcaaacttcttagtaaaattcccatttcaacaaaaaccaaaatactgattgtttgaatgtagaaaggtatagaataaagactacaaaggggaattttaccagggctccttagaccagcttccccagcataatttttatataactcaagtaagcctctgcttcccctctcctttccagtataatataagaaggtcggaactgtcgcacaaaagaacttgatttcaatatgaaaatataatatgtaattttggggactgcagactttctgcatcaaagatctggacagccttaacttttataaaaataatttttcaatgttctcttttactaaccaggaaaacaagatgttttctgaaattaatgactttttctattttgggtctgttttctaagtttttacaggttgaggtataaagggtcgtcttctcctcatattgcctcttcataatcacctggggctattttttgcaagtcactgcatttttacaaaaaataaaaataaaaagtacatctcacaaatcataaaattctccctagacttcagacagtccttctggagtgaaagaatagaaatacagaaagaaaagaattacagggtggctttctttttattttcctatggttaatgtactgtatggtatatatgtttacagaatgtatctgccttgtgatgttaacaaaatgaatgacaaaaaatagtactgatgtgccatttgacagtttgccttagcatcactgtttatgttcttcttttctgtcctttttggtaaaaaaaaacgcaggttgtattccaaagctgtattaacacaacattctcttccccactcctacccagccttyttcagagctgtgaatttcattacaggagcattgaggcagaaccttgcaggtgtggcccaaaggggctaaagtgggcataggttgggatttacttctgcccgtctaccaaccaaacacgtatctgtgttctcatataagcctgcaaaattttacaccctgcctttcagggagacaggccacatggagcgcatgacctcttgtagtcgtctcctcacagtccttcccactgtgagagaaggaaacttgcagacccccaactggatctgggagcatatttttaagcacagttggcattgcttgaaaaagcaagagagatggactcaaattctatgattgagccatgactgaggaatgtgcccattcgttatagtcgaagatgagtaggatgatatgggtgagaataggagtggctgtagaaatggaatattttacagttatgtatttttttaaggaatagtatttttataatgaaatctatatacattatggagcttgagttggaaaacacccttgactgagctatttcttcattccattaaaggtaactttctggggagtcctatagcactaggccaagccttgggggcatgaacaaagggcctgtcacttggccttgcactgccattacatgagatccagtgtttccaaataggccttggttggaagattgagctttctatacctgccattaggtagattagatagatggcttgatagctctctgggctatacttttaataatatataataatctttgggaaggagatagctattttaaatgcaagcaaagcccagaaactatcaaagtccaaatctttcacatatttaaggagtaattgccacatttgaggttaagggaccacttactatggtgcatttgagaaatatatatgaaacggtgagtcagagccctctgaccatcttcagtctacacataagcagataaaccaccaatataaatcttataggggccagacgaggtggcttatgcctgtaatcccagcactttggggggccaaggcaggaggatagtgtgagcccagaagttcaagaccaggctaggcaacatgttgagaccatgttgtttagtctctactaaaaaatataaaaattagccagcatggtggcacacacctgtagtcccagctacttgggagactgaggcaggaggatcacttgagcccaggaggtggaggctgcagggggctgagatctcaccactccattccagcctgggcaacagagcaagactctgtctcaaaaaaaaaaacaaaaaaacaattatcagttggccttctacataacacagggctacactgtatttttagagttaagtagatacaggaaaagattgtctttatccataaaggagattctgaatttttagagttcctgaatattttcccccaagtttctgtcaaattcctgaagtcccttccctatcacactcagtttcctgaagctcttcccctacacctgctcctctgtctggctaacagagttgtcatgtctcagaaactactcaccactcttgtgagactctcttcccaagcatcatccttcctcaggatgaggcctttttctactacccaagagatcaagaccctttttctaacaagacaaggttatatctactccattttcaagagaaataacccctctggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagtttactctaatctcttattactaaggaacctctcggtttcgagattaagtgggcagggagacatccagtcacttagttttgcaatgacaggtcttgatatacacagaggccaccaggcaatgcctgatccaaactattctgtatgtagctccaactccaattctgtgatatcctattctggcaggtgggaagagttctattctttgcagggttctggaacattctttcctgctctcaagctcctgacttaggagagtcaaaatcatacaggggttccagaaaatgttgtgtctgatgcagcttctcagtgaatgtaggttgttggtgaaattttcagctttagcatctcactcggggtgagtgatgtctctgtaaatactttcatttgtggttggttggtgggggtgggggtgggagcctgtcgtgcttactctgaattagcttactgggctagctgctgtactttgtaacctgaagtgtactttgactgttctgtttccttcagatgaaaaacaaaataaaaaccgacttcagaaaagacactaccagcgacagctgatgctgtacttgtagcttctctctgttcctctgtacagtattaatagacaataaactgccttttcactgcatctacctctgtgtgtctgtgccctgattctttccccttctcacctgccactagcggacttcaggccagaccgtgttgggagcaccttccgctgttcactaaaactaaacactaacccagtgcctctcaaactccagtgtgcttcagaatcacccgggggtacctgttaacagtgtggaagcttagtcacacctctggaactcagattccgattcccaggtggggcccagtagcatgcatttgtaataatgtctccaggtgattctgatacatgtggtacctggaccgccggtttgggtgccccttggtgggaatcctcatggcccacctgttgtagttggtttctacactaatccaatctcccaacatgtcctccctctaaccccctttgcaygtctctctccacaactgtcatccttttcttgttccttgcaagctcccagcagcagcccagactgtgatcaaacttgggctgccccttaggctaagtgacagggttcatctggtgcagtctgctgtttaagagcatctgaagacacgtggggactttgtttctcttgttcacctctctttacctggaacagggtcagcatagtttttcaataaatggccagatagttttggctttgtgggccaaatgatctctgttacaactactcagctctgctgcaaagcagccatgtatgacatttaaatgaatgagtatggccatgttctaataaactttatttacaaaaacaaatgctgggtccgatttggcctatgggcttataatttgccaacccctggcctcaaacagggcctggtccatagtaagtgctccaaaaaaaaagtttcaaaaaattattgcatgaaagaatgaatgaagagtagatatgatgcctaccacctgcagagcagtcacagaaaatggttttctttgaggagattaagtaaatgaatcagttgggagttctcatctggttgggttccatggtagattttttaaatgtctttatgcatggaaggtaactttaaagatggaaatatgagtggtgttttayagattgctcaaaccgccaggttaagattgacaagagtttcaaccaatagaacgtggaggaaatgcaagaacatcttgtcctcatcaaaagtgctggggataccagaactgggtgctccctatgtacctaagcatttagtgcagttgtttgtggagctatgttttgtcagattcatcttacacagtgaatggcagggctttctttacattattctctttgttaattgaaatactttttaatgtgtagttaggtaggctggaaccatgatagcacattacacatcccacagttctagagcataccaacgggttcaaatgtaggagcatatggaaagtcgtgtgcttacattcatccctagtgttgttgtgaagttaaaggaaattatatttattaaaagcactgtgtaagctggaagtagatgacaaatgttagtttagttataatgagaaagtgtctgttgcccaaccagaggcctcatgctgtccaaatatagagattataagctgttcaggtgtgtttcagaactagtatagaaagggaagctkctttggcctcctttagatttgtgactagttttgtagtacattgaaccttatgaaattgccattttgtagatccataatattgactattgacagttccatatagttcaacctcataattcgattctggggattatatctcatcatggagggcaaatgattaccagatgaactctaaatatagcaggaggaattagatgagaaaattagaactttggaagggaatgtagttcagtactaccaagtagacctagacatttcacctgatagggtaggatttcctttaatctcacatcaactttgtaatgtagccattgaggttactgtccttttatacatgaggaaactgagttatagagatagtaagtactttggctaatgtggcagggctaaaaatccgtgtggggtggaggagggccaagttccaacctcagttgtctttacttcctcccacacagagagctatgttatgaaagtggtgtggaggccgggcgctggaggccrggtgcggtggctcatgcttgtaatcccagcactttgggaggctgaggcaggtggatcatgaggtcggaagatagagaccatcctggccaacatggtgaaaccccatctctactaaaaataaaaaattagctgggcttggtggcacgtgcctgtaatccccgctactcaggaggctgaggcmggagaattgcttgaacctgggaggtggaggctgcagtgagctgagatcgcaccactgcactctagcctgggtgatatagcaagactccatctcaaaaaaaaaaaaaaaaaaaaagaaaagaaagtagtgtggagatgcccctragactggagacaaaaagatttagataatgaggttatttatgcaagaaagacccaatggcaccagttcttattttgcacctttacctactcaagcaaatgctctgttaattataccaccccctggaggctgggaggcatctctgcagcgcttccttaccaaaggagaagcggagggtaaaatcactttgttttcttatctgttcatcaggagtcctgttgttctatttgacagtttttccttcaccattcataaaaaggattaacaaaattgcccaaaacaactctataaagtctaggagtggcacgtcagtctckgaaaaagcaaagggggttttgttattgttgctgatgatggtattgttactatttcaccactgtcataacagcaaagaggaacagctgccctatggtgttatgcaaatgccttttgatctaggctatatcatccttgtgcagctattaatagaccacatcatctccccagcagcccccaagccctagcttctgtcctgcttttctcaaacagtattaaatcttgcattttatcaacagcacaaaaaagcaaagatttgctatttagaagtggacacaggaaggggaatatcacactctggggactgtagtggggtggggggaggggggagggatagcattgggagatatacctaatgctagatgacgcgttagtgggtgcagcgcaccagcatggcacatgtatacatatgtaactaacctgcacaatgtgcacatgtaccctaaaacttaaagtataataaaaaaaaaaaaaaaaaaaaaaagaagttaaggttgcaagatcttaagtgatcatgtagggcagaagtcagaaaatggttatgcagattctgggctgaatctggcctacagtaaggttagtttacctgcacagcaattaaaaatcattttgaattcattgccaataataataaattaagagagttcttattttaaaagtatatttccgacttctcttgagaattcagtctctggcaataatagcctgttctccccactggcaattgtctggagctgatggtggttgctaactttagaggagccatattccgttgttcatcaccaccaccaccaacaccaccaccatctcctattatttttaccaccttctattattcttactcttggcccacttcctttgtctgtatcacctgcctggcccctattggcatttgagcatgtgacscctaatctaccatcattcactcattttatggctgggtcaaataagtcctaggtggaaatgggacttaccttagcaagataacagcagactcagaactaaagtcccctgaactctttggatgaatgaggctttgtactgtgttgggattcaaatcttctaagggcatttttagttttgaacaggctacaagcagaaagctaatgccagaatctagtgcttttgctacagaggaacccatgtgacttatataatgatgaattaaccttaggttaaatgaacagtgtaagtttgtaaggaactttagggtatcctgtgtttcatggtaaaaagtttcattcccaggaaaataaatagatactttgtagtcaacacctcaatagttctggaggcttcatgttccttcttagcaaaaataacaagaggcacagcccatacttatttaaattgaaatgtgatcttccatgccttcctaatccttagtctttgattgtgttcctgaggtcatgtggttgtagaatactactattctgtattgtccactttttttatcttcctaagagcaataatcctcacagaagcttgataattcaaaggactaatgaaacagagatctttactcccagggcttgtcataaatcctggccaatatggtgaaatcccaactctactaaaaatacaacaaaattagctgggtgtagtggtgcgtatctgtggtcccagctattcaggaggctgaggcaggagaatcgcttgaatctgggaggcggaggttgcagtgagccgagatcgtgccactgcactccaacttggcaacacagcaagactcctctgtcttaaaaaaaacaaaacaaaacaaaacaaaaaaactgatatgatttagtgtttgtttgttttaaggaaagactaattttttttttttttgagacagtctcactctgtcacccaggctagagtgcagtggcatgatctcagcccactgcaacctccgcctcccaggttcaagcgattctcttgccttggcctctctagtagctgggattacaggcgcatgccaccatgccaggctaatttttgtatttttagtagagatggggtttcgctatgttggccaggctggtctcaaacttctgacctcaggtgatctgactgcctcagtctcccaaagcgctgggattacaagtgtgtgccaccgcatctggccaaggctaattacatttaagatgataattgtatttcccaaattaaaaaaaawatttccaagtcactgaatattaaaaacacgagctgtgggcctattctcttcaggccagggttcttaggtcaacctcagacaacctgaamgtgagataaattctgcagttagtgtgaattattcagactatcagaatctgccaaatcaaattccatttcttcaagaacttatttccagtcagagtacaaagatagagtcagcttttctacttttcctgaaagactgcctaaattctaactatagctcagagactcagtgtgaggtgctgtcacataccttaactcagtttttcctcaaacttcagacttttgggcatcatatttgttatttttgtcctgtgtgtaccagctcgctcctgttaaaagaaggaaatagccaggttagagaggtgtcaaaaacatagctccatctctttaatataatcagatgggagtgaaagagaatcaagatagcagtaactttcttgctatgtgagtcagtgttacataatgccatgcccacttacccccaaaatttaggaaacactgtcttgcctccttgcatcctcttaaaaaaaataaaaatcccaattcctcgtttcaaagagactagggttagaaatagaaagtgacttgctcaaagccacaagaagagcagagacacagagctgggattcagacccaggcagggtgacttcaaattctttccattgcaccaggtgcctgtcatgctgttccttttataaggattgaatcgagtacatcagtagcaaacttaaactctccagtaagatcacgatcgtttaaacaaacaaaagtaacatctgttccagctaaagagctgtctctggcataagcaatttttcaccgatggaggctagatctgattgggctcttgctgagttaattgagcaaagttacgtggccagatgtgagttttcagatagaaggggaagggaatgcaatatacaagcacatggggagactgatggaccaaatggctggctccactataaaacactccagcgtttagcctttgttctgcctcctgggcgttagcaagctgactccygcacagaagacttcttggttgactcttgaagagtcagggatttagtcaatgcaagctgtaaactggctcagcactagagaagcagcagacatgagtagaaaaaggttctcccaaagacagctcagcttcacttttctcttctctcttcactcctttcttctctcctcttttctactgaatgaacttaaacatttttcagctgagatgcattcccacctgcagggtgaactgaacttttaagaagcctattaattctcccaggaagcaccaggctgcagctctctggttctcatttcttgcttgctatgtattagaacctgggacattttctccaaaatataatgctatgagggcccccactccagagatcattatttaattggtagggtgaagcctggcacatttattaaatggttccaggtgattctaatggagattcagccagtgttggaaacagcagcacacgggtgcccagggctggccgcagtgagtccgggctatgattcttgcctcaattctgcaagccaagaaaaacgggctttggattcaggaacaaagcaaagcccaagtctgtcattggccagctgagtaatcttaggcaattaatttcaattcaccaagcctcagtttcttcttctgtagaatgggaataatacctaccttgcaaggcttctgttaggaatgtttcccttctcctttccttcccattacaaaagaaatatatttgaggcagttgattgaaaaaaaaaaacagcagaaaaagaaacagatggagaaattaggccaagagaaaaataagatgaaattagaaaactccatctagcttatattactgaacgtttacttctctcacttgtttgagcaattcagtttgtaaaatgtaccacataatactactttatcaaccaaaccacttaattctaagatcttgggtctattttgaaaacaacaaaaacatgatgtgacagaagcagcattcttgagtgtaaagggacccatggactgagctttgtctcatttatgcctttatcgtatgacttagaggaagtcatttttcctctcttggtcccaacttgctcatctataaaatgagacaacgtgattgtgggtgacattctgagtggacgccaacctcaggagtatttttctataatttaaaaagaaaggagagaagaaaaagagaaggagaaaaggaagaggagcgagagaaaaggaaggaagaaagaaggaaggagggacagagagaaagaaaaggaagaaaggaaggatgaaagaagggaaggagaggaaggagaggaaggaaggaaggaaaagaaagagaaagacattaagaggaggggagttgttccttgaaggtgctgaagtccctggcctttagaagccatcacatcagccatctgctgtgcctggccctgtgaagttactagtaagccacccgtcactgccttgttccagggtcttgaaaccctgtggctattttcctgtgtatgaaattcagtggggggaatacctgcctgaccaaaatttgtagttccccatggttgaaaataagagtctgaatcttccttttaaatatatgaacagaatcgtctttgcctgccatctttgtgccctcactttctccttggagacttggcaaacccccccaccttgagggagaatactgcagacacgtgccactgctcccctattctagatgttttctccaaaggaacgttgagtttgtgagcaacaggctgacagtgcttctctccacagacaatgtttaactctggacaaaatacaggctccttctcttgttctcacttgtgactccctgctccatgaatgtccagtgtactgggtctgaaagcagtaagccagttctgctctttaatagctctgtgtctttgggtcagacacttagcctctttgctctgtaatacaccatagagagttgtcttaagtataaagatccaggccaggggtggtggctcaagcctgtaatcccagcactttggaggccgaggcgggcagatcacaagctcaggagatcgagaccatcctagcctatacagtgaaaccccgtctctactaaaaatacaaaaaaactagccaggcatggtggcgggcgcctgtagtcccagctactcgggaggttgaggctagagaatggcatgaacccgggaggcggaacttgcagtgagctgagatcacgccactgcactccagcctgggtgacagagcaagactccgtctcaaaaaaaaaaaaaaaaaaatcctaatatttccattgatccaaagaattttagaagtggtagatagaaagttaggcatagaaactccaagttgaatggggttagttagctgaagtttggctgaagagagtttgttttcatgtcttttcacctaccaggagaaaatttccctcattgaatgttggaaggagacgtgggaatttttggataatttcctgaggcagtggctgggtaatggaaactctcattgtgagcgtacaagcatccatcctcatcactaaggcactctcctactcagtaagaacagagaatcactgctttgttctctttctccagaattaagatcaaacccttctctctggaattcaacatttgctaaaatgcaacaacttcttctccatcacccccctccgcgaaaccttagttcccactgattcccaacataaatttttctttttaattaaggatcccaccctggccctcactggccattttcaccccttccccacacttggcccatgctgttctgtgcacacttggaatcatgtccctcttcccctggagaagccttcatcctgctcagcccagctgcagtgctttcatctcatactgccccctgcacccacccacctttcgctatcagccctcctctgcacactgcactcctgctgtctttaccatacggctgacccttcagtggggctcctctgtattcattggataaaatactaattttttagttccaaaatggatcagtagcagcacctttgatctctgaagtagttgactttcaccctgagacacagacttatagaccatagatgaaaaatgacaatcaagatataatgcataagttgagcacggtggtatgtgcctgyaaatcccagctactcaggaggctgaggcaggaggattgcttgagcacaggaatttaagtctagtctgcrcaacatagcaggaccctatttctttaaaaagaaaaaaaagatgtaatgctatcttttggctcccaagagtcagtaggaaggatgggagaggaggggacaggagcccttgccagaaaaggaaattgtagttttattttctcccgtatgtcagaagagaacagattggtatggtgtgcaggtagccatgggtcttctcttaccaggccagaggagaggctgaacttccctcagcagttcccaagcaagtttagcagcagaatcatagacaaattgtcttcctatgccttgcagtgtgggtgcttgtttactatttgagggaaaagtgtttaggcaaacaggtatcctgagggtgaccagctgtgcaaggattaggctactgaagcacaccagttctggctggtgggaatggaactggagctccccagcagggctgccaagtatgattgttcaggttgcatactgcacaatcctggaaggctccattcacatcaagtacaatgtgaatggtgctcttggagttgttcagtgcataacatgcatactacacctgctcaggcaaaagcaacctatccgttctttggaacatatagctaaaattcaaccagaaacttactttataatcatagcattgcacatatattaaacttgctgtagcctgtcaagttgcaggaatcagtttataccctgaagactatggacttgacttctaggaaccggtaatgaagacatacttccagggaccaggcatattcttccttgattttctccagtgaagtttagcatggtataaacacatggtatggggtagatatttcatgatgttgtagctgggatcatggagcagaatgaaagggcagaaccagttgctcttttctcaggggcggcattgcccaagcatgaattgttattgagtggccacttagaagaaagatttctctgactggggtgaccatatgtcccagtttgcacatgttttaccagcctaattttcagtaatgttcagttgggatgatgaaccatatggtcgtgtgacctctggcatggagatgggcatctctgctttgtcaactactccacatctgcaaccagcctttccttttattgatgccttggcaattctccatgatacagacacaatgctgagggcacggcaagactcctgtacgcaaactgttctgaaggatcagagtgttgtarggtgacagtcagcctcatccacatcaaagcatttcctttttttcttcaccatttttgatcagtttcatattcctgtgggtactaatgaaaaggaacagcagaaccactatcaagtccagtacttactaggcagatagagacccactggcttctggcctgtgccacttgctgctgcccacactcatcagtggaggagaattccctactaagttttcagtagttataattgccaccaacattgcatgggagagaggagcatgacttgaagtcgtttgcaaatgtatgttcatccaacaacagccaagaagcatacccgagactgtgcaggtgctgcccaagtcctgaacacattactgcacagttgctcagagttctggttcgactgctacctcttgtaccccagtttcttcatgtgtagaatggcaaagagggttaaatctcttacaaagtgttttggacactgcctggtaaatactggcagaactaaaatatagctattagtaagaatagtatcagcagctttgagagccagggaacaacccctaagaatggtatgaagtagggatcagcaactatggcctttggagcaaatgtggtcctctgcctgttttgtaaataaagttttattggaacagaattatgtccacttatttaagtattgtttatggatgccttattgagtagttgggaaaaaaatcatatggcccataaacctaaaatatttattgtctggtactttaccaaaaaagtttactggcccccaattaaagcataagtaagatactcaaaatctcattcctattcctattccactagcagttactgagcactgattaaatgccctgaactgtgccaattttttttttttttttgtaagacagagtcttactctgtcacccaggctggagtgcagtggcacgatctcggctcactgcaacctccgcctcccgggttcaagcgattctcctgcctcagcctcctgagtagttgggattacaggtgcatgcgaccaagcctggccaacttttgtatttttagtagagatgagatttttgccatgttggccaggctggtctcaaactcctgacctcaggtgatgcacccacctcggcctcccaacaaatgttttaacatagattatcttatttaactttcatgagaagtagctcttcaaggttaatggaaatatcccattttatatgtgaggttcagagcacttgtgcttgtgtacaattgcagagctaggattcatactctggtctggaactttaggagttatgaggacagacatcctggaggagttcggtttgcacttgttcttgaagaatgagtatggttttcagtaagcaaggagaagacccaggggagggtattgcagaaagaaggaattgactgagcaaagggcctgaaataggaagcttgggctggttgtctgatttgtttagcctgaagggactgaaggagacaaggtgaaagaagtggctgtatgccaggatgtagagagacaggtacttcctcgaggaagcagctataaactgaaagttcaaggtcaagcccatagacatattgtgtttggcctttactgtattgattcacacaaggatgtttgctttggttttcacttgaatttataaccagcccatcctacatttcatcttctcttaaaagactgcaagatctagccagactcagccacatttccaggaggtgggaactagctagagttgagtttagctgccctctttagatgcagcatctgctttcctatgggcctttactcatcttagactcaagcaagcacagcccccatactgggccctgggctttatagggccttgctctagtcacactcttttctaaggggtgaggagtctttgggccaaggtgacttgcctgctccctacccctgtcccctgactgtgcttcacctcccaagactctgaattgtctcctgaacggtcccrgctcacatccagaactcacatgggcctcttctctgcatctgtcttcccaaggatgggccactctgaagggtgtaccaaagggaagcagtttgccttgaaggtagcgtatgtgtggatggacctttgaggtgcaggctagggtgtccaccatgggtgtgcaaggcctctagaggtgcaggacagagcagagggtacaaagagtagggaagaaggtaacaggccacagaatctcgctctgcaccaccaaatctcaatatgggacacgcaggaatccaagaactcacaatttgaacttggccttctcagtcagtatgaagtatatttgccaacttagtaagagagaacataaaatatttaataattttgaatttgatttcagatattgagatatactgtatgtcagcatctatttgtgcacttgctccaagccccagaaatgttcggcataggcctggctgcagccctaccagttcccattgtcttacaccagagctgtgtctctcatggacatgacctgtctggtgcttacaggaatgagaggttttggccctagctaaattggtttagtggtgaagaagattgaaggtttttgatcagggcagattgtgccaaatgggctactgcaggcagaggcagaggcaggaaggccagtgagggagctattgcaggagaccagctgggaggtcagagatttgaaccagtaggagcgagagaagaagggacagatgcaagattaattatgtcttttccttccacaatgatctttaggttaaggtcgccaacttaacccaatttagcctgtgactttcttggtttttgctctgcaagcttctgtcccaggaaaccccacagtactggtcacactggggaggctggcttgcctgcctaccacctaaatatcagccaccatcatattgagctcttactatacctcagctgggaacttgagctcaaggctttggacttgagtataactttgctcctggaagcaaactgtctggctatttctattccttgaccctaaatcaaaaaatggcaaataactctcaggccatggagcttcccttgggtgttacagttacagattttcaagtcaaggatatgttcaggacctaattagctcatccagacacttagaatctagattcatgctggaagggaagaaaatgtctccctcctcacctttgctggacacaaggatgtgtcatctttcatctgtttcttgccattgtcattaccatcaacattgacagagataacacatagaaccttgaattatggaatccttattaagttagatactcatctcttctagaaaataaaatgtttattagtaaaagcagaatcctcaggaaaacagtatttataagccctagacacatggccctggaaaagtcacttaacttctctgaacctctttttcctatgaagtgggactaataatccctacsatagatttgtatggagaataaagtttaaaatgcctcatgcacaaaagaattgagagcaaggactcgaacagatatttgtataccaatgctcacagcagcattatttccaatagccaaaagacggaaaaaaccccaagtgtccatccacagatgaatggataaacaaaatgtgatatatccctacaatggaatattattcagccataaaaggaatgaaattttgatatatgtcacaacatggatggaccatgaaacatagtgctaagttaaacaagccagagagaaaaggacaaatattgtattattccacttacatgagatatctagactagtcaaattcgtagtgacagaaaggttaccagaggacctgggggagagaagaaaggagagttattgtttaatgggtacagaatttcagtttgggatgatgaaaaagttctggaaatggctggcggtgatggttgcacaacagtgtgaatgtacttaatgctatcgaactgtaaacttaaagtggtaaatggtattatgtatgttttaccacaataaaaaaataaatgcctcgtgcagtacctggccattgaagatactcagggggaaaaaaaagagctaaaaagagatattaagatgtttctaagtgttactgagttcagaagtgggagttcatactttaaactaaaagtagtcaacgaaggatttgccaaggaggtgggatttgagatggagtttgtaggaccaggcaagggaaaaggcaacccagccaggaggaaatgtgtaagcaaaccatgaagctcctgtgtgtggtgatggggacccggtgatgatgttgtgatctgttttgttttttgttggagactagatttgggatggggtttcaagggacttggagtccaagttgacctgtttaggtgccaggcagagcagaggcactaaaactatctgggcagggaggatgaaaagatcagtgtcggcagaaagatcaatctggggcatcgtagaaaatggattgaatggtgccataccagaggttcaaggcagccagggcagtgttgcacaagtcctagactaaactaggatggtggctgtgcaaaagaaaagggagagatggagactaatttcagaagagccttgatagacttaagatatcaaggaagaggtggcaaagtgttaaatgtttagcagaatagctcaaccctggagccaggtaccctgcatttagtactgctaatgttctaataccagtactgctgcttatgagcttgtgtgaccttgagtgaatgacttaatctttctgtcctgtttcttcctctatcacataacaatgaatgacaaagtagtgcctctctcacaaggctgtcatgaaggttaaaggagtcaatatttgtaaagatcttacaatagtattcagcacagaatatatgcttgctattttttatcttttaaatctggatggttggtacgttggtgtctgttacgttattttttggtgtttgaatattttaaagcatgaccttaaaataatgtactttcaaaacagtcttgctaagcagtgcttcttaaagcttaacatgcatgtgaaatgtttggcagtcttgtgaaaatgcaggttctggttcagtaggtctcaggcggtactcaatggtctgtgtttgtagcaagctcccaggtggtctggtgccgcgggtctgccggccactccttgagtagcaaagttgttaaggaacggagttccatcacggtgtttctaggattgttctggttgtcttttgccacataacaaatcatccaaacctagaagctaaaacgaaaatgatttatgttctatgctgttgttgttattattatctcttgcagttcagctatgtagttcttgggatctgtcacaagctggtggttagatgtagctggggcaagagtcaagagtcatcctgaaggcttcctccccctcgtgtccggtggtagatgctggctggctgttgggacctcagctggggctgtcagcgagaacatctccccagggcatctccatgtggcaaggggctcttcacagctcagcagctgtatctcaagacagagaaccaggcagaagatgtattaccttttcttgcccagcctccaagtctcacagcatcgcttctgccaccttctatgtattagaagcaaggcactaaggccagcccatatgcaagggtagcgcagtgagactccgtgtcttttttttttttttttgagacagagtttcattctgttgcccaggctagagtgcagtggcacgatcttggctcactgcaacctccacttgctgggttcaagtgattcttgtgcctcagactcccgagtagctgtgactacaggcaggcgccaccacacccagctaatttttgtatttttagtggagatgggatttcaccatattggccacgctggtctcaaactcctgaattcaggtgatctgcccgccttggcctcccaaagtgttggggttacaggcgtgagccaccgcacttggctgagactccatgtcttgaagggagaagtgtcaaagaatttttagacatgtctcaaaaccaccacaatggcctgcttaaggaagctctgggaggaacagaaagtggtggatgagtcaaccagggaaagttgactttgttgtgtttaaatttgtgggtttggggtaccatgaagaccacttgaagttattctccaacaggcaggatggtgtgtgagtatctgagtatctatctctcacaccagatcataagcttcttgaaagcaaggacttggtctttttctctgcaatagttctggtgtctaccacagtgcttggcacacaaaagtgacccaaacaatgtttgtttgatgagggaatgaataaatgaatgaatgaatgaatggtaaaggatttaggactgaggctgtgtggtctgaagaagaaaggatactggaattctggaaatctctcccagaacagtcctctctggcacttctcccagggagagggactcctgcatttgctcagaggccaccatggccctgggggtctggcctgcctgctttgcaacttgaggccctcgcgtaccccataggctgtggaaggcctggatctgctgggaaacctccttcttccactaaatggaaactggaattccaggagaaagcaaaaatcaacaagagctattttgattataatgatatctcatttctaagcagctctctctatttcctgtttatagcccaaactgagagcagaagcgactagatctctcagtgaaaggttttctccgaagacgtctagctatatcatcaacaggaaacagtactctcccaagacaaaagtccctgtctctggccactctgttgggtttcattgcaccctacaaagggaggtgggaaacctgggtttctgaaagaggccctgattttgtgttagccttcagcatctaccacttgtacccagctcccagtcccccaaatttctggggactccatgtgaaatcaatgcacaggaattgtggggggaagccctaaggagtccagccgcgattttcagcgcgattttcagggcagctacatttcacttcaaaactcccagtaagtctgccactaagacccctggaaaggctggctatgtcagccctctgtcttcattagaagaatctcaggatttcttccagtgacagaacatgatcctcagattccagggagtgaccccagacccagttcctctccgggctataaaactgtggagtgtgacacagacagagagactgtggtaatttagagactaagaaaaaaactgactagaaagcaactgaacagaacagctgcaggaatgtaaaatgcaagaccctctgatctgacagtcttttcctgcacctctacaaatgtgcgtgcacacacacacacacacacacacacgactcccagaaaggaccctctgaagacaggacatttcagctgacatctgaaagatgaggaaggcagccatgccaagagtattccagaaagaaggaacagggtttgcaaaagctcagcagctccacagctgctggtctgggccaaataggacagacagcctgtggctctccccacaccttgtgcttcctcactcagccactgtgagtctcctctcgcctgaaacagtctcccgctctgtcctaaccttccagcatctttctcattcactctgtctcctgaatatcacccacaaagggtagcagtatcagtcttggtccacacacttatgcaagaagtgccactttgttttctttaaatcaagtgatatcagactctgtaccccaaggctgctggtctggcaggcagttcaaactcagtcgttcacggggctctctcccacccaaggtcatgcaaaggtgacatgctcatcttggggaaggcccatcatcactggttctcactggatttatccttgggtgtgcattgtcctggttttcagagccccttcagggctgaagtctgtgtggcttctgagccaagcttggagacaggagccttggcagaggctgggagcctggaatcagcatccagcttccctgcttacaccacagtgtagcactcccacatcctcaccccaccccaccccaagtgcagcctacagcccctcccctctactgcttctgggagaaagtgcacccctccccgaaccccaccaggatgcctagcttcatctctttagtgaacttttggcttttgcaaaagacctgaaggcccattgaccaaaagtagcctctgcccaggcaagggagcacaaaacccactcatcttctagaaatggactggagagtgcaacacaggaagtgcccacacagatgtttcctagaccttgcctttagggtccctctgttctcagggatgcagtctatccagccctgggaacttgaactccctgagaacaatgtccctctctatctatggtaaaggattaggttttgttttttttcttttaagcttccagttcatctcagaacagtacttttgtaaagtacaatgaaagtgaatgatgagaaaagtaaaatttttgaaagacacacagaatacaggtactgattttttattattagattcaataaattgttattaagggttctaaacatattctttccatttctgcactcacttggtcaccgatcagtaaccaactgtggagggacacggattggtgggccactcactttgaggagcgctgccttagagcactcaggagggagcagtgagtccttcttcacctctagaaatgtggagcttagtgaactgtagaatcttcaaggggttagggtagaagctggaaacaaggacagcctttacctagtgagccaagaaactaaaatccagcctcctcttacaactacttacaatgcaaaaagaattacagtgtaggactatggagcctgcctctggggcaggctgcctggtgatacattcagcactgccacttactgccttgacccaggatgagttaatagctcacagcctcagtttactcatctgtccaattaggatagtagtactatctcataggrtttttgtaaagactgaagttaataagtgcataatcacatagagttgctcttggaaaatagtaagtgcctgtgaatattaaaaatttcctggccaggtgccggggctcatgcctgtaatcccagcactttgggaggccaaggcagaagaattacttgagcctaggagttttgagaccagcctgggcaacatagggagaccctgtgtctacaaaaaaaatttaaaaaattatctgggcatggtggcatacacctgtagtcccagctactcaggtggatgaggtgggaggattgctcaagcccaggaggccgatcacaccactacactgcagcctgggcaacagagcaagaccctgtctcaaataaaataaaataaaagtttccttagaaagaaagcttcaggaggttagggatctttatttcctgatgtttcccaaatgcctagaaccatgcctggcacatagcagtgctcagtaaatatcagtgaatgaatccatctccttatccaatgctgaacttcaggcttccatgtttatcccactcttagtcccttttttttttttttttttttttttttttttyacagagaaaaggggtctgtttgctctttgtgttctttgtgttcatagtgtttccaagccccaggccattcagagcttttgtctccagtgccccacacattcaagaaagacttgaattgcctctcaggtctgaacctgttttgtgcagggtgtccaagctggagtgcaatggaccggtcttgactcactgcaacctcccactcccggcttcaagcgattctcctgtctcagcctcccaagtagctgagattacagacgttcgccaccaagcctggctaatttttgtattttcagtagagatagggtttcaccatgttggtcaggctgatctcgaactccttacctcaggcaatccgactgcctcagcctcccagagtgctgggattacaggcgtgagccaccgcgcccagccaagatacattgttgcagagtgtaaaaccagatcttgttgacctggcatttagaccttccaaaatctgatttccacctgtgtttctaggcatgtgacccactgcacactacacagcccccacagggaccatttctcctaccctgagcaagccattcctccaagacacacttctttgcaactcctgcccgttgaaagattactcattctaccaagccaggcttaaatgctgcctactctctgaagctgtctctgatattccaccagagttcgtctctcatctgcacatctactaattctctgttctcaactcctgttcagaagaccttgtaatcaagttcattgtttgcacatctgtccctttactaaggtggaactccttaaggacaagggaccatatcttcagcagctctgaatagcattggtgcttcatgcagggccttgcctataaatacaacttcaacaggtgggagttgttggtgggttcccacctgcaagcataagtcagcaggcttcacagtgagtggcctaacataggtgtggatcagaaggaaatgaaagcttcattctagcttccccaatactacttgtctcttaccattccgttgtcttgagtattctttggggaacctgctgatataggaggaacagtggcttcaatctgaaggactgtgccagcttagggtgagtatgactcagtctggaagcagaagcagaagggaatatggttttgtggatgracgtgggagacagcatggcatgaggttagtgctctgaggtctggtgcatctggcttcctgtctaggctctgctgctgactggctggatgacctttagcgtattcttcatgctttgatgcctgtttccccatcagtatactatagacaatgttgggacctcccctaacccctgccactaggggcataatgaagaggaagccaaggggtgtgcatatgaccccaccaccagtctgcagggaatgccacaaagatgctagcctttgcaaattctggtgcagtgttacgaggagacaaagttcacaaacattaccttgcccctgggtaccacgtgacttttgtctccctatatctcctgyacaattgcaaggattaaacatgctaatatgtataacggacttagcaccctgctctccaataatggcttaataatgctctggtttctcttcagatcatataaatctttcaccttttaccaataatggcttaatacaccttttaccaataatggcttaatacacataagcaaaaagactcagttaatataggctataagttggaatcaataatccatgaaagaaaccctggatagggtttttaggacacaggcactgctataccctaatagaatggatcarctttcattcagttaaaaaaaaatctacttcttttttatgccacaaagtgccaccttaaatttatcttagtgattgaatgtcatacccaaaagaatcaaaagcactggagcagttgatctggtagaaacttcagcatgtgtttgttcattccacaaaggtttactaaacccttgctttgtgacaggcactgtataccagttggccttctctctacattatgctgttgcaacaggcaaccccagtaatggtttctttcttgctactggagctctgttctaggtgtcttcattcctggacccaggctgcaggatcagcccctatatggaacatgccattcttatgacagagagaaaggggtactaggagaaccatatagtggctcttaaagtcatgcttggatgtggcacgtgtagcttatattccattggccaaggcaagtcacatggccaagcctggcaccaatggggtaggggagtatcctcctcccatagagcagcactgcagatctcttgacaatgagtgaggatatataatcctcccacrgggaaggcagaaaggatttgggggcaataatactgtctgccacatgctgtcatgaatgctatctagttttagtctcttgataactctgtgaggtaggtattattatcctcattttacagagtggaaaattgaggtttggtgtggctaaccaacttgcccaagatgtagccagtaataagcacagctgcctgaatcgaagccagtaccaatggtatatagccagccttgggcttcttgaggactcattttcatatagatgttgtcattcagtaaacattgataaagcatctactatgtgcctggcgctgtgctgggcattggaaacacastgatgtgcaagacagacactcttcctactctcatggagtttagagtccaaaggaagagagaggcagacaggacacatgtaaagtatgactggtatgtgcttctatgagggagatgcagactaaagcaagagtccatggagagagcatgcaaccagactcagagcataagaaatggacatgtctctgatgactgcacagaatgtaagagctggaggactgggtcacatggctgttgtcaaggccctgcctggcagggtgagtgccaagggcagtttctgattcagaattctaaagggcactcacaagagttcaatgccgatgggcatatgcccagcctgttgctaacgggactggacaaaccagtggctgtgtggcaggaacctaccatgtgcttccgactagtgagtctgacccaaagcccttttcaggcttcttctgggagtgttgcctctgccttacctacactcagagccatgcatgctgaaaaaaaaaacccaaagacccagagatgtcaacaacaacctgagagagaaagagaaacccagatttgatctgattttgaatcggcagagtgacacatgttgcttagactgccaacgcacgccactctcacttccctgaatggtttccattttagtggcattgtaataaaaagaagaaggaaaaaaatcccctgcaatggtttacaaagtgtaccgcaatagtaagaaataccattttctcatcactgctgctgcagcaccagagtatggggcccagcactaggcctgtctttgcaagcaggactaattacatagtaagtgattgcccctcaaacagagatggcatgtgtgctgggaaataggtcacttcttaatgaggtgaagctccagcaagaagcaagcacagatgcagactattcctcttgggatgcaaaaggcatctgaaaggtgagcacatatgtcccataggggagcctctggccaaatgtcacatctccagggaaatgtctttgaaacagatgactctactttcagcttggttatggacacacacaaccttgaaagtttcagaaaatatcacaaagccaaatatatatgtatctgcacgtgcacacacacacacacacacacacgtttgtgtatattaggattcttaagaaaagcagaaccaataagatgtatgtagacatatggaaaaatattatgagggattggctcactcaattatggcggttgagaagccccaygatctactatctacaagctggaggcccaggaaagccaatgatgtaattccagtccaacccagaaggccagaaaccaggggagtcagtggcacaagtcccartccaggtccaatggtccaagaaccaggggcaccagaagacggacatcccaggttaagcggagagagaaagttcacccttcctccacttttgtgttctattctggccttcaacaaattggatgattgcccacccacactggtgaaggccatctttttactcagtctaccaattcaatgctaatctcttttggaaacaccttcacagacataccaagaaataatgttttaccatctatctagccattccttggctcagtcaaattgatacataaaattaaccatcacagtaggtatatgtatcttcttacccttgattgtatttgaaaactacacatggacactactgggctttgagtgtcgacttgctttaaaaatagtcttggagcttggaaaggagcccttcttggagagacaagcaaactgactcagcccgagggttatgggcagagaacctgcaaaaattgtggttcacagccaccatcatacattccttgctaactctgacacaaatggtaaaatgatgaagagctacacattgctggggaaccacggggcctgtgcattcagggtcagccggtggggaggaggaagagcagattaagcaagtatgtcccatgccccatgcctcaataatcaggataaatcatattttaataatgcagtattttagaaaatcaaattagcaaactatggccatgggccatctgcctgtgtttataaataaagatttattggaagcattttttctgaaactattccaagttttactggaacggagtgtagtgtgcctgtttaaattttacacccaagccaagtccttaccacctcatcttagtcctggccctgcctcatatccatttactcatcatttccttctcatccagcactacagagtgccaggcactaggagacagagctaacagttactgagcacttaatatatgccaagtactatcattagcagtttacacatattacctcacttaatccccacaacaatttcataggtaagaacagttattcatgccattttacaaaggaggaaactgaggcatagaaaggtgaagaagctttcccaagatcaaacaagtaggaagaggtagagtcagggttcatatgaagaagtttgagggctttgatggagatggatgcctggagaaaggaaggattactcagctctgagaggtcatcacagaggaggtgactttaagcagggtgttgaagggtgagtagaagattgctaggcagaaataataaatctaggttgctgtagtgtttcagaagasaaaatatatctggagaggttttctctggcttccctaggcccatgtgttgccctaaaatcagaacagcagcaaaataatacaaataaccaacatttattgagtgcttaccctatgtgctaggtactgaactaagtactttatatgtgttatctcattaaatcctcaaataaacctgagaaatgggcactactcttatttctgtctgacatatgaagagtctgaggctcaaaggagttaagtaacttgccaaagctatacagatagtaagtggctgagccaggatgcaaaaccaggggatgccacagtgtgaaccgcagtgggcactgctcatcttgtagtctgtgcaaaacccaaaaacttggtgccagagcttcaggcttagcaaaagcaatatgccagtggtgctcaaacttcacagtgcatccagttcacctgaagggcttgtttaaaaaaaaaaaagcaagcagatttctaggccaycttagaatcagagattctcatttaggaggtctgaggtgaggccaagaatttttatttctaatgctgctggtcctgggaccagacacggagaaccactgtatcacattgactctcagcaacagcaatagtactgtcctcctaagctgcaccagggaatacaagtacaggaggtagttgaaagaacatgcttcttccttcttagtatatagatcaggatccacttagtgagaaacattcaacctcccttctttttattccagttgtccttttctctgacacttgcatcaattttctgattgcctaggctcttaatattgctttctgttcatgtgggctttaatgacttgctcgacatgctagtgcttttgcagaattaggcagcccatgtcccaccacttctgctctgagcctgatgtgcctcttaaattgacacaaactccagctatcaatgtgagaaggatcatgtgtttcctgatggttctctaggctccacaggggccaaattacaccaaaaagtaattggtttcatgtattagtcaggagtctttgggttgcaagtgacaaaacacaatttgaactgatctggaaaaactgacatttactgacatacatatcctgatcacaggaagagcaagggtgccgctggtctgcaagcgtgacacatcagggctttaaatgccactgggactctgcccttcaccccctgcctctctctgggtatcagcaacatcctttcaggcaggctccaaacagcttcctttgactcccaagctctgttttcagtcccaccttgaaatagggataaacagacctggtttctggattctgggaaagggctcttggtggcctagcttagatagttgtccatccctggaccaggaccttggccattttggatgtctacccatacccaatctgagatggagtgggacagggcttgtagaagatgttagctttccctcaaaccataatgtcagagtgagtgaaggagcatttctagaaaagagaggaagagatatttggtaggaaaataaagccccagaggtgagtgggtgagtggaaggagggatgcatgcctcctcaggaccaggtgctgaggtggcagaggggagatggagagaggggagaaggaaagtctcagccttcctggaactcacagtctagaaaggccaagtcatgccagagatgtcagtggaggttggcagacatttctgtggatcacagcaggaggcatagcaaatatttcatctcaaatattttgagaaaacctgggttcttctggatgggctcatctattcacccccacccccaaccaacttttgagcatctactgtgtgttaaacaacatgtctgcactcaagaagctgagcattaatggaatgccctaaggtggcatcagaccttgtctctagtggatcaatcactcccaaagatgcatttaaagctccctgaaaaggagcatctgcgtcttcactggctactgtccccatcctccttatgttgcctgtaaggactctctttctatatccactcaggctttcacaggccaaggctctacctcacttttgcagggtaatctcactgagaatgaagagtcccctcactgtggctttctattttctcactctgggtctgtaagtggagacagtcttctatctctttatgtcattgcctttgatttccttgggattctccctgagattcgttggccatcttaagctgtggcttccagagctttttattaaaaatggaacaatcattgcaaagccccctcagccattcaatagtgtcactagagacacgcttgactccatttctctgactgagctggcagatgttgaccctgggagaggacaggaggcaggtaccactgggcccctgtttccctttctgtcttctccacaagcctctctgctccaggccttcttttttttttttcttttgaggcagagtgttgctctgtcacctgggctggagtgcagtggtgcaatcttggctcactgcaacctcctccgcctccctgtttcaagcaatcttcccacctcaacctccagagtagctaggactacaggcacgyaccaccatgcccagctaatttttgtatttttagtagagatgggatttcaccatgttggccaggctggtctcaaactcctgacttcaagtgatccgtccacctcggcctcccaaagtgctgggattacaagtgttagccattgcgcctggtctcaggtctcctctttctaagagtctagccatgagggtggaggaagaacgcaagccttgctctcaagccccgcctgtcttaagagtctgaggggcagcatagcctgaggaacttatgtgtggcaacgtggggatatcagtcacctgtctcttaccccactgggaatgtcagtagcccctgtctctacctctgcagcaatgtagtaaaccaagtttaaaggtgtcttgcttcatctttgtactttccatattgaggatacctttctctctgcctgtctgcctgggagcttctatttggtggctgtctttactgtctttatttcctcaatgcctagcatagtgcttggagcacaataggtattcaacaaatgactgatcccattaatggaactaatcaaggaaccatctcaaccattcccttaaaagtaagggatgagtagggacaatattgtgggggcttctgatgttattgttggatttggtgaatgataattaagagcacccttaaattccctttaaattcaaaatagattgaaaaatgagacaacatgagctttttatttgtatggctgattagtgaatatgatttagatctgtgtgctgaatacatcctctgctgaattaaactctcccccagacgcagacaggcctggatgacaccggcatcctctgggaataggctgcttttcaaaggacacaggaaagaagtgtgtcctcaggatattcccaaaagggtagaaaggccaccccacacatgcccatccctgtcatagctgggcctgctctgagctccctaaaccctcactgtgccctgtgcccatagtaggccactccaccatcactcttcttggttctcaagttccaggagctttgcaaacaacagatgcttccctagtataaaggaaagaacaagtctttgggccatgggtcctcctcttctcagtgtccctggataaagtcatctaatcaccctgagccttgctttcctcagtgaaagaatggggctgatctcaaccttgcctgccatcgaggctcagatgacctccaaatgcatcctaaactgctcacattcttttgcaaggagggtttttcttcctcaaagcaaatgggagggccaagtaagagaatttatacaagggctttgaaaagagctctgcatgctccttttggaaactgaggcaagtgagcgctaagtaactttctggaggcctcatcgtacaccagctgggattcagcctcaagttgtgcatgttggcctccaaaagccctgacttctcgctagaaggagccttctcaaatgaatcctatgacgacctaatgcaggctcataggtctcactccagaatactgaatcagagcatctgagatcagggcctggaaacctacaggttaacaggttccttgggtgcttcttactgcagtagctcaagctgtcccatggtgatgggctggagctgccacatacaggccaattgttctactcagttattctcatctctgccatttccataatgacttagcatctatacccatctctaaaatgttaaggcactttgccaaacattattttgtttaattgacagacagaaccatatagtggttaagaacctagtttctggagctaagctccttggtacccagttgcagctggggtgcctcccagcttcgtggtttgtgcctccatttccttctctgtaccatgggaatgcgctttgcatcctacctcataagagttgttagcagtgaagacttcagtgcactaaagtacatagaatagtgcctgttgtggagtaggtgcttaataaatcttcatttattattcctaatgaggaaatggaggatagatttgtgtaggatacagtaaaaagtggactgaccacagccaacacccaggttttctggttctacttctacacttccatgaacttaatctttgtttgcctttcaaagtcacttagaatttaaagcagtagtaaaaatacctcaaatgcagtcaaccaacaaatatttattaggttttactgatgtgtgcaggatgctgtaggaagatatgaatggatgttattagcacacctaagctgcttagatgggcttgaagggttgagagaacagagaagtagyggaatgaaagcagctttgaatggcaggagcttgtctagggagcagaggcctaggtctagctgagctgctcacctggtccccatcgcccacaaagctttaatcaagatattctgatcaggccaatgcttctgaacaggctaataaggaattaacacataaatgttgcttagcaaacttctccctagcatggaactgaaacagggacagtgctgagagggaggttttgttttgttgttgttgttttgtttttgtttttgagatagggactcaaatggcaaacaggtatttgacaaggtgctcaacatcattgatgatccaaaaaatgcaaatcaaactacagtgagaatcatctcaccccagttaaaatggctgttacctaaaaaacacgcaataacaaatgccggcaaggatgtagagaaaagggaacactcttggtgggagtgtaaattagtacaaccactatggagaacagtttagaagtttctcaaaaaactaaaattagagctaccatacgatccagcaatcccactgatgggtatatacccaaaagaaaggaaatcaggatattgaagagatgcctgcactcccatgtttgttgcagcattattcacaatagccgagatttggaagcaacctaaatgtccatcaacagatgaatggataaagaaaatgtggtacgtgtacacaatggagtactattcagccataaaaaagaatgagattctgtcatttgcaacaatatggatggaactggaggtcattgtgttaagtgaaataagctagtcatagaaagacaaactttgtttattttcacttgttggtgaggactaaaaattaaaacaattgaactcatggacatagagagtagaaggatggttaccagaggctcggaagggtagtggggagggggaagtgggtatggttaataagtacaaaaatatgattagatatataactagaatgaataagatctaatatttgatagcacaaagggtaactacagtcaataataatttattgtacgttttaaaataactaagagtataattggattgtttgtaacacaaagaaaggacaaatggataaatgcttgaggtgatggataccccatctaccctgatgtgattatttcgcatcgtatgccagtatcaaaatatataatgtacttcatatattatacctacagtgtacccacaaaaattaaaacagtaaaatttttttaaagagagagagagacagggtctcattctgtcacccaggcaggagtgcagtgcatgttcatagtccactgcagcctagagctccagggctcaagagattcaccagcttcagcctcccaagtagctagggctgttggtgtgtgccaccacgtccagttattttaaactttttgtagagatggggtctcactatggttgcgtaggttggtcttgaactcctgatctcaagtgatcctcttgctttggcctcccaaagtgttaaaaatataggtgtgagccactgcacctggtctttagtctggtttttgacaagaaagagccagccagctgtctgcccatgtctttgagctacatgaagattagatcccattagtcttggagagggagcaacaagaaatagaagagggcacagaactgcacgtagcctcacctacttcaaaagtttcccctaaaaccccttaggcattcaggaatgggtgagaaaagggttttctttctatgagagtggggattcctctataaaatttccggctttcaggatagcggactcacattaaagtgttaggggctagcctgaaaacctaaattgttttccttgacaaaatgtgccatagatgcgaatacctgattctggttaaagagttggtttttgctgattatgtagtataaaatggaatctgttttccactttccttctcttctaccatccctttgctttttctatgctctctcctctctcaccatttgttccattcatgctctctctcttctttttcgtctccttctttttccttctcaccccactcctcctttttttcccctctctctccctcttcttttcctctctgtctatctgttcttgttttcttaaccccatattctacaaagcatttagggtggcttgcagaaatggaaactaatatagtaaaatgtaagtaaaacatgtaagatctggctgggtgcggtctcatgccttcaatcccagcactttgggaggctgaagtggatggatcacttgaggctaggagttcgagaccagcctgaccaacatggcaaaaccccatctctactaaaaataccaaaattagccaggcatgatggcacatgcctgtaatccgagctacttgggaggctgaggcatgagaatcgctggaacatgggaggcagaggttgcagtgagccgagatcatgccactgcactgcagcctgggcaatagagccagaccctgacttaaaaaaaaaaagaaaagaaaagaaaaaaaaattgtgagtcagatgctcaatggcatcaaggagataattcatatagaaaacaagtattcaggaatgaatttattgaataaatcatcataattaatgtgtttttcaggatcaagaggagcaaaataatttaggaacaaatagttctgatgagatgctaaaaacttacctaatgtgtatacgacttcatcttttttcttcagtcttgaccactttttggtgcgaacttctccattgactttgagacccttaaccctatatatttttaataatactattggggtagctaaaataaattagtacagtgaagtatatctctagtctcttaaatacatctctaaataatgaatatattcctgaagatttctttgtatttgtaattattgcagatcaaatattttatttccatagaaaactgaccttctaaagatgayacaaggtgtctctctttagtattaaagaatttatgctttaaaactttagatactgggtatggtggctcttgcctataatcccagtattgtgtgaagctgaggtgggaggatcacttgaggctgggagttcgagaccaatttgagtaacaaagcgagactagattgagcaacaaaatgaggccctacaaaagaattaaaaaaaaaaagttaaattaaaatagataaataaacaaaattttagaaactttgggccaggtatggtagctcatgtctgtaatcccagcactttgggaggccaaggcaggaggattgcttgaggctaggagtttgagaccagcctgggcagcataggaagaatctagctctataactttttttttttttttttaaagaaaaatcagctgggtgtggtggagtgcctttaatcccagctactcaggagactgaggtgggaggatcacttgaccccaggagttcgaggtttacaaagcactatgatcgtgccactgccactccagccagggcaacagagccacaccctgtctcttagaaaaaaattttaaaaaggccgggcgtggtggctcacgcctgtaatcccagaactttgggaggccaaagcaggtggatcacctgaggtcaggaggtcaaggccagcctggccaacatggtgaaaccccgtctctactaaaaaatacaaaaattagccaggcatggtggtgcacgcctgcagtcccagctactcgggaggctgaggcaggagaatcacttgaatcaaggaggcagaggttgcagtgagccaagatcacgccattgcactccagcctgggtgacagagcaagactcygtctcaaaaaaacaaaacaaaacaaaaacaaaaacaaaaaactagatattttgcacgttacctttttaaaagcctgacatatctgtatgatatccctgcactaaacatttgctatccataatgaggtaaaatgtgcttgggctttttccccaatgtgaaatatgcttaattgtcttgtaaaactgtcttgagtaatcccagcactttgggaggccgaggtgggccgatcgcgaggtcaggagatggagaccatcctggctaacacagtgaaaccccgtctctactaaaaatacaaaaaaattagccaggcgtggtggcgggcacctgtagtcccagctactcgggaggctgaggcaggagaatggcgtgaacctggggggtggagcttgcaatgagccgagatggcaccactgcactccagcctgggcgacagaacgagactccgtctcaaaaaaaaaaaaaactgtcttgagttttctttctttctttttttttttttttaacagtcttgctttcttgcccaggctggagtgcagtggtgtgatctctgctcactgcaaccttcgcctcctaggtttaagcaattctcctgcctcagccacctaagtagctgggattacaggcatgcaccaccatgcccggctaatttttgtattgttagtgaagatggggtttcaccatgttggccaggctggtcttgaactcctgccctcaaatgatcccccmaccttggcctcccaaagtgctgggattacaaacatgagccactgcacccggcytttgagttttcttttattccggctgcatacctcccagttaatctgacatctttctcacctcattaaactggmtccaactgctaatacgtcatcaaattcaaaagaaatgcgacccgctaccaaaatccagatctgaaaacatttaaccttaggctgtggttcaaggtgcaaagaaagctaatatctaataaagccttggtatagtgtgttccttgagtcaacgtttgagaaactgaatgacatagagctgcgtgaaagtttagggggtaaaagtgtatttgattgaatgtaattaatgtgtttttctgaatgattttcttacagttcacaatgaaccttccaattttacagtaattttcttggccttgattttctgatctgtcttaatttagctgtcaatactatgagtaacaaaattcagtttcattggtgatccttgaaagagaaattccaaaaataaagggctataagcacctcctatgaaaagattcatgcagctgtttcatctaatatggatctgataggtttcctttatgtccagttcttcctttctcaacattttctctgattttcaggcagatgcaaatagaattttcagtgctacggcttctctgacttaaattttctgtttcccttgtgtttgtgccaattaaaacaagactcagtctgtgcttgtgacatatttttggaaattcattgtgtaagaaatattgacattctcttgtattattttctctgagtctttacccacttcatcacaattcttgcctttcttttccttgaagtctgtgtgtttcatatgttttgaaaacttctgtcacatattttagttattataatggataactgcattgaggagaaagctctaaatcataggcttggaatgactagttctagaagcatttcctaaagcacatgcccctcctcaatagacatttctctgccatttattttgtgcagcagttcatatttgtggcctgatgctatctcttttctcagaaatttcagtaagtgtttcaacttgagtaatcatttacagaaacataatgtagtggacattcaataataaactattgccatgacattgaattgtcttatgatctttggtggaagctgtgtgaatatttacattgtcaggatcatgcacctacccgttatgttctgccttcctttctctattcttttcttttcttttttttgagacagagtcttgctctgttgcccaggctggagtacattggcatggtctcagctcactacaacctccacctcctggattcaagtgactcttctgcctcagcctcctgagtagctgggactacaggtgtgcgccaccacacctggcttatttttgtatttttagtagagagggggtttcaccatattggccaggctggtctcgaaatcctgaccttgtgattcgcccacctcagcctcccaaagtgctgggattacaggcatgagccaccatgaccagcctgctttcctttttcataatgtgattttcatgtacacgtctctgtgtttttcagcttcagataaaaacttgctatcttttgggcatttctttgatatatcatctccaaagtgacttattaagtcaaaaatataaattattttatcatttcctggaatgctttttctacaagtaacagaaaattatatctcagttggcttgaacaacaagaaaacaatataattgcccataacaagaattcctgtggtagggctgctatggagttgtttaattttacaacacagtgacatcctcaagggcccagtttgcttccatgtttttgttctgccatctttgggggaacatctctgttgtgaaggatgtcctcatggtcacaaaatggctgccacagcataaacatcaccgtacctcacagatatgacaatgttcagtggaagaagaaaaggaagtttcttcatctgtgtctcttttaacgagcaagaaaatattagagattcctcatcagtctctgtttcattgttcattcaacatttctttggccagtccctttcctaaaccagtccctggcaagggacataggatttctaccatgaatttagtatgggttctgttctacagagtaagggtgctttctgctacatgtcctttgacatgtggcctaggttattattatctcaagaggcaaaactgctttatagtaccaacctgcagtctaataagtgtgtttgttccctaacaaagctaagtttctatatgtttttgcttattgttataaatttgaagggtccttgtataatgaaaatattattgtaatttatgtttcttcagtgataacaaagtcatatgcagtctttttagaatgagttagtttgttttcatttcctctagtgttttacctacactgaatttgaaaactccattctaaccaattttatatagtcattgtgccagaatatttgccaccactcattattctgtaacatttttgagtcacagaccatatctactaaataagccaacattccaaaagtcttccttataagatgttaacatttaaaagtaggggaaaataaaagaaagaaaaggaaggaagggagggaagaaggaaggcaagaaggaagcaagggagggagggaggaaggaggaaggaaggaaaagaagggaaggaagggaagggaagggaaaggaagggcgggaggaggaagggaggaaggaaggaagaaaggaaaagaaaaagcaagcaaacaaagaagtgaagggatagtaatgtggtttggttgtatccctacccaaatcgtatctttgaattgtagctcccataattcccacttgtttcgggagggacctggtgggagataattgaaccatgggggtggtttcccccactgttctcgtgttagtgaataagtctcacaagatctggtggttttataaggggaaaccccttttgcttggctctcattctctcttgtctgcctccatgtaagatgtgcctttgccttctgccatgattgtggggcctccccagccaagtggaactatgagtccattaaacctcttttcctttataaattacccagtctcagttatatctttatcagcagcatgaaaacagactaatacagatgtgttgagaggtcaaaaattctagatactttgggattgaaagacatattgaatctggagcgaaaaggacaccccatttaacaaactgccaaatgcccctctcccaagggcccctcccttcccacctttatctgaacatcgaagtgtgccatcctgttgtcttgccyaacaatgaatggcaaggcaagcagctgggactatctactcgtagcttgtcacaaatgtgctccaactccagaggatgrtgcagtaatttcctccctttttctttcgggttgtgctttctgctactcaaaagttctgctctcctgtgatcaagatggtaagtcctgtttcatgctgttgcccctttggaattgtgccttcaaattccatttgcctggaacagtcacattcttcagagtgatgggcctcaaccacaaaacagcaacagcaaaaaacatttttctctaatatttgttactccaaataggttatcttcaatacgttattgtggtaagagwttcttctcaggagtgtttgctgctgtcaggggtaacatggtgaaggatagagcaagccctgccatgctccagtctcagctggctgtgtggattccacccaggaaaaccctgccagcttctcctactgtgggtccatcacagtctgtccattcttgtcccatctaagatataagttgtcatagatggctgccccctccaccattcgccacgtgggcatgtaggtcacatctcaatatgtccctaaagatccctctcctaatctaaatgctgaacttccacgtcagttaaggattgtttctctaaacacacaccaaaaggggaaaacatagttacttcctaaattcttatatccagaatggaaataatttcgggartaacaaactccttatgtttaccactgttccactgtttaagtcactgttttcttttttctttctttcttttttttttttttttcttttgtggcagggtctcactctgtcacccaggctggagtgcagtggtatgattttggctcactgcaacctctgcttcctgggttcaagtgattctcgtgcctcagcctcccacgtaactggggttatagagcccagctaatttttccatttttggtagagayggggttccagccatgttggcaaggctggtctcgaacttctgatctccagtgatccgcctgtctcagcctcccaaagcgctgggactacaggcgtgagccaccgtgccttgcctgaacgcattgttttcttaggggttggctagatgtcttcatgaagatgcaacaggctgcacttcagtgtgtcagaacaggtgtggcacagtgagcccacatatttctgtatagtgtcgtcaaagctctttccattagtgaccctatgtaagcgtaccccaagttgatcctagtctaaaaagcagggtctcagggcagagttcagagccagctcctcagattcttagtccttgcttcaagagctacctttaaaatggctcaaaaattcaactctctgtcaaagtaaaagtgaagccatctggctaggttgaacaaaggcagcttcgctttactgcaataggcatcagaccaaagccacagatcatttgggtgtgggaatgtaaagctgaatcagtgacattgccagaaaatggcacatttgccagaatactttgccttttgttccttgtgagataaacatgagcccagaatcctgtaaatctgtggtaatatttttactcttggagaaaaaaattagaagacaacgttgagaggctttttccgcattttccaaatttccttttggtgccgagtaatttgttttcaactagtgtaagagggccatcttgggctagtagggaagtcctctaagttagggctcagggatatgggcttcctagggcaattaccccttacctctgtttctgactgttgggggttcttgaagcagctcacccagggtgagactggtgcagagagcaacatttctgcctccctggttgggaagggagccaggttatttttttaagtgctacctattgacagcattttctctatgtctcagtttttcttcttcctctaagagctttttataatagccttaaccatcatcacatttttttcttttttcttttttttttaagacagagtctccctctgtcactcaggctggagtgtggtggcgtgatcacggctcactgcagcctcaacttcttgggctcaaggcatcctctcacctcagcctcccgagtagctgggactacaggcaagcaccaccacacccagctaatttaaatttttttttttcagagatggggcctccctgtgttgcctaggctggtctagaactcctggactcaagcaatcctcctatcttggcctcccaaggtgtaaggattacaggcgtgagccaccacacttagccaccacacttggccaccacgtctttaagattatgaataaaaaggtgtcactttcgaagattctcaragggagtaactcctccccctaatactgagctgcagtccatcttaagccttgctggtatacatctcaaagaagaagatattgrggatagcttgtgcaacgtagctctggtggccgctaaggaaagagcaaacagctctatggctgcagacatcaggctttaaatgacaccaggatggtgaatgacctaggaacataaacaaagggatgtctcagctgggacataatcgcatcctggaagcttgaaggctgttttgtagaggaagaatagacgtgtgtttgactccagaagaccatgctaggaccagtagttacataaaattaaattctagctcagtgtcgagaagaacattctgacctgaaagttgctaaaaatggaatgggctgtgtattggtttcctaggactgccatagcaaagtaccacatattgggtggcttgaaacaaccttgttttttttctgggttgaaattaatttcttctctcacagttctggagcctagaagtccaaaatcaaggtgttggtagggctatactctctctgaaggtctaggggtgcttccgggcctctctcagcttctgctccccgaagcattgcttggcttgtggtagaataactgtcatctctgcctctgtcttcatgtaaccatcttcttggctgtcagtctctcttcttattaaggactcccagttatattggattaaggcccaccttgatgacctcatcttaacttggctacatctgcaaagatcctatttccacataaggtcatattttgaggtactaggggttaagatttcaaaatatctttttaattttatttactttgtttatttattttgagacagggtctacttctgtcgcccaggctggagtgcagtggtgtgatcatgactcactgcagccttcctgggctcaagtgattctcctatctcagcctcctgagtagttgggactgcaggcatgcaccaacacaaccagctaatttttgtattcaaagtatctttttgaggaacacaattcaatccataacaggctgcctttatgaaagtgagttccttatccctggaagtgtgcaaatgtaatcagagtttttcaaaatacttgaagaggtgtaagcgctaaagagagaatgcaactagatgacttctagcatctcttctgaccatagcatttcctaatgctatgagtcctgtagtaaatgactctactaaatcctgggaccacacttgggaagaccacacagtcttggtgaaatgtcacatgcacggaagcatagtctagcttccaaaaaccattgaaaggagtttcaatcttttcttttaaattcatatatatgwatatatatatatatakakagagagagagagagagagagagcagagagagtttatttgggccaagcctggggactgcaacccaggagcatagattcaagttgccctaaatatacactccctccttttaattcttaaagaacatcaatgaagatccctttttctgtcccctgcagctgctcctcttggagtctctctgttcagtactcttttggtcacacatgacagaatcctaattcaaagtgccttaaaaaaaaaaaaaaaaagataatatcttcttgcaaatttgaaaagtccaggagttgttgttttggsttggactccatttcccagctttgccttcctctctgtgggctttctcttctgcatagtgtttccactaagaggtggccaccagggttcccaggtgttatttagcaattgagcaatttagcaaactcattgagaagagtttccttcttccagcattctaagggaagtcccagggctggctctcattgggccaactctgtcacgtgcatttatcacatgcccatccctaaacttgtcagtaggacactgaccacctcctgaggaagaaaacttaggaatggaggcacctctatgtgagttgcataaactaggaatagaagagggtagcagcccaaagggaaattggagtgctattaacataataagggggagtccgtgttgggagggccaaaggccaaaaccatcactgtctactctgattcctcccctcacaccactattctctcttccttcctctcctcattctccctccccttcctctctccctttcttctctccctctgtttttctctctctcctttcctctctctctccctcttctttttcactctctttctctctgtctccctttcttctcctcctctctcttttactctctccccctctttttctcccctcacatctctcttcatctctccctgtctctcaccctcttcctcctctccctcaagtctaggcagctcagcctctctcttttttctccyttctttttcctcctgcctctccagcttatctcttcctacttattttcccaattcagtattataaatacctagctactgggctggcaaatactgaactctcccttaagggtaaggacgggaaagaaatggagcctgccagtgccaggttcctttagcagctaaggggagggaggacgggaggaactcccattggtaacttttattcacatcgtatatcaaatcatcagagtgatcctgtgtcattttgagttgtgagtgctttaaaaatttgcatgtgtgtccaggacagagatagatgaatttgcacatgacggcggaggaagactttgggatgtatccactttgatgctaagttatggatacatcccaaaagactagacaaacagtatctgtgttttagcttccagacttctgtagtgggtccagccaaactcccgaatgggtttttaaacttgagaaacctcaggcttttttgtttccaatcatacaagcactcttgaattgaaagcaacactgggtcataaagcaatatgaaaactacataactaatatcttgatccttctgctttcagcacatttagccccacagcagtttagactcaaaccctctaaacaaaccaaccccctcaccccactcacaaacagcctgccaagagcattgagcgtccagtccctggactccatcctgaccacctcctactcccccgtcctgcatcactggtcttgctttggtcatctctgtgttctccattgctctgtctcccctccgccaccctacacccacaggcttggtgagttgtcccccaacactcatatttagactctcccttcctcaagcccccttgctctctgactctgctgggaggctctgatcctgagccctgccatggacctggttctgggagttgacctttgccccacacccatcagctgcgagtcaggggctctcttgttctatgccttgacctggtggtacccaagtgcattcatttgctagaattcatttgccataacaaaataccacagcatgtctacaagccaccagggctgccatgtataacactgggtggatgattaccctaaaacccttctggaactttccagataattcttttaaaaatattctcttttataggcttctacgtgattcaagtgagtttcctaaatggctgggtgagctcccataggtgacctgacactgccacagccctctcccacccagggactggagaggaagctctggcaggacacccagaactcagggtggaaatggaacatcctggccacctacccaggagaggcctcatgtagtaagaaaagggagaggaaggagcagtgctagaaatcagattatmcagacagaaaaccacctcccagactgcctgatggcagsgggtgggtctttccatcttaatctttccagcccaagcaccatgcctgcaacacaacagaaatgcaaggaatgcagttgaggtggtgcattagtctatcctcacgctgctaaaaaagacatacccaagactgggtaatttataaacaaaagagatttaattggctcacagttccacatggctagggaggcctcacaatcatgacagaaggtgaaggaggagcaaagtcacatcttacatggcggcaggcaaagagagcatgtgcaggggaactcctctttataaaaccatcagatctcacaagacttattcactgtcatgcaaacagcatgaggaagacccgtcttcatgactcagttacctcccaccaggtccctcccatggcgtgggcattatgggagctacaatttgagatttgggtggggacactgccaaaccatatcaggtggggagtgatgtgagcacagctacatttctgaaaaataatgatggtcatggaatggaagacagatctgagctgaggaccttggaggcctgaactggtgcacttgccatgaggatggagargaaggatgaggcaggaaagatactgcaggtcccagcttctccatgaatccaagggctttgctctccactctgccttcagcctagtgacacaatttatacagcaagagaaggaatgtcacagaccaccagatgggtagctgacccttccaagagcacaaagactctaaatatgtccctgtcaccacctgctgttttaacaactagttgtttaatacatctcctctggatggaaactagatccaagacagtgactctgggttttgtttaattttatgtcacatttttagggagcaaatgttaaatatgtttccagcctagtaaaataagggtggcaaacttaatcattagagtatgtggagaatataacaggatcttttattggacctggaaaggggccccactgaatggtaatatttgtgaaataattggagaggaaaccaagttttaagctattagttctctaacctttgagtagggaaaaggaacagtcccttgaacttgctgcaagtctcatggttgcttaaaaaggctttaatttctgaggactggcacaggccagccaaaacaaaccatttccaaaattagtttgggcctcaagggtcctgtaaaactcattttaaacaatgtaccatgatccttttttgctctcattttgtgcaattggagtctgcttccttcttcatatacagaaggatgtttaaaacgcacctttgagggtagggtgttgaaacacccagttttctgacccactctcagatgctatgacagagaaaagctcttttctccttcaagagaggtccaagcttctgagtgtactgtggtagctggaaagctattgcagcttcatgcccagatatgcatctgtgtgtgcacatgcacatgggtgtgtgcatgggctgtgcacatgtatgtgtgtgggttggcatgcgtacacacaagcctgcacataaatgtctaagagtgcatgtgtgtgtgcatgtgtgtacataagaacatatgggccaggtgtggtagttcacgcctgtaatcccagcactttgggaggctgaagcaggtggaccacttgaatccaggagttcaagaycagcctggcgaacgtggtgagaccccatctctactaaaaatacaaaatttaactgggcgtggtggcatgtacttatagtcccagctacccaggaggctgaggtgaaaggatcacttgagcccaggaggttgaggctgcaagtgagtcatgatcacgccactgcatgccagcctgggtgacagagcaagagcctctcttgaaaaaataaataaatatataataaagtaataaaaagtaaataaataaatattgattccatcacttgttagctcagtcattttaacttttgcaagcctgttttctcatctgcagagcggggataatattgtgtctacctcatcatgttgtatgaggattaagtaaggtaatacacataaaggctatatatagtacatcctctggatagtctcgctgtcattactgctactattgcagccccgctggcaaacagagcaagggggttgagaagacatggggccacactggcaagacattgagggttttatatacacatatatatatttgagatcctttaacatccactcagaggcactcagagaggactcccctactcaaggagaaatagttggggttgcaggagaggtttccaataacctatggtgagttcgagaaaaataacttatccaaaagatggaccttcctgtttctcaatgagctctcctaagagagagcagaagagggagagggaattgccctctatttggaggccrcagggcctggtcctcatagctatcctaaggaagagaaagctcaggaccaaggaagagccaccacctggagtggggagggtgggacggggttgcatcctgccctcctccttcaaacccggggcagagcttcccatccagaggaagcaggccccatcagcttatcctggggtggggcttcctaaagccaagtgtttaaaggcagatcattgttctgaagttccgctaagttctaatgcccaccctgctgagaaatcctccaagaacaaagtgagattttaaaaatccacaggkttacttggagccaaaggcaattaagaggaagagaaataactggccaagtctcaatgtgatggctgtctgtgcagagactctagtgaggaagagagctaaccccattctttttgttgtgatcaagcaagatgattccccagtgggccaatcttttgcctataaaatggggttgatatgattttgtccaggaagaagtctggtttaggaaaagcagaggcattcttgtctccttcagtcccagcttagtggctactgactgtgagactttgacaacttattttccaactcagagccttgtatctctccttgaaacccaaaaggccgggctccagacttcctcaaagttcctttgctgtgtctatgacagtgggctgatgaaggtagaagcaggggtgtgatgaggacgagaataatcaggatggataggaaggctggaaggctgagaagggtataccaaagtcccagcaaacaaaagcgaacactcaatagccgtggagggcgcctcaccatgtcctctccataagccaggctacataggtcatcatctgggatcttatttttctgaattgtttgtggctcagctcttcttaatatrgtactttctgaccagggcgggggggtggggagcctgtagtctcagctactcaggagactaaggtgggaggattgcttgagctcaggcattcaaggctgcagtaagctatgattgcaccgctgccgtccagcctgggtgacagcgagaccctgtcgcaaaaaaaaaaaaaaaaaaagggggatagtccattctagctgcccaatgtgcatgaccttgtgaggtagtaagaaccatgaccaggaaaaggccatgtcatccatcaggtgacttygtagaggaggcttctgccctgatgggagagtagcttaggcagcctcgaggccccttccacttcaatttgggaaatatttaatgagctcccactgtgtgccagcccagactgtgctgactgaggcctggggtgggacagcagggaggacagtccctatcttcaaagtgctcagggtctggctgggcacggtggctcacgcctgtaatctcagcattttgggaggctgaggtgggtgcatcacctgagatcaggagtttgagaccagcctggccaacaaggcgaaatcccgtctctactaaaaatacaaaaattggctgggcttggtggcgtgcacttgtaatcccagctacatgggaggctgggtcagcaggatcacttcaaccttggaggtggagattacagtgagccaagatcacaccaagatcacaccactgcaccactccagcctgggtgacagagcaagactgcctcaaaataaataaataaataaataaaataaaaacaaataaaaataaaaaaaatgtgctcagggtctcaccacccagacatggtctagtctagtccacccatgtggttcctgcctctccagtttagggggatggactgaggcctgggaccatctgttcccagtgccctctgccttctctcttgtagcattcttcttttctccttcggcactctctgaagctcctgtcgcccaaaacttcctgcccagaactaacacttctcatttaacaaacacttggatgagactaactgtgtataagcccagttcctgcccacaggtgctttgcgtggagaacggcccgctgaagcagcatcgaccaggaagcaccatgagacacatgtcagggctctccctgcctaggccctaatttgtgtcccactaaatggggccatgatcagaactgtgagttcccagcagagggtggaggtggagatgccacactggggctgagctaagacaccaccaaggaggagctggcagcagaaggctgagtcccaggatcccctgtgtacttagcttacacaaatttgagtgtagattcttccttttctttccttttttttttttttaaagactgaaatttttgtatttattgaatggaccattccatttttctctattttttttctttttttaattatactttaagttttagggtacatgtgcacaacatgcaggtttgttacatatatatacatgtgccatgttggtgtgctgcacacattaactcgtcatttaacatcagggatatctcctaatgctatccctccccsctcccccgaccacacaacaggcccccggtgtgtgatgttccccttcctgtgtccatgtgttttcaytgttcaattcccatctacaagtgagaacatgtggtgttgggttttttgtccttgccatagtttgctgagaatgatggtttccagcttcatccatgtccataaaaaggacatcaactcatcattttttatggctgtatagtattccatggtgtatgtgtgccacattttcttaatccagtctatcattgttcgacatttgggttggttccaagtctttgctattgtgaatactgccgcaataaacatatgtgtgcatgtgtctttatagcagcatgatttctaatcctttgggtacatacccaataatgggatggctgggtcaaatggtatttctagttctagatctctgaggaatcgccacactgacttccacaatggttgaactagtttacagtcccaccaacagtgtaaaagtattcctatttctctacatcctctccagcacctgttgtttcctgactttttaatgatccccattctaactggtgtgagatggtatctcattgtagttttgatttgcatttctctgataaccagtgatgatgagcattttttcatgtgtcttttggctgcataaatgtctccttttgagaagtgtctgttcatatccttcgcccacttgttgatggggttgtttgtttctttcttgaaaatttgtttgagttcattgtagattctggatattagcccttcatcagatgagtagattgcaaaaattttctcccattctataggctgcctgttcactctgatggtagtttcttttgctgtgcagaagctctttagtttaattagatcccatttgtcaattttggcttctgttgccattgctttttgtgttttagacatgaaatccttacccatgcctatgtcctgaatggtattgcctaggttttcttctagagtttttatggttttaggtctaacatttaagtctttaatccatcttgaataaatttttgtataaggtgtaaggaagggatccagtttcagctttctacatatggctagccagttttcccagcaccatttattaaatagggaattgtttccccatttcttgtttttgtcaggtttgtcaaagatcagttagttgtagaaatgtggcattatttctgagggctctgttctgttccattggtctatatctctgttttggtaccagtaccatgctgttttggttactgtaaccttgtagtatagtttgaagtcaggtagcgtgacgcctccagctttgttcttttggcttaggattgacttggcaatgcaggctcttttttggttccatatgaactttaaagtagttttctccaattccgtgaataaagtcattggtagcttgagggggatggcattgaatctataaattaccttggacagtatggccattttcatgatattgattcttcctacccatgagcatggaatgttcatgcttttgtttgtatcctctttgatttcattgagcagtggtttgtagttctccttgaagaggtccttcatgtcccttgtaaattggattcctaagcattttattctcttcgaagcaattgtgaataggagttcactcatgatttggctctctgtttgtctgttattggtrtataagaatgcttgtgaattttgcacattgattttgtatcctgagactttgctgaaattgcttatcagsttaaggagattttgggctgagatgatggggttttctagatatacaatcatgtcatctgcaaacagggacaatttgacttcctcttttcctaattgaataccctttatttccttctccttcctgattgccctggccagaacttccaacactatgttgaatgggagtgatgagagagggcatccctgtcttgtgccagttttcaaagagaatgcttccagtttttgcccattcagtatgatattggctgtgggtttgtcatagatagctcttattattttgagatacgtcccatcaatacccaatttattgagagtttttagcatgaaggttgttgaattttgtcaaaggccttttctgcatctattgagataatcatgtggtttttgtcattggttctgtttatatgctggattatgtttattgacttgcatatgttgaaccagccttgcatcccagggatgaagcccacttgatcatggtggataagctttttgatatgctgctagattcacatcaaataaaatactgatgtgccagtattctattgaggatttttgcatcgatgttcatcagggatattggtctaaaattctctttttttgttgtgtctctgccaggctttggtatcaggatgatgctggcctcataaaatgagttagggatgattccctttttttctattgattggaatagtttcagaaggaatggtactagctcctctttgtacctctggtagaattcagctgtgaatctatctggtcctggactttttttggttggtgagctattaattattgcctcaatttcagagcctgttattggtctattcagagattcaacttcttcctggtttagtcttgggagggtgtatgtgtcgaggaatttatccatttcttctagattttctagtttatttgtgtagaggtgtttatagtattctctgatggtagtttgtatttctgtaggattggtggtgatatcccctttataattttttattgcgtctatttgattcttctctcttttcttctttattagtcttgctagcggtctatcaattttgttgatcttttcaaaaaaccacctcccggattcattgattttttgaagggttttttgtgtctctatatccttcagttctgctctgatcttagttatttcttgccttcggctagcttttgaaygtgtttgctcttacttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtacccagtagtcattcaggagcaggttgttcagtttccatgttgttatgcggttttgagtgagtttcttcatcctgagttctagtttgattgcactgtggtctgagagagtttgttataatttctattcttttacatttgctgaggagggcttcacttccaactatgtggtcaattttggaataggtgtggtgtggtgctgaaaagaatgtacattctcttgatttagggtggagagttctgtagatgtctattaggtccacttggtgcagagctgagttcaattcctggatatccttgttaactttctgtctcrttgatctgtctaatgttgacagtggggtgttaaatctcccattattattgtgtgggagtctaagtctctttataggtctctaaggacttgctttatgaatctgggtgctcctgtattggatgcatatatatttaggatagttagctcttcttgctgaattgatccctttaccattatataatggccttctttgtctcttttgatctttgttggtttaaagtctgttttatcagagactaggattgcaacccctgcctttttttgttttccatttccttggtagatcttcccccatccctttattttgagcctatgtgtgtctctgcacatgaggtaggtttcctgaatatagcacactgatgggtcttgactctttgtctaatttgccagtctgtgtcttttaattggagcatttagcccatttacatttaaggttaatattgttatgtatgaatttgatyctgtcattatgatgttagctggtgattttgcccgttagttgatgcaatttctttctagcatcgatggtctttacaatttgacatgttttcgcagtggctggtaccagtttttcctttccacgtttagtgcttccttcaggagctcttttagggcaggcctggtggtgacaaaatctctcagcatttgcttgtctgtgaagtattttatttctccttcacttatgaagcttagtttggctggatatgaaattctgggttgaaaattctttcctttaagaatgttgaatattggcccccactctctcctggcttgtagagtttctgctgagagatcaactgttagtctgctgggcttccctttgtgggtaacctgacctttctctctggctgcccttaacattttttccttcatttcaactttggtgaatctgacaattatgtgtcttggagttgctcttctcgaggagtatctttttggcattctctgtatttcctgaacctgaatgttggcctgccttgctagattggggaagttctccaggataatatcctgcagagtgttttcaaacttggttccattctccctgtcactttcaggtacaccaatcagatgtagatttggtcttttcacaagtcccatttttcttggaggctttgtttgttactttttattcttttttctctaaacttctcttgtcacttcatttcattcatttgctcttccatcactgataccctttcttccagttgatcgaattggctactggggcttgtgcattcatcacgtagttctcgtgccgtggttttcagctccatcaggtcctttaaggacttctttgcattggttattctagttagccattcatctaatattttttcaaggtttttaacttctttgccatgggttcgaatttcctcctttagctcggagtagtttgatcgtctgaagccttcttctctcaactcgtcaaagtcattctctgtccagctttgttccattgctggtgagctgcattcctttgggggaggagaggtgctctgatttttagagtttccagttcttctgctctgttttttccccatctttgtggttttatctacctttggtctttgatgatggtgatgtacagatggggttttggtgtggatgtccttgctgtttgttagttttccttctaacagtcaggaccctcagctgcaggtctgttggagtttggtgaaagtccactccagatcctgtttgcctgggtatctgcagcggaggctgcagaacagcagatattggtgaacagcaaatattgctccctgatcattcctctggaagttttgtctcagagcagtacccggctatgtgagatgtcagtctgcccctcctggggggtgcctcccagttaggctactcgggggtcagggacccacttgaggaggcagtctgtccattctcagatctccagctgtgtgctgggagaaccactactctcttcaaagctgtcagacaggggcatttaagtctgcagaggtttctgctgccttttgtttggctgtgccctgcccccagaggtggagtttacagaggcaggcaggcctccttgaggtgcggtgggctccacccagttcaagcttcctggctgctttgtttacctactcaagcttcagcaatggcaggcacccctcccccagcctcgctgccgccttgcagtttgatctcagactgctgtgctagcaatgagcgaggctctgtgggtgtgggaccctctgagccaggcgtgggatacaatctcctggtgtgccgtttgctaagaccattggaaaagtgcagtattagggtgggagtgacccgattttccaggtaccgtctgtcacccctttccttggctaggaaagggaattccctgaccccttgcacttcccaggtgaggcaatgcctcaccctgcttcggctcatgcttggtgtgctgcatccactgtcctgcacccactgtccaacaatccccagtgagattaacccagtacctcagttggaaatgcagaaatcgtttgtcttctgcgtcactcatgctgggagctatagactggagctgttcctattcggccatcttggctccacctcttttctttttttttctttcattctttctctctatrtctcttctctttcctctttctctcttttcctctcgcctgcctgccttccttccttccattttctctctctctcttcctttctttctttcctttccctccctttccttccttcctttctttctttctttctttctttctttctttctttctttctttctttctttcttctctctttctttacaagatcttactctgtcatgcagtgttgcaaacacagctcactgcagcttctacctcctgggctcaagtgatgatccacctgcctcagcctcccaagtagctgggaatacaggcttagacctatgccaccatgctcagctaattttgtttgtttgtttttagagatggggtctcgccatgttgcccaggctggtcttgaattcctgggctcaagtaatcctcccacctcagcctcccaaagtgctgggattacaggcatgagctaccattcctggccctgagtgtgtatttctaactaaattaatgagaacgagagagaaaaaaatataaatttatataacataagtgattctgcctgccattccaatctacatgtgcatcctcttgtgacagactgactctactaagtgcttagctgatggccccctacctattcctgtcgttgctagtcaagatcctgtttcattccttttttcatcctccaggtggccacatcctcagggaaggctgagaccttcctcaacccagggtttattcttggttcattaactccaagccagttttgatgattctattccctttcccttattggtttaggagtaggtttatgctgtatttttgatcagtgagactttgggggttcagctttggtgaggggtagggggtgctttggggaaagcttcttttttcttaaaaagggaggagaggagaatcctcccttttcctgtctctgaacattttaatgacacatggaacttctgtgtccatcttgggacatcagagaaaagccaggagaattgcagagaggtcaaactgaggccatcagggcattgagccactgaattagccacctctggtgccatactaccttgggacttgttatatgagccaatcaatcctctgttgtttaatgccccattaaataatctttctaccacctgcaggtaaaagcattctaaatgatacagtatgaggatgactgttcccacagttggtctcagcatcttgtatctctcaaaatctgagcatcaacaaatcccaagaaattctagagtttcaagatacatatttttgtacaacatgattcttagtacaagccagcaacatcatctggtatttaacatgagaaaaggaggtctgttcctaagctggaacttttgggttttagtgaggtatgacactatattgtacttattgggagatttaaggaattttcaaggggagttttgactatgcaaacttctgccttttctctttagaacctaatccttttctgagatgccactgtagggaactgaaaggaactttccctttcaccctgtgaaggttcactgaaaaatcaactcacgaaaggctaataattggtggaaagacgtataaatttatttaacatgtgcatgggagccttcagaaggaatacccaaagatagaggtgaaattgcccatttttgtacttagtttcaacaaagtttggacagccatgtagatctaaaaaggatataatctaatgttaatagacagtgaggaaacccagcaaggcctgtctgtctagattcttcttcagcatgcatcctctaagcatgcattccttccttctgagtgtgaggcaggaccccttctggaatgggggccttatgactatagtcaaattaggtaggtcagataatttttcatggccagttgttacacagaaaggtggtgggaaagtttgagttatacctgtaggttttgtggctggctctgggggaataaagtgttctggtttctgtgactaccctttggggaacaggggttctagtttctacggctagccctggggaagaatgagaatgagagacaggaggacagaagaatgtcagagaaaaactgttgtttctgaggttttcattttagggtatgttttctgagtcccaacacaactaaaccgtgcaactgggcacagtggaaacagagagtggcccaaaagaagtataaagtatgagccattcaagaccagcctgggcaacatggtgaaacctcatctctacaaaattaataataattattataataataattaaatttatttaataaaaaagaaagtatgggccattataacctggttgaggagaaaaaacttaaatggcaggattgattttgaggctagaacacagcaaatttatccaaaggagtctctatcatgggacttggaggttgatggggaaggcgagtctagaaggactccttcttcccatgaggctgggctaggctatgctggtgtaataaacaatccccaatcctgtggcttcaaacaatagcagtttagttctcactcatattacatggccaaggtgggttgcttgtgtctctgtgctgcattgcccttacactggggcttaggctaacagaattgccactatctaggattgccagttgctgtggtagaggggcagggtcatgtgaccagttctggccaatgggtgtgggcagcagagacatctattacttctgggctggagcatttaactgctgatgtaggacaccttgctgcccacatccaatggccagaactggtcacatgacctcagcaactctaaggaggccaggaagtgaaatcctgttacatgtctgcaaggagaaagaactgggaatatttgcatgagcggcattaatggccaccagtcaccctctttgtccagtgatccatctaaaatctgtgtagacaatgagcgagagcaaatttccactctcttgcacattcgggtccattcagacttgtctttctctcttactctgttttcacgtggtggtgcctggtgattacagggagtgtgggtacagtcagtgtccttccatgcgtgccactctctccctctgaggctttgaccctttaattttacttttacttttattttatttttagtactaaccaaggtcagagctaaggaagtcacccagtgattttttctggaatgccatccattgctgcttcaccaggtctctttagccgcctgacgccttcattgtttastgttacattgtctccctttgttcaaagatgcaaagttggccgggcgyggtggctcacacctgtaatcccagcactttgggaggccgaggcgggtggatcacgaggtcaggagaccgagaccatcctggttaacatggtgaaaccctgtctcaactaaaaatacaaaaaattagctgggcgtggtagcgggcgcctgtagtcccaactaccccagaggctgaggcaggagaatggtgtgaacccgggaggtggagcttgcagtgagctgagatcacgccactgcactccagcctgggcaacaaagtgagactctgtctcaaaaaaaaaaaaaaaaaaagatgcaaagttattttgtctacagggtactctactcaaaccctcatggcttcctgctaccagcccaaatccctctccctgcagatcctcatgtgtgtccctggcttctccagctggggcctgaactcagctcctttgttctggtggcacacctctgtctgccctcacatgcactcttcccaacagaagttagtagcagagagggcagccatgtaagtcaacagagcacgccctgtgaatggagacacagatgttggcgctaaggaattggagcctgggctaatggacttattcctctgactgtgcagctaggtgagagggtgtataaaaagcaatacaaaaaatgttatggtggttgatttcatttatttctgagaggtctttataaaactgtccctgatggatatttataaacataacctcagctacaagtagacaggtctcaatttctcctatcgcagggaaatgcaaacttattctcttctttcctcaaggtttggtcttgtattttaaaaatggaataaagattgtagtaatgttgctagggattataggaataatataaatgtaatttctcttctcaaagacattataagtaagaatttcagcaaagggagaagaggaatgtaagaggaaaatggttgtttgaaagtgcagtatatagaagtataatatctatttctatatatagagatagaatatacaattaatatacatactatatatataatatgtattatacatactatatatgtatagaatagttaatatagcaatatataatataattatataaattctctacatatataaattctatatatagaatatataaattctctatatttctatatgttctatacattctattccatatattctattctatttatatattctataaatatatagaatacttaaatttatagaatacttaaatatattttaaaatactaaagtatatttatagaatgtatatacttttgggctgggtacggtggctcacgcttgtaatcccagcactttgggaggccgaggcaggtggatcacctgaggtcaagagttcgagaccagcctcaacatggagaaatcctgtctctactaaaaatacaaaattagccgggcatggtggtacatgcctgtaatctcagctactcaggaggctgaggcaggagaattgcttgaacctgggaggcggaggttgccatgagccaagatggtgccattgcactccagcctgggcaacaagagcgaaactctgtctcaaaaaaaaaaaaaaaaaaatatatatatatatatatatatacttttgtatataagtatacaaaagtatatttatagaatatataaattatatatttctctatatattccatatatattctctgtctagaatatataaatgtatatatgtggagaatatgtgtaattttttatatgtatggaatatatatattaatttatatatggagataatatatataggatttatgtatatttctattatatatatatatacttttttccccaagttcttaggtcagattctttatataggttcttcccctacaaccagaggaaactgtgtttttataactaataatagaaatacatcagcctagaatatgtgtcttttacaattgaacatctaagctttgcaaatgttggtgctatagttataaaccatggatgttagtcgaggggaaactcttctccggaactcaaacatgaaagctgatgttaaaagtcattgctaaaattctagagctgaggggattacaaatcagcattctaagctatcctcctacccactggtccaatgcattacatgttggcagaatggaaatcattttggaaaagggaagtggcattttcagatgtataaacatcttcctataaagaagtgtctgtcattttctatctccaagttctcaagaagacagggtctcctgccccttggtatccaaataaaattggcctgtagtctactgtgcgcagtgtgtgggttaagtgctttctccaagattcttagcattgtgtcctccttcgactccacattctccgggagctcccatgggcacacagctgctctcttgtttccatccccaagtccaagtgggatgtcattcagcttccaacagacaactctagcacaagatactggtgtagaacagatctccaccataggtacgagagtgagggaagaattacatcatgacacagcataataaatactttaaaatgaatttgtaaacattgctgttctgaaaagccctttttaggctgggcacggtggcttatgcctgtaatcccaacactttgggagactgaggtggttggatcacttgaggtcaggagttagaccggtctgaccaacgtggcaaaaccctgtttctactaaaattacaaaaagtatccgggcatggtggcgggtgcctgtaatcccagctacttgggaggctgagacatgagaattgcttgtgcctgagaggcggaggtttcagtgagccgagatagtgccactgcactccagcctgagtgacagagcgagactctgtctcaaaaaaaagaaaaagaaaaagaaaaagaaaagtatttttttattaccccctggtaatttcttactgccaatttttgccctaatttctttcaatttctttccctcttctgactgcacctcttccttcttatcttccttctgtgatgtgggacccacattttcacacccaaatggtccatagagttgctttgttctccaaaatacagttttctccttggaaggaattttacctctagcttttaaaataacatttctgttcttacaaacttatcatcaggattaatcacatttttaaattaaaatgttattactaaaacacttaaaactaaaatagcatttttaaactaaaatgctatgtctgttttctctcactcttgttatgaaatgtttcctaatgtgaagtgttttcttgatggaagactaaaatattgagacaacatatatatttatgtctcacatctccttcttatggccatatagcctttaataaaggtagtgttgcttacaaaaggaatgattgtataatagcagagaaaaaattctttccaaagtgaaataatagagatgatagagatgaaaaccaacacttgtgaatgaaacttttatatgcagaattatattagcatagttaaaggtaaaaatacttgatccataatgattttcatttataattttggttatagattgtatctattaactattgttacaataatgctgcttgacaaaccatcccaaaactcattggctttcgttgtcatgcatatgcagttggctggggcttggctgatctagacctggcttggcttccaggtgcagattggatccagatctgctccccaggactctcatccacttgcaggctgactggggcttgtccttctcatgctgtagcagagtgcaagcctcacctcttaagcccatttcaaacctttgcttgcattatgccctctaacatccctttggccaaagcaaacatcagtgagacagggaagatcatttctcccacagcaggagaggaggagaatgaatatttgctgaacagtaattcagactcttacataagtgaagtatcatctgattgtccatcatgcccaacatctgtgtctctctgccagccaaatccaacaggtatcaaaagtggcttaaagcaggaggggttattagtcrgttaaaagcaaagcatgtcaaggaaataatctattcatgtaggagcaaagatttttcttctataaacttgcatttaagataaagctgacaatctccttgcagcaattccttgagaagaaagtgtagaacaaggcacaacactcctctgacccaattcctgcaacctagtcagagaggacaactatttgcaccatgaattgaattatagccaaacaggtcttgagtaattcattgtgcatatatcctatgaaatgaagctcycaaggacccagaatgtaaactttaaaaagtaaccagtgttaatacattaaaatttcattaatttcgtattaatttacttaaagcatcatgtaatttcaagtaattattagtcattcatcaccttttgttcagttgattcttactagaaatgctggagtatggcaatcttacacatctctgggttcttgatttagcacagaggctggtagagtacatctcatgggacaaactagctgtttttgtaaataaagttttattggaacatactcatgcccatttgtttctatgttgtctgtagctgctttcactctacaagggcagattgagaagttgcaacagaaatgctatgaactcaaagcctaaaatatttactatgtgacgagcagaagaaagatggccaatcctgatttaacataatgctagacagttgaaattttggaatttgggttattcacacagttctgggatgaatattgttcttgagctatccttagataactatctaaatacttagagaaaagtatttttttaggaaaatcaataatgtaaacaaatattacacagataattttaacctccttaagaaaataatctttttaatacattaggttatgagcacttatttctaaacagttattataccaatcataaaatttgtatttgcttgttaaaggagactctgaaaaactctatcaaatattgctttattaacctttaaggagatgattattcttgcaataaacctacggtttttaaaaatatacacttgccagttgggcacagtggctcactcctgtaatcccagcactttgggaggctgaagtgggcacatcacgtgaggtcaggagttcgagaccagcctggacaacatggtgaaaccctgtctctactaaaaatacaaaaattagctgggtgtggtggcacatacctgtaatctgagctacttgggaggctgaggccagagaatcacttgaacctgggaggtggaggttgcactgagccaagattgcaccactgcattccagcctgggcgacagagcgagactctgtcctctgtctcaaaaaaaaaaaaaaaaaaaaaaagtatatatrtatatatatatatatatatatatatatatatatatatacacacacacacatatatcttgccatttcttcaaacttttcaccaatgtagatcattttaactctattcacgtacataactgcatctgaattagtacaattttactatattgtgtttaaagatatttcaaaacaccacactggcccctgatcttttctttgatattagaaaaaacaaaatcttgtgtcttgccggatgtccactcttggagacaatcgggtagctttagaagaaagaaacattagcatttctaaagacttggagagagaacatgggcagattttaaaagtgacgacacattcttagttatttccagtagatatattgagaacacagaaaaatctggagtcatatctattgggtattgaattagatgtgtgtatttctgtgttctgggattcactttaaagccccaaatgagtctcaatatgaggcctgaactggagaagaagaagagttcgtggagaagaacagaagggtggcttacacctgtaatcccaacactgggaggccaaggtgggtggatcaccggaggtcaggagttcgagaccagcctgggcaacatggtgaaatccccatctctactaaaaatacaaaaattagtcaggtgtggtggcgggtgcctgtaatcccataatcccagttacttgggaggctgaggcaggagaattgctgaggcaggaggcggaggttgcagtgagccgagatcatgccattgcaccccagcctaggcaacaagagtgcaacttggtctcaataaataaataaataaacaaacaaataaataaaaatgaaaagaagaagacgaagagttcatcccagcctcttctccaccctgggctaggaatagctctctataagatataggatttagacaatggatcctaaattggagattaggtaaaaacaaaagaagtgctccaggactacacttctgaaaggaagttttcctagcccagtaactgcaagataggtatagagctataggtcatcatcagctccctttacaagtcacatgggattgtaatctgagcaataacaactgtgtatccatgtcagctgaatgacttggctcaaatggcacttcttttttttctttcaggagtcgggtgggagaatgtgctgctaaaggaaggtgagtcagcctcgaacgccacagaaacatccggcccagacatgactatcaaggtaagggattctcttcaggttgattctcaaagtgtatctctagagtaaaggcagccgatggcaggtttttctgggggcaaaatgaacactaccaatccaccttgctrgagttctctctctactcmctgaggtcttagggagrcaaccgtacataagattttctgaaatttgggatctggtctacagccgtaccaccctgaatatgcccgacctcrtctgaaacttgggatctggattaggaaactgcttgaaaaccagaatctaagatgtgatttccaatgggcctgtcgtagggtcttcagtgaatatctacacgtaagctatttgtaaatggtaaccccagtgggcacagtggagcaaatctgaaaattctgatctgagaattcaggccccactgtgcattgtgaggaaaggtcagagaggcataaagtagctttgatcttggctcaagatttccactgatgtcagcaggaaggcagcacatggcccactccagctgaaacactaatggccaaaggtttacaaaatgagtcatctagaaatccacttaactatcactgttcaaattaaatgcatcaatttgtaagcactggccagaataaagaatctgtagcaaaagttatcagaggtgccaccatttcccctctgttacgggattaaacacaaaggaatgatcttcctctcttagaactctgctaacatattagttaacaaaggatgggggtgggagggctttctaacattcttgcttgaatgattataatttgaatatatgctacttatgaatttttctttgaaaaataagaagtaatgtcttattttatatagagctgtaactggagatatttctttttttttgagacggagtctctctcttttgcccaggccggagtgcagtggtgcgatctcggctcactgcaagctccgcctcccgggttcatgccattctcctgcctcagcctcctgagtagctgggactacaggcgccagccaccgtgcctggctaattttttgtatttttagtagagacggggtttcaccgtgttagccaggatggtctcgatctcctgacctcgagatccgcctgccttggcctcccaaagtgctgggattacaggcatgagccaaactggagatatttctctcctggatctattagtagaagttgtacaaaagaatatacagcatggatttattcaagttttcttttgtaatgtgaaggctaaacttgtgttgtctatgttacaaatggtagagaaagcaagcaaatgttaccatagtaaagctaaatgaaagataggatagtagcctgattagtcaaaaagtcaactaatctaagtggtaactatccagtgctgaaagaactatcactacgtttagcagaatttgtaagacaataatataaattgcaatgacatgttggtgttttattggctattattgcaatgattgacaagtttcagtctatgaccacattggacgaaggggaatgggtgccaatagtaaaacctgttggatttagatttgttatctcaaaatctgttatcatctggagaattagtttttgagaagagttgctagtgggagagaagacagcatgttgccagtgtagctgcagatgtggtacagacagacattcaagtagtcagaaagactggagtttgcttttataaagcaaacggcatattctttttttttttttttttaagacggagtcttgctgtgtcgccaggctggagtgcagtagcgcagacttggctcactgcaacatccgcctcctgggttcaagcaattatcctgcctcagcctcccgagtagctgggactacaggtgctggacacaatgcccggctagtttttgtattttcagtagagacggggtttcaccatgttggccaggttggtctccatctcttgacctcatggtccgcctgcctcagcctcccaaagtgctgggattacaggcgtgagtcaccgctccaggccacaaatggcatattctaatagaagcaagtcttgtccaaatcccatttgataagattgctacttaaccaggctactcatccatggtaccaggatcttgactgaagttgtatttgggtccctctagtttagacatcattctcgatctccgtttctttttcttttaatgaatacctgaaaatttctcacaagaaaagatttcttttacccctgccctaccccaggaagatttttcatccataagaactgaactcattctgaggaataaataccatacactttaaatagttgagcaaaatagaaatttatttctttattcattttgaggcagagtcttgctctgtcacccaggctggagtgcagtgtggcatgatcgtggctcactgcaacctccacctcccaggttgaagggattctcccacctcagcctcccaagtagctggaattataggcatgtgccaccatgcctggctaattttcgtatttttagtaaagatggggtttcaccatgttggccagtctggtctgaaactcctggcctcaggtgatctgcccgcctcagcctcccaaagtgctgggattacaggtgtaagcctctccacccagccagcaaaatagaaatatatttaaacacatcaataaacccctacaaatattctagagttcttctcttaatgccagttccttctcactaaggaatttgtgaattttctaggtggatataactacagaaaatgcttgtttctatcttctcctttaggattcccaattacggagcagtcattgacttttttcctttgggtataagttgtttcccaccccacattgccttacataaccatgatgtctttgtatctaaatgaaagtattattttttctgctccacttcgttaatcagagaaatgcaaattaaaaccgcgatgagataccatctcacgactgggcatggtggctcacacctgtaatcctagcactttgggaggccaaggtgggtggatcacaaggtcaggagatcgagaccatcctggccaacatgtgaaatgccgactctactaaaaatacaaaaattagccgggtgtgatggcgcgtgcctgtaatccaaagctactagggaggctgaggcaggagaatcacttgaaccagggaggcagagattgccgtgagccgagtctgcgccactgcactccagcctggcaaaacagcaagactctgtctcaaaaaaaaaaaaaaaaaaaaaagagagataccatctcacaccagtcagaatggccattattaaaaaggcaaaataacagatgttggtgaggatgcagagaaaagggaacagttatacactgttggtagcaatgtaaattagttcaacccctatggaaaacagtaaggagatttctcaaagaacaaaactactgtttgacccagcaatggatatctacccaaaggaaaataaatcgtcttatcaaaaagacactcacactcatgttttctgtagcactattcacagtaggaaaatcatgaaattaacstaagtgttcatcagcggtagactggataaagaaaatgtggcatatatacaccatggaatactacatagtcatataaataatgaaatcatgtcctttgtagcaacatggatgcagaaggaggccattatcctgcaagaattaatgcagaaacagaaaatcaaatactgcatgttctcccttataggtgggaacyactacacatgggcataaagatggaaacagtagagactggggactctaaaagaaggggcaatagagaaaggagaaagggttgtaaaactacctattggatactatgttcactgtttgggtgatgggttcagtagaagtccaaatcccagcattacgtaatataccttgtatcaagcctgttcatgaaccccctgaatctataataaaaaaattaaaattaaataaaaagaattattttttttctctctgtatataactgcctggagctcattaagcacagactccccctcttacatttagctatagctattcctacttctaatagctactttatatatccttgcaatatcagctattcctgccttttgcctgagaaaacaaaatattctgttaataaaacctgatacactgacacttttcaagggaaatatcagcagaaattacaaagatagttgggtttcttccatattgctcttcttgtgataaaggtgtctattttagtatttataaattttctttctgaaaaaggaatacaatgttttgaaggtgcttgctttctctttgccttccatttcccttgccatgattgtaagtttcccgaggcctcccagtcatgcttcctgttaagcttgtggaactgtgagtcaattaaacctctcttctggctgagcatggtggctaatgcctgtaatcctagcactgtgggaggccgaggtgggtggatcacctgaggtcaggagttcaagaccagcctggccaacatgatgaaaccccatctctactaaaaatataaaaattacccgggcgtggtgatgcatgcctgtaatcccagttacttgggaggctgaggaaagagaattgcttaaacccaggaggtggaggttgcagtaagctgagatcacgccactgcactccagcctgcatgaccagagtgagactccatctcaaaacaaaaaacaaaaaaaccctctcttcttcataaattacccagtctcaggtaactctttacagcagtgtgaaaatggactaatamacctgtgaatgtgacttatttggaaaaaaagtctttgcagatacaattaacaatcttggctgggcacgttggctcatgcctgtaatccaagcactgggaggctgaggtgggtagatcacttgaggcctggagttcaagaccaacctggccaacatggtgaaaccctgtctctactaaaaatacaaaaaaattaggcatggtggcacacgcctgtaatcccagctactccggaggctgaagcacgagaatcatttgaattcaggaggcagatgttgcagtgagctgagatcacaccactgcactccagcctgggtgacagagtgagactctgtctcagaaaataatactaataatcttgagatgagagcatcctggatttaccagatgggccctaaatccaatgacacatgtccttataagagacaaaagaggatactcatatacacagaaggccatgtaaggggactgaggcagaggttgaagttatgcagcccaagtcaagaaacacgtggatccaccagtagctagaagaggcaaggaaggagtcttctctagagcctttggagggagaggagtgcagccctcctgacaccttgaattggaacttttggcctccagaattgtgagaaaataaatttccgttgttttaagccaccaagtgtgtggtagtttgttatggcaaccctgggaaatgaatgcactcagattctgccaagaatcacacctatgcttcttgagtgcaaatgccatagaggctgataaaccaatattacraagatccacataattttcttattttactctacttacccttataaattgttttttacctgttcttgttttgggagaaccactaacttttttcagcctatatttatcatccttcactggaagaaaagggtagctgtatctcagaatagcttctattttatatcctattctgttttgttgcttgtccagacattgaatttaaaaaaaaaaaaaaacaggtatggatcagtatttcttgaaatgcctgaccctgagaatcacctgcagcaatgtagaaaacaacaataacacagcttgccagacatctttcagaattcagattcagaagacctgggcttgagaattagcatttttaataagtgctccaagtaactttcatgattagtttcagaaaatcttgtcttagcacaccactaatgcagtctgggggtggcaatgtgagccctactattgctcttggctctccagttgtccaaccaatctgaggcaggatttggatacttccctattcagtgccctttgattacttcccatttcaacactgaataagcctcaggcttcccctgccttctagactttcttactcttaacttcagtttcatttttagcattgtctttcactgtgtctctctctgtacccattcttgccctctttatccggtctacttgtagcctggatactgtagctttctttttaaaaagctgagttgagctttgcacggtggtgggaagattgcttgagcccaggatttcaaccctagcctgggcaacatactgagactccatctctaaaaaaataaatgaaaagatcaagctgataatatccctctgctaaggccctgctggccttcccatggctcctggaacaaagaccaactcttgcaggcactgtgttttttaaaagcccctggctttcattcacttctcccttgatcttcctgctctccctctctctttatattcacatctttggctcaaatattccctcctccagtggcacattcttttctttttttttctttwtttttattttattttattttattattattatactttaagttttagggtacatgtgcacaatgtgcaggtttgttacttatgtatacatgtgccatgtttgtgtgctgcacacattaacttgtcatttagcattaggtgtatctcctaatgctatccctcccctctccccccaccccacaacagtccccggagtgtgatgttccccttcctgtgtccatgtgttctcattgttcagttcccacctatgagtgagaacatgtggtgtttggttttttgtccttgyaatagtttgctgagaatgatggtttccagtttcatccatgtccctacaaaggacatgaactcttcattttttatggctgcatagtattccatggtgtatatgtgccacattttcttaatccagcctatcgttgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatygccacactgacttccacaatggttgaactagtttacagtcccaccaacagtgtaaaagtgttcctatttctccacatcctctctagcacctgttttttcctgactttttaatgatccccattctaactggtgtgagatggtatctcattgtggtttcttttttttttttttttttttttttttttttttgagatggagtttcgctcttgtcacccaggctggagtgcaatgacgccatctcagctcaccacaacctctacctcctgggttcaagcaattctcctgctaagcctcctgagtagatgggattaacaggcctgtgccaccacgcccggataattttgtatttttagtagagacggggtttctccatgttggtcaggcttgtcttgaactcaccacctcaaatgatccacccgcctcggcctcacaaagtgctgggattacaggcgtgagccacagcacccagctccagtggcactttctaacaagcattgcttgtttcacattctcataggacctaacagctctccttcatagccactcacatcaataaccatagatgtcgggcaggtgtggtggctcacacctgtaatcccagcactttgggaggccaaggtgggtggatcgcttgagaccaggagttcgagaccagcctgagcaacatgacaaaacccagtctctacgaaatacaaaaaaattagctgagtgtggtagcatgtgcctgtagttctggctacttgggaggcaagagatgggaagatcgcttgagcccagggagattgaggctgcagtgagctgtgataaaacaaaaaataaaataaaaataaaaataaccataattttcattgcataatatccagttgcccttgctacaatatcatttccgtaagggtcatttttctgtttcattttttacttgttagaggctctaaattgtagttctttttttaaataacacaactttattaaggataaaatttgcatgccatayggttcccccaggtaggtatatgattcaataatgtttcataaatttactaaccatcacacaatccagttttagaacacacacagttttaaataatttccatcattccaataagatccctcatgccctcctatagttaatctccattctaccccatccccaaacaaccactcattcctttctgtttctataaatttgcctgttctggacatttcatataaatggagtcatacaacatgcagtgttttgtatctggcttaggatgatgatgattttttttttttgaggtttatccacattgtagcctcaatcactatccctttcactctttttaatgctgaataatatttcatttaattgatatgccaggctgggcatggtggcttacgcctgtgatcccagcactttggaaggccaaagtgggtagatcactagagcccaggagttggagaccagcctggacaacatggtgaaactgtgtatctacaaaaaatacaaaaattagctggatgtggtggcatgcatctgtagtcccagctacatgggaggctgaggtgggaggctcacctgagtctaggaggtagagagtgcagtgagctgtgattgtgtcactgcactctatcctgggtgatgacagagtatgaccctgtcttaaaaaaaaaaaaagatatgccagtgtcttgggttttttgttttttttttttaacagcccagaggtcttttatttatttattttttaaacacctattatgccatgaattcatagggaataggttccagcagttcaggctccttcccattggttctcacaaagtgtgcttctctgggtggagcaggctggcacttcagttgaacccaggtacctttctctttggcttctttctttttctgatcattttccttcacacatttcaggaagctatctcggctcagagtgcttaatgtgctcaatatgcacattaattctcttggcaagaatcttgcccttaacttgtttgtttacaataccaacagcatgctgggtaacattgtagactcttccagttttgccatggtaacacttgtggggcattcctttttgaacagtacccattcccttgatgtctacaatatcacctttcttatagattcgcatatacgtggccaaaggaacaactccatgttttctaaaaggcctagagaacatatgtcgggagcctctcctctttccctttgtgttcgtcattttggcgaattactggaagatggaggttccgcccgaaaggctttttttttttttgttccttcacaagttgatggattttgaggttgtttctaccttctggcagtaagtattcttgctatgaatagttgctgctttggatagtcacatgtaagcctttgtgtggacgtaggtcttcctttgtcttgggattgtacctaggagtagaattgctgggtcatatggtaaatctgggtttaactttttaaaaagctgtcagackcttttccaaagcatctacaccactttacacctcaccaacaatgaatgaggcttccaagttttctacatcctagccaacacttactactgtccatcttttgattataaccatcctagtgggtgtggagtcgtatgtcattgtggttttggtttgcattctcctggtggctaacgacactgagttattttcatgtgcttattggctatttgtatgcagttaatttttaatggcttgatttccttttttgccatagtttgttcaattattaaattgaagcactctctcattgcagctgcccagtcagtgttttctgagtgagggaccctcttcttgactgtggcaggagggtgcactcaactcacacttcccctttaagatcactgccctctccaccactacgtccctctgcaggggttgcatcaatctctcttctttctatttcttttctttctctcactcttttatttatttctttctttcttttagacagggtctcgctatgtcacccaggctggagcacagtgtgatcatggctyactgcagcctcaacctcccaggcccaagcaatcctcctaccttagcctcctgtgtagctgggactataggcgtgcagcaccacacttggctaaatttttattttttgtagagaaggaggactccctatgttgcccaggccaatcttaaactcctgtgctcaagtgatcctcgttcctcagcctcccaaagtgtgagattacaggtgtaagccatcacacccagcgattatctctcttttctattttcccttcacatcttagccttttttctttaatttttttattagcctaatcaatgctattttttattgtggtaaaacagatataacatttaccattttaagcacttttaaagggtacccgtctgtggcgttaggtacattcaaagtgttctgtaaccatcatcgtcatccatccttctccagaactttttcaacatcttcttcaaccaaaactctctacccattaaataccagccccccattctctcctactccagctcctgtcaaccacctaaatgttgcattttacacctaaaatgtattactatttaattgccttctcaaagggatttttaatacattatgttaatagtaaaaagccagtaaggccaggcgtggtggctcactactgtaatcccagcactttgggaggccaaggcaggtggatcacttgaggtcaggaattcaagaccagccttgccaaatggtgaaaccccgtctctactaaaaatacaaaaattagctgggtgtggtggcacacacctgtaatctcagccactctggaggctgaggcacgagaatcgcttgaacccaggaggtagaggttgcagtgagccgagatcgcgccactgcactccagcctgggtaatagagcgagatgcagtctcaaaaacaaaaacaaaaacagaaaagccagtaagatggctacccctcagaaataaagtaggaagctgctacaagctagatttttaaagatattgctggttacaaaagttcctttcttctgtggcgtgaactgtccaggaccctcatactggaaatgtcttggccttatccagctggtgccttgctgcaagtcccaaatcacacctgcttggctgtgcatcattttcttgaattttgtttatccaacgactggataaaatgacatcaagtaatccatgttaaagaagtatctctaggataaaaattttgtgatttggctgtcatttccatcaaatacaccaactaaatcgtagatgctctctttatcttgccctcttgtccatatatactaagactaaaaactaagtgtttgcaaaaaagaatacaaaaaattttagcacagcagaattttcctcagaatgaagtctggtattcttatttacatgttcaatatttctcatttatgcttgaacaagaaacaaggttggtagcccttaggcaaactagagattctggctgtaaaaccgtttgaaaagggtacatttctattcaaggacatgggaaagccacatttaaaaaaggatgttgcttctctacacgtaaaacttgttggaagacagattatcctcctagaagagcagatgttctctattacaaaagaggaaaagcatttagaytcttccggtggtgaatagaggccacaggttacagctttctttggcctttgcttttaaaaaaacattctgctgaaggccttttgttgccagtggtgtccagccggttgccctttgtatttgatgatgacgacattgaaaggattgttttgtgcagggactctggacaaaaaagagacatttgggacagaaaacctttctacattgtgtatatacataaagatcgctctaaatttggttccttgccaaaggaaatattttcgaagattttttaaaaatccttgaaactattcagggtagtggatctcagagggggtttggcattggtgagtaggaggcatatcggtactatatgggtcagtttttataatacatgtctttgagaatcattgtcttgaattttctttaaaatgaatatgaagagctctgttgtaaactgtaataaactatattattaatggttatttattgttcctgtgtgctactccctatttgtcaaataaaataaatgtgaaagaaatgaagtcacaaccattgacagctttcaataatctatgtgtagataaggaatattcgtggcaagtgaataatctcaggtaccttcttctttgccgttttatttcttcgctgtgttctcttgccaacaataatagctaacatgggttgaacgtttgctttgagctgagtactgtgctacacatacaccatctcgtgtaatcctccagatgactctgctaaggagaaactgttattaatcccattctacagatgtggtggctgtggcacagtaaagtaacttacccaagatctcaaagtgagtgtgtggtggagccaagctttgaacccagatggaaggacactttgtagcctctctgtttgggttttaataagtgcaggtttatttttttttaattagctaaagcaggggagctccaatgacagggcaagggtagcttagccagataaaatattagatgtccagttcgatttgaattaaattgcatgggacatacttatattaaaaaattatttgttgtttacctaaaattcagattttactgggtgttctgtatttttatttgccaagtccagtggccctaggcaagaggagtgttgcaaaggaaatgaagggaaccgcgtaatgtgttttgattattgtcctttgggattatttgtggttttgggttctttttgaaaaaaaaaaaaaaagacttttttcattttaaacatgacaatgtattttattaagctttaaaccagacagatgtatattttaaggacttgtaatatgctgataacctatcaagggacatcccttgatatgcttctttgctaggaatccaaatctgatccatgccaagatttgtacctcattggtttctctatgaagtgaaactatgagaaacactaccctctatttgtttgtttgattgttttttcttttgaacaacagcaacaacaaaaaccctttacctcaatctgggtatatcatgactttttggaagccttattctaggatcttctttttagttgggatatcagtgttagcctaatttcattttctgcagatagcttcatcatcccaatttttaaaatgttgatgaaatactcttgtgcttttatcaactcctacttggtaaaatcccctatctctgagtggtcaccctaaaatacatgacatgggcatggatattcccagcaaaagttctgacacattcacaaatgcttcctgaggacatctgtctgtttccttctatgcacattttgaacattccagcagtgagaatgactaatgatgctaaagctctagaaactgtcacgtgttgctgttcagtatgtcagagcctgtctgcagataagcctcatttcttaagaataatctgtcccaatcaagctagttttgcaacaaggctcatttgcaagtaccaaagtctatgacttgtgaaagaaccaagccacgcaaaccaaacacagaacccagtgacagaaactattggtctttagtgcgactggaaggtagccaacctggttcccatttaggcagggaaccagtttgtctctccagttaatgtctgaataaattaccattcatgtccctgagggtttggaatgattgcaaattatttctgaaatcctgggtagaactcatgtggccacttacgataagccttgtccttctgcaactggtcaggtatcagagaggtctcataaatcaagattgtagttatcaggaaaagttgttggattcatagagtaggggccaagggaaaactttccctttgccctctgaaatttcgttgaaaaatcaattgacactagacagattaacgggagaaatggcatagaagtttactaatgtgcaaagagagaaaattacacacaatggggtacagatggttatatacccttcttcttagaggaaacggagataggaagtgtggagataggaagtggggggaagggcagtaaatgatttttacttgaagaaccaacagtgacctgggacaaagtctgttgggcccacagaacagacaacaatttgtgacagaagtctgttcagatgtgttgacagacttcattcagtctttcttcctgctatatgagttgctaatggcaactcaaggaagagaccagaagtaattgttttcttctctggagggtaagattttaggtagataagggaacttcacagaaccatttcatcctgtgcgtaggggagagacagaagattgagagacaggagtgaggggaggtcagagagaccttgagccttcttcaggttcagaatatcaaagcatcatatttggggatataggtttctgagccctaacaatgggaagaatgatctttctgtatcatatgaatactgaagattgttgaagtgagcatctagtgctcctatctcgataaattatccaatgcctttcccatctctttctcctacccattctctagtggcctgcccccttgccctttttattgtagtgaaaacttagtagtaaaaaatacacttggtaaaaatcatgacatcatgtaaattgtatgtaaaaagatgacatgctcatacaagatgcttgattcattgcctagcagagcaggccactggtaggtctgcataccacgagctggtctgtttcgaggtcacttatgcttactatcattgcaacaactacttcttcctcagaaattagtcagtggagatgtgacatttattttatctcagaatttttatgtctgtttctgaaaagaaaaaggtaccagcagctgcagttcccactccgtctcccaaagggatctgggctagagggtagggtattggatttgtcatcatattttccatctgctcacagattgtgaggtttattattgtttctgttattgttttttgagacagggtctcaccttgttgcccaggctggagtgcagtggcrccatcttggctcactgcaacctccacctcccaggttcaagtatttcttgtgccttagcctctagcctccctggtagctgggattacaggtgtgcgccaccaggcctggctaatttttgtatttttagtagagacagggtttcaccatgttggccaggctggtctcgaactcctgacctcaactgatccgcccacctcagcttcccaatgtgctgggattacaggtgtgagccactgcaccccaccagagtgtgagttttgatctccaacagtatgcattttctagtgaaattcggtttaataaaatgaataatgagataatagctaacatatattgagaacttcccatgtgtcaggtagtgctctgggtgtttagggtattctattatttaattcttaccacaaccctatgaggtgggtactaggatatctccagtttacagagaaaacaaggtgcagagagattaagtaacttgtctaaggtcacacagacaaggagtgctggagcctaggtctaagccagacagcactagatcttcatgactttgtcacagtgcttcaccttggagaataatgagatgatgctggtatgtagacatgctaaggaggtcttccttgcctcacagtcctgatcaatatggaggcttttatgtagttctgtttgcgttcattcttccaatgcaaagctggagtttacctagtgggataagatttgattttcatccttgagaatgagttgttcttcaggctggcccatgagtcttcatcctgtcagcattctgattacatttctcattatcattctcctgcagtgattcatgagtatgataaaaccgaacagccttctcagtaaataagcaaagcttagcttacggggaaaaaaaaaaaaaaaaaaaagtagagctttccttgaatctggagaaattaagcacacaggtgtcctgcaatattagttaagagactactgcacccatcatactgtagcttaagacagtttcttcttttagttttttctaaaatgtctccatgtctgtgttatgccacaaataacacagccttggttaacttttggactaaaaaaaatcaacttattggccaagcatggtggcttacacctatgattgtagcactttgggaggctgaggcaggaggattgcttgaactcaggagtttgagaccagcctgggcaacttggccagacatcatctctacttaaagaaaaaaamccgccgggtgcggtggcttacgcctgtaatcccagcactttgggaggctgaggcgggcagatcacgaggtcaggagtttgagactatcctggccaatatggtgaaaccccatctctactaaaaatacaaaaattagctgggcatggtggcgcgtgcctgtagtcccagccactcgggaggctgaggcagaagaatcgcttgaccccaggaggaggcggctgcagtgagctgagattgtgccactgcactccagcctgggtgacagagtgagattctgtctcaaaataaataaataaataaataaataaataaataaataaataaataaataaaataaaaaataaaaaaacaaaaaaaataaaaaaataaaaaaacaaacaaactagccaggtgtggtgtgcgcatgtcgtctcagctactcaggagacaggtgggagaatcacttgagcctgggaggatgaggctgcagtaagccacaatcctaccactgcactgtagcctgggtgacagaaggagaccctatttctattataaataaataaatttattgaatgtcgtattatatgtagcataccatatttaagcagggtcaaatttttggtctgacttttcaaattaatgtgaataagtcactttgaaattttggagacaaaaccttatttaagttgagaaatagacaaacattcatccactaagaattattctttttattatttttagtgtgtttgagttggttcttgcaaagaaaatataaacaaatcccaaatatgaaaaagtttctaagtttatattaagtgtatcccatgagtgacacaggaaaatcccttttaagagaaatggtattgcaaaagacacagcaaatctttttctcttttaaataaaaatatgcattctgtgtctaagcattttccaaacctttctcctttgtgtggcttttactaaaccttcaatcctataacagtcattgacttcttcctactttcttttcctctctttccttctctcccttcactccctttctttttcccagtgtttactgtgggctaggcactgtgttaaacactttacctgcatttctctctttaacactcaaaatgacaccatgagataggtaccattttttgtcccattgtgcagatgaagaaatcaacactttgagaaggtaaagactttataaggtcacaaattctggaagagcagagtcagaattcaattccaggtttgtcatatttcagagcccacagtttattgctttctgtgtaatgagtaaatatttcttttagaatmaaaaaatattttaattaaaatgtaatgacaggaaaatagttttgatcctgggagcaagaattagtcaagaatggacctgatctaagaccactgtagttttttggacaggctatgagccagtggactggcacagatgratacaaataacacatagctaatactaattgagaatctaaaaggtgtattctgtggcctttataagcatgaacttatccaatgagttccatgaactcatgatatagatactatacacttgttcttattttaaagactaggaatctgaggcacagggagataaagtaacctatggaaggtcctgctcagaatcagtggaagaatgaggattctgccttcattcctagcattcttcatgtggttagcatagtcccctaaccacagtgccagggcacctcttgcctgtgatccctaagtgctcttctgcaggtttctttctttcctttttttctattgtttttttgagatggagtttcactcctgttgcccaggctggagtgcaacggcgtgatcttggctcaccacaacctctgcctcctgggctcaagcaattctcctgcctcagtctcctaagtagctgggatttacaggcatgtgccaccacgcccggctaattttgtatttttagtagagacagggtttctccatgttgttcaggctggcctcaaactcccgacctcaggtgacctgctcgcctcggcctcccaaagttctgggattacaggcgtgaaccaccacacccagcctcttttgcatgtttcttggggaatgcagagccagttaactttacaactagccattcacttggaattcacatccacagcatagaaaagaccatagcgtatgctttccctatggagagaatccaataactatcaagccatatattcccctttttttttttttttttttttttgagacacagtttcgttgcccaggctggagtgcagtggtgcaatctcagctcactgcaacctctgcttcccaggctcaagcgattctcctgcctcagcctcctgaatagctgggattacaggtgcccaccaccatgcctggctaatttttgtatttttagtagagacggggtttcaccatgttggccagtctggtctcaaactcctgacctcgtgaactgccctcctccgcctcccaaagtgctgggattacaggtgtgagccaccacgcccggctgccatatattctttgtataagtgacaggtctgaaaatagctgtgtttatgattacggagttaaagggaaaagaatgccatagctaatgggagagaaaaatgaaaggtcaattgaattcgcccatggtaaatgttagaaatttaagggtcaatgtgatcctttcatatgaaatactaagttcttggaatcaacttacgggaaaatctagtatgtttagtgttttacaagtgcttttttttctgcctaaaatttaagaaatactttacccaatgtactaaatatatatgtgtgcatgtgtgtgtgtgtgtatatatataaaatatatatataatataatatataattatattatatacacacatataatatataatatacatattgtacatatgtataatacatattacatacatatgtattatatgtataatacatattatatatattatatgtataatacatattatatacatatattatatgtataatacatatacgtatataatatgtataatacatattatatacgtatattatgcgtataatacagatatatgtatatatatgatatgttgtgtgttatatataacatatatatgatatgttgtgtgttatatataacatatataggatatgttgtgtgttatatataacatatataggatatgttgtgttatatataacatatataggatatgttgtgtgttatatataacatatataggatatgttgtgtgttatatataacatatataggatatgttgtgtgttatatataacatatataggatatgttgtgtgttatatataacatatataggatatgttgtatgttatatgtaacatatatatgatatgttgtgtgttatatataacatatatatgatatgttgtgtgttatatataatatatatgatatgttgtgtgttatatataacatatatgatatgttgtgtgttatatataacatatatatgatatatatattgttttggtgagttggtacttttttttgttattgttgagatggagtcttgctctgtcgcccaggctcaagtgcagtggcgtgatctcagctcactgcaagctccacctcccgggttcatgccattctcctgcctgagcctcccgagagtacaggcacccaccaccacgcccggctagtttttttggtatttttagtagatactgggtttcaccgtgttagctaggatggtctcaatctcctgacctcgtgatccacccgccttggcctcccaaagtgctgggattacaggcgtgagccactgcaccaggccctgtgctttgtttttttaaaagaaacttcctagaaaccctgatcaagtgggagtttttttgaacccgttaataagaacactttattgtaatgaaaataagaagtatttgggcatgcatctgataattatgtgttgaatgccttctgagggcaatgctttgtgccatgtgtcatgtgcctggtgcagcttccacttccaattatgtctggaatctgatttcaccattgatgtcaccactccaccattaccattctgctttcagccattatcatctcttgcccagattattacaatagcttctaagtgctctcccggccactcctttccctttctgtaacacagactccacccagaaacagccacagtgatgttataaaaatctaaaccaaatcaagtcatttttctgcttgaaataatgcagtggcttctcatcttattcaggaaaataggtaatccaaagtgcttatcaaggtttgcaaggaccttaggwtctggctcactgccagtcttctctcacccctcctttctcagctctgaagtcctcctggctgctccaaacatgattgctcagtgtccccacacctgctgttccctatgctcgaatgcttttccccttgatgtctccctggctcacttccttccattctccaggtctctgctcaaatatcacctcagtaaagagtctgttcttgaccattacataaaatagtactcacctcctactgccatcaatatctatccctttaccctgttttatttttctttataacaattaccgcctcctgacacaaaatacatttcatgtatctgcatgagtgaattcaattggccttttattttctttcctgttatctatgacattcttctcttgcttattgtttttcttacctcattgtccatgccatattaggttgtaagctacatgaacatggggactttcctttttttttttccaacaaatattttttgttgtttgtttttttgaaacagagtttcactcttgttgcccaggctggagtgcaatggcacgatctcagctcaccgcaaccacaacctctgcctcctgggttcaagcaattctcctgcctcagcctcccgagtagctgggattacagacatgcgccaccacgcccagctaattttgtatttttagtagggacggggttactccacgttggttaggctggtctcgaactcccgacctcaggtaatccacccaccttggcctaccaaagtgctgggattacaggcgtgagccaccgcacccggcttcaacaacaaatatttaatgagcacctactctatgccaagctctaggcatctagaaattaacaaaagagaccaggtcttgtacttatgtagattacacttcagtagggtgagatagacaagaaacaagcaagtaaatactatcatatgaaagatggtgattaatgctctggagaaaaatcagaatgctgtagaatatgggatgatttggttagggctaaaaggatgacctgtctttaacaaggtaggcaagactataggaggagcaggttttgagaggaaattaagaatttgcaatatacttgttaatttaaaaatgccttctaggcatcccgtggagaggttaagtatgagtctggagttccatggagaaaataagctgacatataaatttgggattcacctgtgcacagccattgactggatgagatcacagagagaatggcctgagggatagaagggatcaagcccaagtcattgctcatcccaaattaaagatttgtaaaatgagaacgaaccttaaaagaggactaagaaagaatggtcagtgagactgggcacagtcgctcatgcctataatcctagcactttggaaggccctcaaggtggcaggatcgcttgagcccaggtgtttgagactggcctgggcagcatagcaagacctccctctctacaaagaacaaaaaaattagccaggtgaggcagcacacacctgtcatccaaggctgaggtgggaggattgcttgagcccggcaggtcaaggctgcagtaagctgtcattataccattgcactccagcctgggtgacagagtgaccctgtctcaaaaacaaacaaacaaacaaacaaacaaaaaacaaaaaggtcagagagcactgaggagaatcaagaaacagttgtgaaagccaaatgaagaaagcagtttaaatgtgactgactgactgatggcctgtgttaaatcctggtgaaagatcaggtcgggtgagtttggagaaatgaccactgggtttggcaacctcaaggtcactgatgactttgacaagtgctgtcttggtgaaaaaaacatctcttttaagaacttttgctttgaggggaaacagggaattgaggtggtaggatcaagagaatttctcttaaaaaaattattgtaggctgggcatggcggctcatacctgtaatcctaggactttgggaggctgaggtgggcagatcacctgaggtcaggagttcgagactggcctgtccaacatggtgaaaccccgtctctactaaaaatacaaaaaaattacctgggcctggtggagggcgcttgtaatcccagctacttgggaggctgaggcaggagaattgcttgaacgtgggaggcagaggttgcagtgagccgcgatygtgccactgaactccagcctggcaacaagagcaaaactcggtctcaaaaaaaaaaaaaaaaaaaaaaaaattattgtcctagaaaacactaataacgttggcctggtgtggtaaaccagcaatttgagaagccaaggcggggaattgcttgagcccaggagttcaagaccagcctgtgcaacatggggaaagcttgtctctacaaaagatacaaaaattagccaggcatgctggcacatgcctatagacccagctacgcaggaggctgaggtgggaggatcactcgagcccaggaagttgaggctgcagtgagccatgatcatgctactgcactccagccatagtgacagagtgagaccctctctcaataaataaataattttaaaaagaaaattcataatatacaatctaycctcttaaagtgttcatttagtacagtattattaactgtgagcacaagaaaaattttttttgatagaagaaatcacagcatatttgataaagtgaaagaaaattcatgttttgggaaggataaaattgctggaacaatgtcctagaggagataagaagggagggatggcgaggctgagcgattttcctaaggtcacayagccagtaagtgacaggtcaggattccaatccaggtcttctggctctctgttttttactgacattttgctataccgtaaaatgagaaaaatggcttgggcaacatgtaactttcytcctagttctaactttcatgtctctaacattttgatatgccttcacccatcccaagcatgtaaagaaaattccgaagtcaaacatagtagcagcagcagcagcagcacctatctgaacccacagttctcgtctaggtgctcacctatctcatctcaaccactctatgaattgcttagcagtcagcacttggactcatcaaygcctgagccctctgtgggaatcacaaactgtttctgatacctggcagctttactmatttatgttatctgtctggcttcctaaggtatttgagtttgcaatgcttgctcctaaaattaactaggcagtggtctaacaagaaaaggaaggaagggagggagggaaggaaggaatgaaggaaggagagaaggaaggaagacaggagaatacaaagaaaggaagtacaaatgaaggaaggaaggagaggagaagagaggagagggagagggagctataaagaaggtatttacttaatgagttggaaaatcttcaaaaacaatatgggtataggtactttagttgattgtattataagctattgtggtttctaaagtgattttatgttggccatggtcccaatccaacagaggcttttaatatgctatagaagctattattattctccgtatttaaatgatcttaacaccttataatcgtaatagttacttagagaagtaattaatttattctgtgtatataaacataatatgccttcataatattgtcccatcatcttcagtgaagtttacgttaatgctaggaaagccatttaatatgttcagtatactagaaggaaaaagcccatttctcagtggatagttctcaatactaaaacatttgacaagcaaatcaagactactgcaaagactatctctgagagaatcagaattcttaaaacttaaaatctcaagatttggtctttttccccctaatatgactggaaaatcttatggttcttcccttaaattaacagcctgtgcttaaaagttctgagggaaacacttgcaaattactaggaaaatgttacagtcgtattttttttaacaaaaactaagaaataatttcctgttttatccaaaattgaaaagaagttaagcaccactggaaaagaaaaatacatttgcatctaaaacacaggtccctaatgagaagaaattcgcttggttgactcagtaagagctgtcttctgggactccacactattggcactgttttccagcattctatctgtgaacaagctgtgtacattccaagtatattaggcatattttatgttttcagtgccatgcttaaagagtaccttgttgtatgctgtctctctattacagcatgaactctggagtgtttactagattttttaaatgcttcagttgctaaatgagataaaagtctcagccaagaaccaaagaacttggacctcataggactttgctcctgtttattatcaaagtgatacatggctacattcttgtcattattccacaagatttgaggcctctggaatcaaggtgccatcttgctttcttcaccaggggactctgtcctctgggctctttctcatttcccaactctgtgtttctcctacatagatacccacttttcactctttccaacacaggtcttcccatgctgcttttttgttgttgaagattttagtttggaatagtggttttttttttattagtatactggtgccatttacatgtatattacaatgggcaatttgggtggtacaatgttatgtcaatgtcgagaaggcacagcccagctacagtctggaacacagtgtaaacaattccatggggaaatgttgcttgggttttggaatgtttcttatgggtgttttaaaatgtcttttaaagaggctcaagcagctgcggtgaatataatcaggtcaccatttccttatgtttaagggtttggcggaggagaggccaagtgcgaggatgcagggaaaggaaataaatgtggaacaggcaggaaagaaacttacttgggcacaggaagccagagaccctggagaggaaataaaggaaaagcaggaaccacaaactaggctaagaaccacagtaaacacagtctgagagccaagtgttctcttatgacaccatccctgttgctgtgtttggttctctgtcctttcttcaagtaagggcgactgtgtccacctccggtggttcccaaatcaggctgtcacagaatcagatggaaagcttaagcaaacacagattcctgtgctctggatcacctagagaaaggaacctggaaattttcttttcttgttttccagctactcccaatgtaagccaacttggaaacaactaatttataacatcttaaaagctgaccaccttatcttagggagaggtcaaccccttggagaagagatggtttagaagggtgtttttaattgtataaaacacaactataagtcaatgcaaacaagaccatagactaacatatgccagtcttggatgtgcattcygaaagttgatggttaaaatagtctatgggggccggatgcggtggctcaggcctgtaatctcagcactttgggaggccgaagcttgcagatcacctgaggttgggagtttgagaccagcctgatcaacatggagaaactcggtctctactaagaatgcaaaattagctgggcatggtggtgtgtgcctataatcccagctacttgggaggctgagggaggagaattgcttgaatccaggaggtggaggttttggtgagccgagattgtgccattgcactccagcctgggcagtaartctatggatggatcatgcctgctacagaaaagccaatgatgcttaatccagagatgacctttttgccattaagtaagaaccagagatcagtgagaaaygtcttactttggaaatccgtaaacatacaaatcatccatatggatggtgtaaaaccactagttgagctagagtaagcaaatgatctttgtggattctaggaattaattgactaaatatcccatgtcctcctgcttacactcctaccaacatagtattggaggttgtctgatgctcaccccactatttttatggatttttatcttgaggcacaatgggttggggttagttctcctagactcttgttgttctgatttcctatttcttctgaattatttttttaaaattcttttttaatttttgtgggtacatagtaggtggcatgtaatgtataaataattacatcagagtaaattgggcatccatcacctccccagtatttttcttttgtgttacaaacaacccaattatagatttagttatttttaaatgtacaattaaattatttttgactgtggtcaccctgttgtcctagcaaatactaggtcttattcattctttctattttttggtatccattaatcatccctactcctctgcctccctgctacctttcccagcctctgataaccacccttctaccctctatcttcgtgagttcatcctctgaattcttacttgttacatccattttgcctcctatgcctggtcttcaccccacaccaactcacacataaaccccttccttccctttggtgtcccagttttcaaatgctgttatcagaagtatagggggttacaagaagtgtttacatcacaacataacactcaaacaactttaaaagtgtatattaaatattttcttttggccctctctgtgatctggaatttcttgtttactgactcctccccaccactctggtctttcatccaatttgagagattttgtaaacttctgaattccaaaaatgaattgcaggtgcaagtgtataaacattttctatctctagagttatcaccaaattatctttcagatttaccaatttattatcaatctgtatgcccatcaataaagtataatcacttgattttcatcattcccttgccaaaaatacatatttgtattttatatatttactcatattgtaggcaaaaaaaaattagtccaatattttacttgcacttttttaattatgaagagtttgagtatctcttcacaagttcaagggtcatttttacttatttatctgtaaactacgttttttttggtkttttttttttttttttttttttggagacagtctctcactctgtcaccctgctggagtgcagtggcacgatcatggctaactgtagccttgacctcctgggtccaagcaatcctcccatctcagcctcccaagcagctgggatcacaagcatgtcaccacaccccgctcattttttaattttttgtagagatggggtctcaccatgttgcccaggctggtctcaaatttctgggctcaagtcatcctcccaccttggcttcccaaagtgttgggattacaggtgtgagccaccacatccagcccaggtttgttttttctattaaggagttggtagttttcttcaattttcttattgatttgcaaaaactcttcacatatgaggagtagtaactcattgtcatatatgttgcaaatatttcccccagtttgtttcttctctgaaattttcagtggtgcatctgatcccatgaggatccccctgggcttgggattactgctagcttttcagtgaggtcacccactgtttggtgggaaagccccagggacatagagctatttgtttagtgtgagcgagtctttttgtttctgttgttgtttgcttttcctgctttttctttttctttctttctttttttttttttttttttttttttgagatgaagtctccctctgtcgcccaggctgaagtgtagtggcctgatctcagctcactacaacttctgcctccagggttcaagtgattctcctgcctcagcctcccaagtagctgggattacaggcacctgtcaccacacccagctaatttttgtatttttagtagagacggggttgcaccatgttggccaggctggtctcaaactactgacctcaggtgatccacccgcttcggcctcccaaagtgttgggattacaggcgtgccaccacacccggccttccctctttttcttacttttttttttttttaaattttcagccaacttttattttctgtaggacatatttagcacttgtgaattactcccagctgatactttttggtctttcgccttgctaggaggaggaaatagtaaattcccttttatgatgcactgtcttgcccccaccttctggttttcagatcagttctctgagacacttctaagtctatttttcagcttctactgttctctaagtttgggggcatgtgtctactgctagaccattattatttgctggatttagttcattttgctcagtttggggagagagggagaagagcttctctcaacctgtatctaggctaacttcctccccagaaagctgttctttactttgtgtgtttttctagaaagaacattctacttcttgggtcccctgggggccactcttgctcaggggtgtagtttaaagtgggccagcagcatgggagaggcaaagtgagtaaaaatgtacacttaggccacagtgaaagaaatcttcatctcctctccccctaaaaaaatttccatggaagattttgtgcccttgatggtatagggcctgtgggaacatgtaacatttacacgttcgagttatatttctctcacataattaatagccatttattttattcaaatatgctcctaaaatacatctaggagagtaaatatgcttcttttattataaaatattctcagctctaataatcattattatgttaacacacgtatgatgtgatgaaccacaagcaggcagtgggtgataaagctaaccttgcccattgccagtgtttcccaaactttcatgtttttaagaatcatctgggagctgttaacgcagtttccttggccctgccccacacattctgattcaataaaggtggagcccaggaatctgcctttcttttttctttctctttttttttgatgcagtctctctctgtcgcccaggctggagtgcagtggtgcaatctcggctcactgcaatctctgccgcccgtgttcaagcgattctcctgcctcagcctcctgagtagctgggattacaggcttctgccaccacgtctggctaatttttgtaggtttttagttgagatggggtttcaccatcttggccaggctggtcttgaactcctgacctcgtgatccacccacctcggactcccaaagtgctgggattacaggcatgagctaccacaccctgccggaatctgcctttttaacaagcactatctgtggtctttagtactggcttcgaaaaattctggggcaagatatctcaacctcagcattactgacatttagggctcaataattctttgttggtggggcgctgtcctgtagatgccagtagcaacccccctaatcgtgacaataagaaatgtctctagacattgccaaaatgtcccctggggagttcaatcaccctcaattgggaaccactggcctaggagaaaataaatgagaaaatgttaattaaaaacagtgtttacttttgcatgcagccattcatactcttgcatggatttcattgaacaaattaaacaactatttctgagcatctggtatgtaccaagccttttatattaaaaatgtttaatcatggctacctctttaataatttggaaggtggaagaaaatgttcttataaattaatatctattaagcatatatttttcctaaattaatattcctaatagttttctgaagaatattctagaactttaaaattaatattaacaaagcattgacgttgttttagtaaagaagcaattcagaataaagttggtatgattgctttactttttttttttttttttttgagacggagtttcgctcttgttgcccaggctggagtgcaatggcacgatctcggctcactgcaacctctgcctcccacgttcaaacaattctcctgtctcaccctcctgagtagctgggattgaaggcatgcgccaccacgcttggctaattttgtatttttagtagagacgaggtttctctatgttggtcaggctggtctcaaactcccgacctcagatgatccgcccacctcggcctcccaaagtgctgggattacaggcgtgagccacttcacccggccttgctttactgtttctaataatgaaactaattttgtttgtaaattttacacttattctaatttaggaaaatatgagaagggagtgatgaagtacctgccatgatattgtttataacatctcacatctgatgtaattctaaaattcttccttagagagtctatggtccatataaataaataagtgatatccaagcacactcattttaatgtgagtttttcacatgatattaaaatgttaaaaatagatcagtatgtagggcatccaagcatttaattccttaaatcggagacatgaggagaaaaaaatgaaaaggaagaaagaaaagaaggaaaaggaaggaaggaagaaaaagttgagtcaaggctgaagctctggcatctctaaccactggtcagtaaattctattgaaattcaatagtataagagacaaacaggcaaaaaggatsgtgaaaccatttccaaataccaagataaaggaggctattgacattcaggaaccctgagaacagctgatgtcccattgtagacttcatcctcttccttgggtgaaagtgtgaatagcgctcaaggcagggaagaagtcttttctctgaaggtgctatttatggtgcccttggcctggatgggctttctgggtagttcccaagggtatcatttctttgtattggaaatcagggacctttgtgggttaggaaagtagaatcaggccatggctattgtctttccctgctgtgtttcacatgtaaaattgactcccagaagagcatcccagggccttgtcaaggagtggggaaaatagcagactgccctagggtggaaacctaactgagagtgcaagggcgacttgcaaagctggggagagagaattactgggaaaatcgtgcctagggcaaagctgaattcaagaaatctgacttttgtgatcttcctctgctgagaatgaatgcggccacctacagcagagtaagaccacagcttgcttttgaaagtgttgctctctaggtggggtgtttgtttgtgtgtgcctgtcctctctcaggatttctagacggttcattttcaaagggtcattaacattatttaaatattcatggtggaggaggggatgagagactgaaatttcagacatctcaagagtgagggatggctggccacccgcctaatacagccccagtctgcggatcagctgcctccttcccctccgctggctttgttagcacacgcgctctgacaccgggccaccggctgccactacacggagggcagcaggaaggctctggcgagccagtgagctggaagcatctctgtccacacctcagcctctgaaccccatcgggggagtcctcaaacacgcggagacaccattactgccacaaagacgcacttcgcaaccagttccgggagtcgctctgaccctgaggacagtcgtggtgctaggtaagggacgaggggctgtttccccgcctgagtgggaactcagcggctcctggcatttgagcgcacacaggcactcacacacttccacatacgctcatgcgcacatatgtgtacaccaacacacacgtccacatgcacacacagcgacacgccaccccgctccaaagccccgtgcgctaacaagtatccatatacccagacacagcgctcccctgagttaggaaacactcagctttgcccgccccatccatccctccgtctttccctctctccagtctctgcattcattcatttcttcgtttgtgcatcgattccgccgaagccactgagaggagaaggtgtgggtagatggggaggggaggggagggaggggcggtccgtgggcgctgggctactggaggggaagcgaggaggcggggaaggggcgggccccaggagcaggcgggcggggctccccgccctccagcgcgcccggaggctaccactccctgcagatgcgctggccccagcccggggctgccgctcgccttcccccggagtctcctggacccccggagtctcctggacccccggagcgggaggcagcggccgcgcggcgctggactggagcagaaccccaggactgcgcccccgggagcgggcgcccagaggtgggtgtccaagctggggaggggaggggctggagtgtcctcgagtgtgaggaaggggtggccgaggaaggggttgccgaggaagggctggaaatctgggagtcctcggaagcaccgcgggcttttaaagggctttttgtggtccttgtcgagcggagcgtgtgctgggagagggcccgggtggaggggctgtggccatgtggatttgaattcctaggtttgtgggagggccaagcctttggctgctttgttcaatgcttatcatttatatatgctttaaaaactaaacgcaggactccgcttctccctgtatacacacagagctgggctgtgtgtccttttcaggaaaagcagtgaaatcaaatgtggtcgtggccgcatctcctgccccgggagcaccgggaggtgcagccgttccttctagctcgcgaggaaggcgcgggtcctgccttttgggtggcagagccgggggcattttcgcaagtcctgaacttttcagagagactgaagtcagggagggccgggccccggccccggtcccggccccagccagagtctttcgggatagggtccagggagctgaactcaggagatgatgcaggaggagccagcagcctcttctgccctgggagggagaacgcggtccgggtccgagctgagccagaagtttggcctgaggctgggacctcagcagttagaatgtggtatcttatccgagataaagccggagtttgcgtctctgtgggcccttcttggggacactctggggtatgggaagagcagaccgtgggggagagcactgggcaagccgtacctgtaatgtccgtggaggcgacgcgcctgcaagaaccagagcaaggagacactggtggccccaagaaatcccagagaaacggagtggataggaggggagtaaaacggagcccgggagagccggaagcccgcagcagggagctgtggcgctggtggccgggtgaggactgaaggcaaagggcgaggcggcgtgcagccgggctgccgagctctccaacgcggatgccaggcgctcgccagcctgagggatccctcctgacccacaaagagggcgtctgggaggtgactcgtttagagagatggtggattccctttccagacccaggaaagcccgtttcccgtgtggggtagcatgggtttggctctgataggctgcgtggtcagatcagactttgacatatcactacccttccccgtagcagttttaaatgcagcacaggtgatttgggaagacttcctaaatgtataatatttctttttgaaaagaaacttcacctactcatacgtctatacacctctctctgtattgcatcttggaatctgtgaacaagcccatgtctcccgggaagcgctcttctatcccaactcccgtttcacaggctcctggagactgcatgaatacaaactcctctcaccattgggatcccagggaatttgcttccttgtcttttgttctgattagagttcatttaagcatcacacttttctttctggaaatgttcttaatttaaatttaactaagcttccctttcttccagtctggcagcttccccaacattcatgaatacaatttcataataatatgtctagaaatgaggagtatccagcaaggagttttactctgtttctttaaacataaagacttggcctaaagagtgttttaagcaatgctccgctgccggttgtctcctccccagttttgacccttggccctttctctgtttttcttttcttttctttttttttcttttcttttctttcgaagttttgctcttgttgcccaggctggagtgcaatggcatgatcttggctcactacaacctctacctcatgggttcaagcaattctcctgcatcagcctcccgaatacctgggattacaggcgcccaccaccacacccggctaatttttatatttttagtagagatggggttttgccatgttggccaggctggtcttgaactcctgaccttaggtgattcacctgcctcggcctcccaaagtgctgggattacaggcatgagccaccacacccggcctggccctttccttaaagggcatcttctcctttgagtggaggcacaccaagtttcctgcaattatcttggacagcaccaacaaaattagtcctgagccagggacaacaaaagtaaggctgcctgtctcccagtctttacttaaccaactctgctggagagttcatttcactttctttctgggatgctgagatgctaggatgagaggaatagctgggctttgagatgggacaaacattttgaaatactcattatctcatagttctggcatgacagttggcaccacttcctgcctgcagagtctgaagttatttcactttcataagtggcttattctgactcagtagcctcaggacctctggctaataaagtgaagtaggttgtcttaacttcgttgtcaaatgaagggagaatgaatccactggctttatttctgaaagtttgaatattttcttatagaactaacattaaatattacttccaaaaatgcaaacactttggtctttctagtcattgtaattattgtctagataattacaataatccaaacaataaccattacggatttggtgagctcttaaaatacccatgtcccagatttctgtcacggttattaccagtctctgcttattaaggtaatgagaaatgtttcaaatgaagatgaaattgaatttggatggaggttgtgttgagggattttaacagttgaaacaggagcatgctaaaaagttacttctgaagaccaaggatagactgtttagttccagtctttagctttatacatgactcaacgccagtagaattgatgctgtatcttgaatcagcttttggaatgattgttttttgatcttaagaaacatagtactcactgcttagattgttgatcagggattctgtgtcagctattggaagtttgaagtaattgattagtatcttgatgagcttcaacaatttcagtaagtttgggtagcaaattgcacccytttttttttttttgaaatggagtctttctctgttgcttgggctggaatgcagtggcgcgatctcggctcactgcaagctccgcttccccggttcacatcattctcctgcctcagcctcccaaatagctgagactacaggtgcccaccaccacgcccagctaattttttgtatttttagtagagacagggtttcaccatgttagctaggatgatctcgatctcctgacctcgtgatctgcccgcctcggcctcccaaaatgctgggattacaggcatgagccatcatgcccggcccaccattttctttatactgtgcaaactcaacacccagaggcagaatttctgtaaagctaaaaataaaggaacaacttcaacttcagtttctctcattggcatgagcctcacccagcagcacttcgggtagcttgggcctcagggaagaatgttaccatggaccatgatgggagttaaggtaatccatatacatgtatatcttactttgtaaaataatcccctctatgaacatgtaagactactgttcacaatttggacattttcctttcaaacacatttttcatgaatatrttataggaaagttaaaaccatctctattctaaaaggaaaatctaccatttkgctcagagagaaagttactgagtttgtctatgtgattttaagtagtatttgattagagtattaaagaaatggggtacttcaagtaacataacacctgatatttaaatctaagttttaaaaatgtatttcacccattgttaatgaaagtgtttctaagatgtaacccctggttagctattccgtcttcttgccttgatgggttgactggtggtgaatgtgctgttgtcattccattgacagttcgggattttgtggtggtctcagcatattagcatagatgtgagttgtaattttataggattatggaactgtaattgtggaactcctgcagggcagactctggaggctagctttttagaaaactraaacctccagtataaacttaatttctgtcatttgccccattttcttgaaagttaagtgccagaaaagaaaaggatcgagtctctcttttctttctacaataaaacagaatatactttctccagggtttggtggtgggttcctttttcctgttgaggtggattctgagattgaggaggggctggagaagacagagcatgagggaaagagactgagaacatactcaggctgccctcgcctccttttccctttcgtgctcctgtctcccatctaggaggaccagggctaccagtccttgtggggacaagtttgagtaggatcaagagacatgtaactgcgccaggcgcggtggcttacacctgtaatcctggcactttgggaggctgaggcaggtgaatcacttgaggtcaggatttggagaccagcctggccaacatggtgaaaccctgcctctactaaaagaatacaaaaattagccaggtgtggtggcaggtgcctgtaatcccagctactcgagaggctgaggtaggagaattgattgagcctgggaggcagaggttgcagtgagccgagatggagccactgcactccagcctggtgacagagcaagaactctgtctcaaaaaaaaaaaaaaaaaaargaaaaaaagaaagaaagaaagaaaaagaaaaaaagagacatgtaacgggaatttgttcccatcttggtgacagtttcagagtgccccgcataggccgtgcaactggagaaggtgccctgtggaggcagaatgctgctgctggggtccttaaccaggcagaggttggatatgaagatgagatgatgtagcttcttttgagtaggtttgaggggttgggttttttgtttgttttttcttctaagccttggaaggatgcatgaactcgttgaagggggtgtgacatgaatgccagggaaggagagagacctgtggaacttactggggaaggccactatgctttgaacccttcttttttcttagatatgggcaggggctttgtggttgtttttgatgcctgattggagcagatggggtggcaaggccaaatacgcagatattgtggtgcgccctttatccagaaccagggcatggccaaagcaccctagtgcctcagccaagttctctgtgagatcttggtctgtcacataaacaaaatcttagttcattcatctataaaaatggagataccaggctgggcatggtggctcacgcctataatcccagcactttgggaggccgaggtgggtgaatcacctgaggtcgggagttcgagaccaacctgaccaacatggagaaacccggtctctactaaaaatataaaattagccgggtgtggtggcgcatgcctgtaatctcagctactcaggaggctgaggcaggaggatcgcttgaacccaggaggcagaggttgcggtgggccgacatggtgccattgcactccagcctgggcaacaagagtgaaactctgtttcaaaaaaaaaaaataccaaaacctacctgttcaaaacttgtgtaaaatcagatggttatggaagcaccttgtacatgtattcctcctaaagttggttgttcttaaattaaccaaagccttctttcatcttcattacagatgcaaatgataagtaaatagtttttaaattaattatttttattattattttttgaaacagggtctcactctgtcacccaggctggagtgcagttgtgtgatcatagctcactgcagtctcgaacttctgggctcaagtgatcctcttgtctcagcctcttgagtagctgggactacaggtgcatgccaccatgcctggctgtttttctattgtttgtagagacagggtctcactacatcgaccaagctggtcttgaacttcggggctcaagcagtcctcccacctcggcctcccaagcagttccacaattacattcccaaagtgctgggataacaggcatgagccgccatgtgctggcctaaagwtaacacttaaaatgctagcaattgtgcagcagatcaattgttcatccttcacactgattaagtagctttgaacatggaaattctctaagcctgactgccccccgcccctacccgccagctgccattctcacccctgaagcacttgcactattgagaattcttctatttttcattagttgatccttctttaagctttgagtaattcaggaattggtcttcattgggacaatggaccgcaattttcagaaccataatcctagttttttagtttttttttttaaatttttatttatttatttatttmttttttgagacagagttttgctcttgttgcccaggctggagtgcagtggcgcaatctcagctcacagcaacctccacctcctgggtttaagccattctcctgcctcagcctcctgagtagctgggattacaggcgtgtgccactgtgcccggctaatttttgtatttttagtagaggtgaggtttcacatgttgtccaggctggtctcaaattcctgacctcaggtgatctgcccaccttgggcaatcccaaaatgttgggattacaggcatgagccaccacgcctggggaaggggcctcttttggtgaaaaggcaagggcactactcctattcattagtgttctacgcttacgacctaatcacctcccagaggacccacctcctcattccattgtattgggaattagtcttcaaaatatgaattttagggagacacaaacattcagaccctagcagggaccctggaaaggattctcattgtgcagagtatggataaacagtgatgctagggcagtttttccagggttgtcagaaagggctgaactagaagtttccccactgtgcctggagtgccctgggttggttgagtgtagggtttcgaagataattttgtcaggactctttagtttttagtcttttatgagttagaagagtgtgcatatgtaactgccaccataccacagcaagttccagcaagagagaggattcctcaggtggccatcctatccaaactccatggctctttccagggcgtttgtgggaaacctgtggggctaggactgagctagactttttcagtagctgagactggtcctgcagacccatgaaaggtgccatgccgtcacccagtagggggcagggagggaccctcatttgcccctcttcccgcccaacagttgcctgacttcagccttaatgcatagctcatccagagtcctcctgagctcccacctggtgaggtgtgtgtagaaggtgtgaggaaggccaaaccacattttcctggcagtggttaactgaccgttttcagcccgcctcccagtgcagctgactgcgtcagcttacattaccgtgatgtcattcccatggtgggataatatagcatcttactttgtctggagtggtgcctcccataagttttttgataccgcctacaaatggagaaagacatcattgtttagccatttttatttgggtgggttggaggaatgactttcccaaaggaataaatcttagttaatattccagaaaattcaagtacttttcaaccctaattgaaaggcactctgtgtgcgtgaattaaaatcaaggtggagtccatgtgccatgtgctgtgtgattctaaagccatattttagcttggcctattagtattttgcatcagaacattttatacttgcaaaggttagcaagaattttcctcagacacattacagatgagcagaatttattcattttgggggaaaaaatgaacagactgtatttggaaacttagatcatatccaaagcacttgatgattcctgtttgraatcatttttccttcaaagaatagttcagatcagtgttaaatgcagggcagagatggactcaagagtgggaggcattgcttttgaatggaatcacaatgtgtatatcattttaagtattatttttatggtatgtttcattatcaaaaccatctatagcctccaaaggatgacaggtgttatagtgtgagtggcgtagagggtgttgagatagaggaatgaaaagagaagagatcgttccctttccactcaccattcatagaggaactaagttttaccttctagggaattccctgtaattcccagggacgccttgtccttgcggttcccaggcaggatggtaggaggagctaagtgggagggaattaatatttcttgagtgtcggctggtaagttggttgctttacctccacttttttagagacagggtctctccgtgtcacccagatggagtgcagtggtgtgatcatagcttactgcaaccttgaactcctacctacactattttacttaatctttatagtcaccagcatttttcaaatggagatactgagacatttggaagtcacataaccatccaggggtcccacagctacataatgtcaggtcagttttcctacccagctccttctctgttttttttttttttgtttttttgttttttttttgcaacagagactcgctctgccatgctggagtgcagtggcgccatctcagctcactgcaacctctgcctccccggttcaagcgattttcctgcctcaacttcctgagtagctgtgtctacaggcgcgtgccaccacgcccggctaatttcttgtatttttagtagagacggggtttcactgtgttagccagggtggtctccatctcctgacctcatgatccgcctgcctcggcctcccaaagtgctgggattacaggtgtgagccaccacgcccagccctctccttttcttactaaaccagtgctgtaggggcttgctactccaagtgtggtctggggacctgcagcattcctgtcatccaggagcgtgttaaaactagagtatcctgagccccatcccagacctacttaatcagaatctgcattttagcaaaatccctaatgagtcctgagcatgttactgtgtgaggaagctctgcttagaggaggaaagtctgacaattacaactatgcatcctggccaagactcaggacttgaatccatggactggacccgaaacattggtctatctcagtgagggaggaagggtgctactagaatctgatgggtagagaccagggatgcagctaaacrctctataacacacaggacacccccttccaccaacaaagaattatcctgcacaaaatatcaatggtgccaatgttgaaaaaccctggtctaattgtctagatgtagaattcacatcctgtagatatgtttcgtagcctcagatgtatgcaaatctctaggaagtagatcttaaaggagttgatacaaattgcagtgtgctatgcaaatgggaatatttttattgggacttgaaaagagaaaaagagcttaaactgaagcatgaaagatttccattagagttttgagagygtcagactctcaaacaatartatcagggatgcagtggaaaagtttctaagcatgtactgagtacccaccattgagggtgctacaaggcaacattccctcccattcccaatcctgcctggcaacagtgccttctgtttcttcrttttattcctaagacttgccctggcctttgtcctacctttccgttctcaagcaggatatgctgggtcagttgtgccacctggaggctgggggaggaacgcaaataatgaataattggtaaagggaaccaaagcgctgtttctaccatcttttcctccctgcctgcrtggatccacacctcactgtttcttactcaactccttcaatgccacgacactgtagccacttccactggtggacacatatcctctctccctccttccttcccattctctttagatcctggcccagaacatctgaaaagatctgtcctccctcccctgtctctctccctttttttcttctctttcttccttttctgagctgaacagcaacctgtatcaatactgggaagtaaaatgagtatgcttattgtatactgatggaaagttttttggttttttttttttttttttttgagatggagtcttactctgttgccctgctggagtgcagtggtgcaatctcggctcactgcaacctccgccccctgggttcaagcgattctgctgcctcagcctccctagtagcagggattacaggcatgtgccaccacgcccacgtaatttttgtattttgggtagagacagggtttcaccatgtttgccaggctggtctcaaactcctgacctcaagtgatccgtctgcctcggcctcccaaagtgctgggattacaggtgtgagccaccgcgcccagccgatggaaaatgttttgaagtgaaattatatccaataaagagctcctgtcattcatccagttgtgagagtccctttgagagttgccagaaatgtctgctgtcttgtttttactcttaaattaacttgctctttctcgaagtacagaattctaaaacagagttggtgtttttgttgttgttctattatgtcctcctgctttctttagttgttggtactagaatagtcattttctactactttttcatggacattatccttgaaataggttattctagacaagttttggaacccaaactggatttaagaccaaggcattccaagaaaaataaaatctttttgcaatttctatgcatcatctttttataactttcattctcctttgcaaaggaaatgtggggctgtggatgtgaaaggaggtgggggcagtgaccggccagctgcagaacattcaagcctggcctttggactcagagactagggcagaagaagccagagtgctaggcttctggccagagtggaatgtgtcttcccaggagtgggaagcctgtgtttttccaccttaccatctgatctgctccagagggctctgcattagaaaaatagggagctatggggaatgactagsgggtggagatcatgagagcagtgtctatggaggattatcagttatgctcagaaagggaagatttggcacctggtcatcgatttttagtacagtaattgtcttgagaaaagtatttgagaatcaatattagaaacaatttttaaaatatatcagtcttaaaggtacataaatgagaggaagaaaatcagagatcagggtgtctgcaagatggtctactaggctttttattattgtaatttgtgattgaatgccctctgtggggccaggtattttgtttttgtttttgtttttgtttttgtttttgttttagatgagtcttgctgtgttgcccaggctggaatgcaatggkgcgatttcggctcactgcaacctccgcctcctgtgtttaagcgattctgttggcttggcctcccaagtagctgagacaacaggtgcgcaccacaacatccggcaaatttttgtatttctaatattcaccatgttggccaggctggtctcgaactcctgacctcaagtgatctgcccaccttggcctcccaaagtgctgggatgggccaggtaattttattttagcctgacaactactctttggggtccttggatagtttttaattccattttgaagatggaaaagtgagatgaattggtcaaggtcaggcccacaggccctatttttttccccttgcattgttactgtgctgggtgacaactggtgctgagacagctgctgtctccatcactctcatgaggaaagagggtcaacaggtccaggagtttttgtttgtttgtttgttttagatggaatctcactctgttgcccaggctggagtgcagtggcgcgatctcggctcactgcaacctccgcctcctgggttcaagccattctcctgcctcagcctcccgagtagctgggactacaggtacatgccaccagggctagctaatttttgtatttttggtagagacgggatttcgccatgttggccaggatggtctccatctactgaccttgtgatccacccgcctcagcctcccaaagtgctgggattacagcaggagtttttactctaaatattaagttaagcttacaagttaagctrcttgtaagctgtctgaaggtctatttccctgactttgcagttccttaattttgaaggcaatctctgcctgtatgtcttcttccttagagacctttgtcccgttaaggtaacctcctctcccagcccacaccttctaaagtaccttgtcacgtctcatgaactccacaagggtcctcttgggcatgataatgtgtgtcacctcttgcaagatccactaaaccctctttgccacaagttatgcttttcaaagtccgcctgaaaatatgctaacaagaatcattgtacaactgacttgcaaatacttgaacaaatacaaattaacaattactgcagctttatgaagaatgcatccaaaccaaggacagagtggaggaagacataatacaatgtatgggtacaatttaataaaaccttgaacctttaacatgggcccattttcatgcatgcattgtgatcaagttttgttcagaagggtgtaacttaactttgaaaaaaactatacatttttatgtgttttcagtgagtttaaccttccataagcacagatactctgttataaaagtgagtttaagctgcttcttgataatgaatgttgactgaaagtcaggccctatttccagtgtcatatgtggattgtcatatttaacccccgtaacaacctttgatagagataccattattttatatatatatataaaatatatatatttatttatatatatatgtgtgtgtgtacatatatatatgtgtacaacaggtacacaccaccacgcctggctaatttttgtatttttagtatagatggggtttcaccatgttggccaggctggtctcgaactcttgagctccagtaatctgcctgcctcggcctcccaaagtgctgggattataggcataagccaacatgccagacaaatattattataattttttgttacagatgaakaaacagacacaagggtttagggcaagggtacacagctagtggcaaagccaagcytggaatccctataggctagtggttagagacagtctcttaatcattcctgtttttactatgctgccttcttagtgcttaatacaaactaagcttgttstctccttttactatggttgggggtataaatctcagtccataaacaaaggcttacaaaaaaatagcattaaaaaaattttattttaagttccaggatacatgtgcaggacctacaggtttgttacataggtaaacgtgtgccatggtgctttgctgcacctatcaacccatcacctacatattaagccctrcatgcattagctagttatcctgatgctctccctccccaccccctccaagaggccccagtgtgtgttgttcccttccctgtgtccatgtatactcattgttcagctctcacttgtaagtgagaacatgtggtgtttggttttctgttgctgcattagtttgctgaggataatggctttgagctccattcatgtctctgcaaagtacatgatctcattcctttttatggctgcatagtattccatggtgtatatgtaccacataaaaaatagcattttaaaacttatgtaaattaattttatctccaagccttcaatctgtccaactataagaaaatgtaccccattatttttagacacacccaccctaggattacctgcaggacctaaggttttagaatgtgctaggttgtgggaagtggtccatccaacacctatctacaatggtttcaacagtgatttctagcacatgtgttatattagtttgctaaggctgccatagcaaagtaccacagcctgggtagtttaaacaacagaaatctattttctcatatagttgtaaaaggaagttaaattttgggaccccaaactcatttagccaaagggaaaagtcaagctgagaactgggtcacgcaaacctgcctcccctctttggttcctaaataagatggctacaagatgaaaaaatacctgccttccctatattttgcccacagggaaattcctggtgagctgttaaaacttcaccatggcaatgcaaattgatagtttatcttatacaggcgcagtcacccaggccctgccagactcaaaagcatatctgattgttcccctaccccattttgtctgtgctatcttatgtaaaatgcagattctccacattttttcctctgccccttttgtttatgtgaaaactgtgtgcttctcaatatcccaccttttctcctttaaatttggaatcctcaaaatcatctctggagaaaggcatacatctgtctcccaggcrtgttcttaactttggcaaataaatctaaaatgattgagatttgtcttgtcattttcttccattgacagaggctagaagaccaagatccaggtgtttgcagggttggttgcttctgagggctgtgaggagaggttctgttctaggtcttggcttgtagatgggtgtcttctcccagtgtcttcacatggtctctcctctgtgtatgtatctgtgtccaaatttctatttttttttttttttttgagacagagtttcactcttgtcacccaggctggagtgcaatggcacgatctcagctcactgcaaactctgcctcccaggttcaagtgattctcctgcctcagcctcccaagtagctgggattacaggtgcccaccaccacgcccagctaatttttttttgtatttttagtagagacaaaatttcaccacgttggccaggctggtcttaaactcctgacctcaagtgatccacccacgttagcctcccaaactgctgrgattacaggcgtgagccaccacgcttggctcaaatttcctcttctgtaagaacaccagtcatattagactcatccactctaaagacttcattttaatttaattacctctttaaagaccctgtatccaaataccatcacactcagaagtattgggggttagggcttcaacataggaagtggagcaagggttggggtaggggtgcacacagttcatcccatttgaggctctttaccagttcatgcaggcatgggacaggtcagggaaatccttggtaagtctgggaacctggagcccctcttctctgaagccttgccagttcccttaggagcttccacggaccaaagtgaaacacccaggggtggagggggtaaggagcttttctagaacaccttgcaaatcttgttgatggcttagatgtttacaaaactctagaagaatcttatctccttgatatgagatcctggaagcaaggagttaaaagcctggctgcctacctaaggaggaggaggaaggagtggaagtaaacgaagacattgattatgatagaaaaaatgttaatagaaggcgatttttggaagccaaagagaaaattcagcttgaatcccctagtagtgtgtatgctcatcttcccaagacggaagtgcctctcctgtccgacctcctagcccagcctcggtctggaacacattgggtcctaggcacccagcagtgaattggctcagaaagtgtttgagggctcaagtgagtccaggaacgatggctcacgcctgtaatcccagaacattggaaggctgagatgcgaagattgcttgaagccaggagttcaagcctgtgtagttagtggtatgtcctcagcagaagccacaggactgtgatttgaagagaaggatatggggttgaactgcttcttactgccacggcagctctctggccccggaactggggcagttccttcattgtcccacctctgtcatcgcaggaatcccaagctgtcacacttctcagtattgtttcctttgcaatttgatgtggacttggcacatttccaaggtggaaacgacccctcattcattatttttgggacctcggtggccccgtgataagggaaatgatggatgcctggacttgtcttctggcattgcgcaccagatatcagggccctccacaggaccagcctatgagacaggaagaggctgaggtcttaaagacatactttcttgggagtttgatgtttcctcttgcttccacagctgtcagaaagggcttgttctgagggtgacctgcaggttgcaaggctgtggaaacatagcrgtgacagcgttgaatggcttgtccccatcagtaagctttggtgtcacaccagccggatgactttctggtggagggccagcttcctgcacttccgtgacarcagcctgacagccccayggaggcatggctgtagacattaagacatttctgtagacatttgttctagttgttgtccttttttgtctgttatttattatttatttatttatcattatttatttagagacaaggtctcactctgtcaccaggctagagtgcagtggtgcaatcatggcttattacaaccttgatctcctgggcccaagcgatactcccacctcagcctcctgagaggctgggaccacaggtgtgcaccacaatgcctggctaatttttaaattttctgtagacagggtcacaccatgttgtccaggctggtctcaaactcctgagctccagcgatcctcccaccttggtgtcccagagtgtggggtcttaggtgtgagccatcgtgcctgccctgtttttcattttaattgtgtgacataaaatgtaaaatgtaccctctaaaccattttttagtgtccagttttgtggtattaagtacattcacattattgtgcaaccgtccccaccatccattcacagaactctttcaacttgcaaaactgaaactgtatgcattaagcaataactatcccttccttctttcctcttccccagctcttggcaaccaccattctactttctgtctctatgaagttgtctactctagtaacctcatataagtgaaatcacgtatttgtctttctgtgactggcttatttcacttagcataatgtcctcaatgtttatccatgttatagcatgtgtcacaatttccttcctttaaaaaaattgaataatgtcccattgtgtttatatgccacattttgtatatccattcattcattcgatacttgggttgcttccaccttttgtcttgcccttgtttttgagaggttaatccatctatgaggtcctccaggcatcaaaagagttccccagttccctactttggagaagttcactatccctagcaaagatgcaaagaacagatacatgaaaaagtaaatcatggtgcaaaagttgtatgagacaacactttaagatgtatcctatgagcgtaggtgtagatttgcaaaatggctggtgtggagtttctggaagaggatggcttagagagagtatggacttaaagcagagttaaggagcccaagctgaaatcctggctttgtgacttcctgtccttgtcactttgggtgaattattgaacctttgtaagctttagtttcctcatctgtaaaacgcagataatagtacttacctcatagagttgttgagaggattaagtgagtaaatgtaagtaaaagatgggcgtggtgattcatgcctgtaatcccagcactttgggaggctaaggcaggaggattacttgaacccagaagttctagaccagcctgggcagcatagtgagaccttgtctctaaaaacaatttaaaaacttagctggtcatggtggtgcacacctgtagtcctggctgcttgggaggctgaagtgggaagatcccttgagcccaggagttytaaggtggcagtgagctatgatcacaacactgcactctagcctggggaacagaccaagacattgtctcttaaaaaaaaaaaaaagtaggtaaagattgaaacaggctggcacacggttagaactcagtactaaaatataaaggagataacatattgcccactaacattttggctatttttaatatattgttcttgtctttttaatgaccacagatactctttagtatctgtttgctgcagtttttgcaggtattcatgatgcctgttatgcctttcctattttacctccttttcagattatgatagttttagcaaagaagtattcagttctagagactcattatcaaggaaagagagagctcttcatttggttttatcagataatagataataataaatatggcctggctttctttgcactgggaagatagagaatgaggaaggagaatgactattagtcattctaacgttagtctgttttatcgaactgaggagggagttagctttctccaactctgggcagattaccgagagtaggatgccaggttacattctcttgggagaacagtgctatcatggctgatctctcaattaaggacttcatatttagattatttaaatctcaaatattgaaatactctcatttttctaacaatgataattaagaaaactttgtaaagttacaaataaagtgaaattgaaaaggtttgctgaatgaagtattttactattgaaaggtcttctagaatgtaagtttcaaacacatcgtctggttggtgcattacttaatctattcctgtttggctgctgcttggtatttcccacgcaggagttcattgacttcaaggcaattgaatgcattattagccagaagaagaaaacatgtgagtctccttcacccaacaatagattttttaaaatacattgtgcacagtcctcttaaaaaaggcatcaatggcaggtgggtgtgaacagaggaatttcctcctccaccctggctgttgctgagctgtaagctgtaaacattgtgagagacaaaaagtatcaaggtctcaactttctttcggatattgctttgtatttctgtttactagtatgaatgaaaattttcctgaaaatgctggctaaaactgaattttggtgttgtctttctaatggaatttctgatcaacaatttcctttatgttggcaattgcttaatctgctgaagtaggtaaggtagttgtgctgccttaaaatttatttttatatttgtcattaaaaacaaacatgaaacttggaggttaattttgtctgtttaaattttgacgctttcattttgacaaaatcttttaagaataatgacgaggctgcagtgattgaaatacaatttgtgtggcttttaggcaagtgagcatttagcaagtaagaatttcccagattgggtttagagttgtatttgcttatgttccaaactyttttttttttttttttttggtaagataattttgaatatcagtagaacttggggcagatagaatgacagaacatggaatgtgtaatccttttgggatttgtatcttagttaagtaaactttcatgatggattaaggaggacaaagtctccagcagatttcacttggctgattttgtttttctgttctttttctgttttcctgatgaggcttctgtacttctccctttaaggaggcaactgaatagcatraaaataaggggtatgggtggtggtagttgctgaggggaatgacaatggatttggtaacacagcatgctaatatcatgcaaataatgagatgatataggaatctctgctctagtggtgggtctgaggtttgctctagtggtgggtctgaggttttctctactgagggcaaaattggagctttttttwaaaaaaaaaaaaaatttaatttttttttgagacagggtctccttctgttgcccaggctggagtgtagtggtaccatcacagctcactgcagcctccatctcccccaggctcaagcgatcctcccacctcagcctcccgagtagctgagaccacaggtgtgcgccaccatgcctggctaatttttaaattattttgtagagagagagtcttgccatgttgcccagactggtctcgaactcctggcctcaagtgatcctcctgccttggcctcccaaagtgttgggattataggcatgagctgccacacccagcctggaactttcttaaaagagaacttctttcttggtttgccacacctctgggttaacaaggtgccagagataattagcccttgattgggagaatgtgggactgttcactatggaaggatcttacagtatagaaatgaaaccctagtgtaggaagggagctgacatttttcagtgttaccttgacttaatttgcaaaatgttttattttctgaagccacagtgtaattcacagatgcaccaagatcaaaggtctctaagaagaagaggttgtggggaaagagcccwgtagaggtagggaggccacaatgaacccattgagttattccacctgtcaaaaccttggttttgtaaactgcaaaataggaccagtaatacctatgattagctgctgctgttacgaattaagttcagtaacaagtccracatggctggcgcatgctgttttcaataaatataaattctgctcccaaccattcaacatcaaatgagttgatctgcaaaaagtgttttgaaaactacagatactaattttcatttgtgtatgcctgttagttgacttcaaaacatttgtttgtcccaggaacagaagagaaatatcctttgatcatgagacaggttcatttttagtatgttaaggccactccatgtcattcttgtggcttgttaatgtggttaattgaaacccttccatattcttgatggggcagaaccttcagctgttttcatgttcatgttcaggggtgtaaatttctagacgatcttgtgggcctctgtcagctctgagattaaatgacgtgtgcatttgcttatcggattcttaactctaaaaccctgggatgaggactaggaaggagaaccaggaggcgctgagggaacaacagcttccacatggcccatctgctttgcagaacctgtgtctttggggtacaagtgagctggaggtggagctgcaacagagtgagtccccgtggtcagtcacatgcaccggcttccgcctggtatgatttatcagcagtgatgcaaacatgattcagagatagttttataagaatttttacttcggttaaatcataatcaggcggctatttccgtttttctaatgtcacttgattagctcaagatgcccaacccttattgtcctgactcatggagggaggctgcttgctaagtaatcgtgagacccaggagaggaagagggttggcggccatccccaccggaggggcatcctggaaaactccagagagggaagcttgtgaccatgactcctagcagagcggtactgacaacctagtacaaaacccatagtggaaacactttcacctactctcatacattcatcttcccctgagaggaagcagagctgacattgtccagtcccattctgcactcaaagaaatgcagtctcagagaagctacgggaatggttcaaggtcacatgcttgcatatggcaaaattccaaatgcagacagaccactgaaattaggggagaggggagatcttctctttctactttaaactattttatattgtttgggtagtttccaaagaacaatgactattttaaaaagaattttaaaaagtaaatttaaaaactaaaaagttttagaaactaaattttaaaatctctgtttatttgtgattattcaaattttagaaaatgaaaaaagagcctcaccaattctttcagtcgatcctctcatttttacagaccagaggactgagaaaagtataagttggtcaattgtgataagctgggtattggcagaaaatctgttttaaaacttagtaggctcactgggatgattgaagctctgtgttctgcttaatacatgtttagctgcctgaactaactcagatgactccatgctgtaccatagagagaggagcctgacctttggctttgggatctatgcgaccccagtcagaacatggcacttttgatgtcttcatgacctttgrcgtgctactcttcctctttgcatttctgtttttttcgtctgtaactgggaataatacccatccggcaagtttcgaattagaaattagaggccaggtgtggtagctcatgcctgtaatcccagcactttgggaggctgacgtgggtggatcacttgaagtcaggagttcaagaccagcctggccaacgtggtgaaaccccgcctctactaaaaacatacaaaaattagccagacatggtggtacgtgcctgtagtctcagctatgtgggaggctgaggcaggagaattgcttgaactcgagaggcggaggctgcagggagcccagatcatgccactgcactccagcctgggcaacagagcgagactctgtttcaaaaaaaaaaaaaaaaaaaaaaaaaagaattggtagaacccatctgaaattgccacttttataggtcaaatggtcgaatattagaaatttcatgtagttgaactcaacatttagagagtctgataggtactcagtaaatagttactattagagatgtaatagaggatacaaataaaattcttatggttgctttagcgaggtcccaaatgttattttcttctcccaaggaaatgactaacaggaatatagcttttcacttttttacattggtaaagatcttctctgactttggaaagcctgccacttactgagggccacctctactcatggctcccaggatgtagtctatcttattgacgtctttgacagttcataactcagttcactttctccctgtctatgcttggtcacttggatggatacatgtcctctgtaactcctccttctttcagttctctttcaatgaagatcaattatttttcatttaagaatcttcctgtgcaatgattgctctatgccctgatacatagaaaatgggcatattttccaattagcactaccattgtttcttgtgggtaaatttcggctaaaattatgtctataaaattcccttagacttaagtagtattattgagtgataggagcctgagggtgatttgggagatacttgtgttctgcccatcactgtgttattaactaaccttatatagtcttcgtaggacttgttcatatatgtacaaggtcagtaagatcattctaagtcaaacacttggctatctgtgattttctcaccattttgtgtttatagatagttcagacagtgagtgttagggaaacagtgaaaggtgagttagtagtagttcatattattaactcattttattggaatttccaatttttccttcccaaaatttttctctgaaccagtataaccctaaacctattggtaaaatatagaatcttaagcctattggtaaaatatagaatcttaactacattccaatataaagcaaactgttgatgtgggcaaaaatgagggggaggagagggagaaagaagtggaagagaaaatgagaaattctaagtcttcatcactttccacaggactcggccataacccaaactcaagctgcccactgttgcttgggatggcgggctctctctggaccagctctgtggctaagggtggcaaggggcccatcagaatggagcagtccctgatctatcagaggtctcaaaaaactgcctgctactaagcttggatctttccagaatcatgtggatgatagaatttgcctatagtgtcatgcatggaaaaggaagagaaactaaaggcagactttaaaggaattacttatctgtgccctctagcatctctgagaattgtgctaaggatttgttgcaaggatggcggtagatgaagaagccattggtttgagtgagatttggagttaggcgtagtaatccttgggtgctggagtagtgtcttgtttgagggagcagtgttcatagggcataaatgctatagaggtgtctgaaccacctggagccacaatctgtcctcatgatcttgcccttcaaatgcagccgcatgcccacataacccaccttggggagtagccaatactcaggctactctgtgggctggcattcttggtctcctgacttctgccccagctctaccttggttgataccccaaatgccccttttcctctggcctacctagcctgctttctccccttcttccttggttaactttgcacrtgaccattttgattctctaaagagaatcattcaattaggaaatggaaatctgaggcaatgagagagaggagacatgcatcactatttatttttagaaacttcacacaacaccaagcccaaactgttaagcattgccttaggagaggtttctaccattgtgcttgccaggtataagaaaagaaaattacaattgattctgtaatttcttttgtaataatcatcatagattccaaaacacagaatgagtctttagtgcgaagccctgaagcctctgtctgcaagtccattttaatgacagtttttgttctgagcaagaatgcgtcattgctggtcttgtgttttcagacaaacacaaagcttttaggaaataagaagcttaagtaaaaagactacaggttgttctctcctgggagttcctggacaccctctcaactgggacacttgaagtgagcctcatgacctgagctgagaattgccatggctgaaacagcttttatagggtgttttacatggacacttgacactctttggatcacattgtgtgtgatccagactcaagccagggttagcctagcttgttgttttatctcagttaaaagccttttgttaagagaacaaacaagaaagttcagataggtcaagaaagccagctctgaggatatatctagagggcaagtcatatttatttttcaaagtttccccaggaattaaaggttgcacatctaaatgtcaccacttctgtgacttttgcagataaacattagatttacctttggcaaactgcagtgtctacattatgggatttccctccccagagtcttttctctggggaagttctgaaaaattgtttcagggatactatagttcttaaatataactaacaaacatattatgaaatgctgttagtttttttctggaggctgaatattgattgctacttagtataccttttttaatgattatattgtcccaccaggatatttacacagcttcatgtgtcttcccacaaaatacacatgaattgcaaagggaatatagtaacttggcagtagagaaacttggcagataccaccctaatcaaataatcaaatctaacaccattagtaattggacaaattggcagtgtgcaccatttgatgagatgcacagaggaaaacacagcatcgcttctgtgatattcctgcacaaatgcatgagttagatctaatcatgaggaaatatcaggtaacctcaaattgcgggatgttcaacaaaataacttgtctataatctttagaagtcccaaattagctgggcatgatagctcacacctataatcctagctacttgggaagctgaagcgggaggatcccttgaggccaggagtttgaggccagtctaggcaatatggtgagagcccatctcaaataaataagtaagtaaaagtcatgaaagacaaggaaagactaagaaagtaccccaaattgaaggagactagagacatgagacatgggagcctagattggatcattttattagtaagaacatcattgggaccaagattgaaatttgcatgaggtctatggtttacatgtagaattccatcaatgttaattacaagattttgaggctggactgtggttaggtggaaaaagtccttgtttttcaaaaatgtaccttgaagtattaggaataacgaggcattatgtctgcaaaaagactccaatagttcacaaaaaaattataaacacacacacgcacatacacataccatgtagcattctaatttttagaaccagaaatgagcttttaaaaagtcaccataggctgggtgtggtggttcacgcccgtaatcccagcacattgggaggctgaggcaggtggatcacctgaggtcaagagttcgagaccagcctggccaacatggtgaaaccccgtctctactagaaatacaaaaactagctgggtgtggtggcgtgtgcctgtaatcccagctacttgggaggctgagacaggagaatctcttgaacccaggaggcagatgttgcagtgagccaagattgtgccactgcactccagcctgagcgacagagtgagactccakctcaagaaaaaaaagaaaaagaaaaagaaaaaaaaaagtcactgtaagagatgaattagaagaatgtgtcttgaatgcgggcacaatttatttttgttgtcaattgacaatcttgaaaaaattctggccgaatgtcggtgtgccagctgtttcatgcaccagacctgtagttcacccctactcttttacctgtagttcatccctactcttctaaggcttgaatgraaaataatttctaatttgttgtaaaatttaccaatttggtattgctgctgtaaacaggattttatctagggtttagatgccttatcttcaaattccactatcaagctagtacataaaattgtttgaaaactgaatcagatgtttatgtaattcataaaaacatataatttccctctaatatttcatttttcctaattayaaaaataatgcatgcttattatagaaatgtagacataaaaaactatraaaagaagaaaagaaaactcaatccaaatcttaccactcagaaatgacgtgccactggtaacatttagacttatttcctcctaatatgtatattttaaactgccctcattctctttttttctttctttctttttttttaacctctatagtcgctcctgtaaaagctgcccctatgcttgtaacattattctacaatggacttttggatcctaatgtttttactcactttagcataagcattttcccatgtagcaaaatttcagatattttacctttttattttaaaataattttaaacttagaaaagagttgcaagagtagtacaaagaatttttgttttctcttcactaattgttaacatttctcatatttgacatgttatataatttatatatgtctatattatatacagatgcataatttttaatatttttttctgaaccttctaaaaataagttgcagatatcatgcccctttatattactttatatagtctcaaaagtgttaaaaaaattcaggaaatttgacattgatacaatactattacctaatataaacttggtttttcaaaatttgccagtttttgcaaagtgacctctagcatttttttaccccaacaccaggatccaatcctggatcacactttgtattttgatattgtctctttatcaccctctaatctgataaagctcatcagtcctttttctttgtctttcatgacattgacatttgtaaagaatatttttccttccatgtgaattagtctggtttctacacgtggtccttaatagctataaaatattccaccgaattttacctagataaatgctttatgttggtgatttgatggtttctagtgtttatcttcataaataaggctgcagtgaacatccttgtatttatgttttataaacatccgtggttattttctctctgatagaatcctggaaataaaatactgggtaaactagcataggtatataggctcctgaggatatataggtatatcatatatattctacatatatatatatatatatataggtatatatacctccaaaaggatgcttttcaaaaggatgaaactggcaagaataaaatctcactagttgccaaatgaaacttcatttttgaaacacaggagtataaaataaaaacttacagaatatatcctatgttattatttttcagttatctgtaatattttggtcagatgtgctttattaagtaaaaatatagggtcccaaatcatgcacacatgatgtttagatgcatatggaagaccagctagacaaggccacctccgagttttgtgtgttgagccactttttatgggttacttattcatttgaaattgatcctggcatctgtcaaggtaacattacagtatcactgcttggggctccctttcacttgcctgtatggatagagctttaatgtttatttcgtgggcaattcataacctgtagcacatgaaggaggctgtcacacaatgtataccacccctgtggtaggcccaggaccggcgtttgtctcaaacaattccagtaggccttttattcagtgaagtggatagatttggtggataccactcagtgagtcagagttttggaatcaatgttctccatagctcatagcataagctctggagcctgacaatcctgggtgtgattctcagcttaactacttgctgtgtgacaacaagcaaatcccttaacctctctgagccttggttcctttatctgtaaaaggaagactgtagtcgtactcctctaatagggcgataccctattagatgtggatgaaatacaataacaaataggaagcctttagcatgttacttggcacattgcaagtacacattcagtgatagctttcataattactataatagtacattcatttcgaggttgtacattgacagtgagcaaaacactttaacatcttgtgacgtgggcaagttctcccatttgacagatgagaaaccttagacagaaagcgggttatatgaactaacaaagccatgtgtcaggtaaacggtgaggctgggcattaatctcacgtcagggctctctcttcaggatatccagtgactgttccataactcgttacctggaagtccaatgctgtttgggcaaattttgaataaacccagtggttctcctacagatatatcttgatttagaataggcattagcaaatgttttctgcaaagggccagacagaaaatattgtaggtcttagccgagtgcagtggctcacgcctgtaatcccagcactttgggaggccgaggtggtcggatcacgaggtcaggagttcgagaccagcctgaccaacatggtgaaacgctgtctctactaaaaatacaaaaattagctgggcgtggtggtgtacgcctgtaatcctagctactcaggaggctgagacaggagaatcgcttgaacccaggaggcagaggtttcagtgagccgagatcgcgctactgcactccagcctgggtgacagagtgagactcagtctcaaaaaaaaaaaaaaagaaagaaagaaaatactgtaggccttgcaggccatatggtctctgttataactacatttctcaactttgctgctcaaacttgaaaacagccttagacaatatgtaaatgaataggcgtggctgtgttataataaaactatttactagaaccagcggcgaccagatttggcacatgggctgtctttatcaacccctgatttagacagggtgtattctggcagggggcacatgcatttcattatattagttacatgacaaccttcttttgagttcttagacatagtgaagaacactccagaaccttgagtctggcatgtagtaggtatttggtcactgtttgctgaatacaggaaagcttctctgtctatattttcctatggtgaatttttctgaatttatgtattcttatctatttttaaataactgttttattttagcacttatgaatttttaagttttgtttttgtttcacattgttctgaaaggacattaaaagcagatcgggaaaagagcatttagccccaaatgtaggtttaaacatattttcagatattcttagtgtttgtcgtgtatcagtttgttattttattttcattctcttgcactgagggtaatttccaataaaaactctggagaatttagacagcttttgttttaattaggaagctatttcacttgcactcttgtactactgttgactcaaataattaacagtaatggctgaataatttgttctttaaaagtaaacaacctccctttgtaatctagaaaagaatcagctggtgatacacatggagtgtttgctccaagaacatttctcatggtgtggaaaatggcagtggtggcctcctggctttcaggctgaaatacrtttagctgatctttgtcggcaaaggtgtccaacaatagcaactgcttatgacaactaattttaggaaacgtgtgtagttaatttgaaatatcgccctgggccgttcaaccttggctgaataaggatgttttcttttaaaatcagtactttgcttccctcagtgattattccctattagcctgccaagaaatattatttcccttttgtatgatttgatgaagtacctcaaaaatctcctggttatggtcaacatttcatctgataggaagcgagtgtatctttctggtatacagtgaggcatgaggacacacagcttattttaatcttcaagctcgcctgtaatcctagcactttgggaggccgaggtgggtagatcacctgaggtcaggggattgagaccagcctggccaacgtggcgaaacctccactctactaaaaataaaaaaattagccaagcatggcggtgcatgcctgtaatcccagctactcgggaggctgaggcaggagaatcgcttgaactcaggaggcggatgttgcagtgagccgagatcgtgccactggactccagcctgggcgacagagtgagactccatctccaaaaagaaaaaaaaatcttcaagttgagatgttaggttaatcttcagtctccctgtgttttcccacaaggaatagtgtggaaaagacttggggaaaaaaaaatcatcatgattcagccaatgaccagggcagaggtataaatggagcatgattctatgtatctgtctagaaggcatatatggagcatgattctatgtatctgtctagaaggtatatatggagcatgattctatgtatctgtctttctgtacttgttgcctactgagaaaatacagatttttattagaaggttgctgggcacggtggctcacgcctgtaatctcaccactttgggaggccaaggcgtgcagaaaacctgaggtcaggagttcgagaccagcctggccaagctggtgaaacctcgtctctactgaaaatacaaaaatttgctgggcgtggtggcaggatcctgtaatccaagctacttgggagactgaggcaggagaatcacttgaaccggggaggtggaggttgcagtgagctgagattgcgccattgcacttcagcttgggtgacagagcgagactctgtctcaaaaaaaaaaaaaaaaaaaaaatagaagattaaggatccctatctgaaaaatcaactttgttctttctcttcatcagttttgtcagtgtacattcagcagctactacacgctaggcatagtgccaggcagccctggggatataaacatgtaatctatcaccgctgttaacctactggtgatttgaagactgcatcccaggagaccaatgatagtgatggaaattggtagggaaggttgctttaaggtctttagtatcttctatttgcctaagagaaagagaacttttgggagaagaaaccatacattttatctcttttcatctttatgccttatgttatcaggaaaatatttaataggagttgccaataaggttgataattctagaccatcaaaaccatagaggtgtgatgtcaggtgtaggaagagatgggaaacacgatgtaaaatgtctgcgtggctcacataggaaatctgtgcttagagtgctgtggcagaagtagaaattgctgtcagccaactgattttctgattcttctgtctataaaagctgtgcccattgttaacwtaggtgataagttgaatttttagtttttttaggttttttgtttgtttgtttgtttttgaggtggagtctcactcygttgcccacgctggagtgcagtggtgcgatcttggctcaccacaacctccgcctcccgggttcaagcgattctcctgcctcagcctcccaagtagctgggattacaggcacccgccaccatgaccagctaatattttgtatttttagtagagatgaggtttcatcatgttggcaaggctggtctcaaactcccaacctcaggtgatccacccgccttgggcctcccaaagtgctgggattacagacgtgaggcactgcgcccagccaaatgttaaaagtatttttgagcttctcagaggaaaccaatgaactgaagttcaataatctgtggtttgtgttacaatattttgaatccttccggagactgaatgaaagatacatatttaaagtgaatgcagtaagtaggaagaggcactgcttcagcctggtaacatgcagttattgctttgagggtcttgcagaaagaatatgcacattgagtaagtaggagaaggtgtgtattttggaaaaatcaatcaacttagttcaacttgaaggttttcctatctgaaaagggatgtatcaaaagatattttttcttaggaggaaaaaatccacaactcgcaccagagcatttcattgagaattactgttatttacgttttggaatttacattgttaaaaagagagattttggaaaggcaggggtgggactagaattgtggcttgcatgttgcctataaacatagattcctttttttagatgtctgtgtttcttagtggattatgttcttaaaatagaacataccacattactctctggtttggcagggtgtggtgttttgtttactgcttgggtcaatgttctatgaacatgaatcttttcacagagaatcccagggctaaaagaattcttagaggtgagccagtcgaggccccagcacccgcttcccaaaggctcttcctgccagccaccaggcctcatgctccagtggcagtccagcccaagcgacaggaaactctcccttcttttaactggaatctcacatccagtggcttctctgcttgtgctgggtccctgctggggcttcccagaattctgtgcaactcctctttcctgtgagagccctcacgatgttagagatttggggtggggttctcatgctcactccaaagcccctacctctccaaaccttcctcaccatgctaaatagccccagttcccccatatgtgttcttatttgatagttaaagccctttgccactgatttcaaccttttaatgtgtgcagtcaagagagaaacctgtgttctggtctagaacatcacctatctggttctttggttcatacttttctgaatatatcccaaggtagtgcaagcagtggctttttgttttgttttgtttttttgagacagagtctcgctcttgttgcccaggctggagtgcagtggtgtgatcttggctcactgcaacctctgcctcctggatttaagcagattacagtagtgtgccaccacacccgactaattttgtatttttagtagacacagggtttcaccatgttggccaggctggtctcaaactcctgacctcaggtgatccacccacctcagcctcccaaagtgctgggatttacaggcttgagccactgcacccagccaagcagtggcgtcttaacataagagggtcaggctctaaaacaccgtaggaagtgaaatctgatatggtataaaaatcacccttgagatcacctataaaataaagtatataaaaacaaccagtagttttgtgtcagaaccctttgtaataattcttacgtacaataaagtttagaactgctgatctggcctaaagagtagaaataaggggaaaaatctcatctacaaaagacttctgcataaagatagtggattgaacacaggcatctacttgcgcccaccaccaaacaaaacatcatttaaatgatacaaagagaatttttggttttggttttgtggtaaaatgtatgcaacataaaactttaccattttaaccatgttaaggtatacagttcagtagtgttaagtactgaacatattgtgcaactgttgccaacatttttgtccagaactttttcattttcccaaactgaaactctgtacccattaaacaatgactctgtagggctgggcgtggtgactcacgcctgtaatcccagcacgttgggaggctgaggtgggcggatcacctgaggtcgggagttcgagatcaccctgaccaacatggagaaaccccrtctctactaaaaatacaaaattagccaggtgtggtggcgcgtgcctgtaatcccagctacttgggaggctgaggcaggagaatcacttgaacctgggaggcggaggttgtggtgagtcaagatcacgccattgcactccagcctgggcaacaagagtgaaacttggtctcaaaaaaagcaaaaaaacaaaaaacaaaaacaatgactttatattcctcacttcccccagcccctagcagccacccttctactttctgtctctacggtttggctactctaggtaccttgtatcagtggaatcatatagtatttgtccttctgtactaacttatttcacttaggggagttttttttaaaaaggcrtaagtctataaacacaagcataacagaaaacgaggcaacaacagcgtggtttttggcattaggatacaggggtgtgtgtggctaaaataaggaggcctagtctgttttaataatgttgaaacatttctgagcctttgcacttctttagatgaatcagttggttctcagccttccccattgacagcctaggatactgttttgtttttgtttttaagtctgcaaagttttttgttttttggtttggtttgttttttttcctacttatctgtctgctttctatcttgccaagttttgttgaaaaattccattggtagcaaagagaagatcctacctataagcttccagggggataaaatagatcacatacaaagagtcaagaataaaaatgggcttgacttcttaacaccaacactggcagctagaagacaatgggaacaaggcctttgatagcatggaagagcatgattttaaaactagaattgtatattccatcacactcttgtgagggtagaataatgcatttcacacataacaagttttcagaaagtaactggagaagatggtccactgagatgagggagtaaaccaggaaagaaaactaccagcggtagagcaaatgggatatccaacctgagagaggcagaggaaatttctagatgcctagggcgggaactcccagctgaccgctgtgctcctgaagcatgccagaggctcaggaagtgacttcctttgtaaggtggagttgatagaatatgtgaggcatcttggtgtcatgagaagagatttagagatatgatggaaaagtttaggcttgaattagcaagagctatataaaacactaagcaaaggtggggaaatactgttactaatgctgaaaacagtaagatgttcaggaaaggaaaactgaccatcattcaccatgtggcttagctgaaagtaatgttatgttattataatactgatcttcaaaagtttccatataattatattgggaagagtaccctcatatggtgagggcatagataggaaaaaccattaaattatcattctccatattgagaagttaataaataatgccaacaatggaaaaatcacaaagaagcaatgtaaattgttaccaaaaattacctaaaagaggttaaagtaccaaggatatccttggtaactatgggggggttggttccaggagcttcctcagatacccaaatctacagatggtccttaatatagaatggtgtagtatttgtgtataacctctgaagatctctagattacttatgatagctaatgccatgtaaatgctgtgtaaatagtttttatactgtattatttagggaatcatgataaaaaaaagtctgtgggtgttcactacacgtgctaccatactttgtttgtttgtttgtttttctttttttttttgagacggagtctcgctctgttgcccaggctggagtacagtggcacgatctcggctcactgcaacctccacctcccgggttcaagcgattctcctgcctcaacctcccgagtagctgggactacaggcatgtgccaccacgcccagctgatttttttttttgtatttttagtagagatgggatttcactgtgttagtcaggatggtcttgatctcctgaccttatgatctgcctgcctcggcctctcaaagtgctgggattacaggcgtgagccaccgcgcccggcctagatgcaaccatactttaaaaaatatattttccatcgtggttggttgagtctacagtgtgtaaccacagacgcagagggccaattgtacttactcttkggaggaaaaatcggagggaagcaggccgaagtggtgacccgtaggaattgttgttttctgtactattaggcgctttaaactatgtaactgtatgtctttaataaaaaatagtaattaaagttaaagagaatgtgtacaaaggaaagggaaaggtactggaggatatggtccagcaaggtgaaggggtaagttgaaaaagtataagaggtgggatacaggaaaccagggatatagaaactcaagaaaatataaagtctagcagtcaactaagcaagactggagcaggaagacccatggctgtgggacacaatggaacaggtggatttcttgatgtatggatgtagaaaatactactgtgatgtttcaccgatctggaactttgggccgagttagcaatatgtaagtagaaaactaagtaattgaggaatatagttaacttcagaggaaaaaacctcagaaaattagacaagaaaacatartatactctgtaagtcttcagtgcacaaaatttatatgaacctaataataaacactgaataataaatttgtgaagtaaataaaaatattgggaggacaagttgarggggatgccaatggataatgcctaaaactgataaatagaaagcaagatagcctaaacatcatatttagaaaagtgtggcaagtaccaaaaagaaataactacagcccatgcgaagtggctcacacctgtaatcctagcactttgggaggccgaggcgggcggatcacctgaggtcaggagtttgaggccagactggccaaaatgttgaaaccccatctctactaaaaatacaaaaattacctgggcatggtggtgtgtgcctgtaatcctggctactcgggrggttgaggcaggagaatcgcttgaacccgggaggcagtggttgcagtgagctgagattgcactactgcactccacctgggcaataagagtgagactccatctcaaaaaaaaaaaaaaaaagaaataactacaaagagttgcaagtggtataagactgagaagtgggagggtgtggggcacttgtttgacaatttaactcttaaactctgtttgatttttaaaaactatgtgcttgctatttgcattttaatctaatgaaggtaaaaatggattaaaatataaaaaagaaaagccatctatatgcagatgtctgggcagtataaaaggtctgagagatgtgcttaatactatgattattaaagaagttaatgtctrtgagagcacccagcacatagtaggcactaaataaatgtttgctggatttgaatctaaagcatgcttgatcagacctacatagaggcaattccttgaaaagctgcagagaatgacttgtaccatttgctgactttccaagatggcatttcttgctggggctccactgattattactgttgtacctgtgggcattgggctcatgaccccataggtgcgtgtgtgtacatgcacatgcattaagttgcaaagtcagtctaaatgacttgactatcaacctgtctttggcagccatatcacttttggcccagttggcaccatcaggtttctggacacagaggcagtattttccatccctgtcctacagagtgtatttgtctcaagtgttatgtacttttccagtttctttgcccccagtaaatctctagggtcatgaagatcattacaaaacagatagtcatttcatctctcttcttaaagcctctcacccattgccctaggaagaagaccccaaatccttggcattcaaagcctaggtggtcaatgatttgaccccctacccattgctctggctttatttcttgccactccagacttcactgtttacactcaagtaaaaccaaagtaattgcaattctctgtaaacactacgccattccatacctcaggtgactttgctcttgctatccttcctgcctggactaactatctcacatctccctgtcacacccaactcccaattctctccaccatgctggtccttctctctaacatggctaactctaccccacttyaagactcagctttatcagcccttgctatgagaagcctttgttgatcaccccaggaggakaaaggtgtccccttttgtgctctccatcaagagcatcacagaactaatgcatcatcttaatactattaatgtgtctgatgtgtcggagaggccccaaaggtttgaggaccatgtttgtcttgatcactgcacagtacctgacgcagctcattcccagtagggctgggactaatcttgcaggtcttcacagttgcaatcatttgttcagaggtggctcttccccagtctattacagaagcctcatgtctattcttggagagtcccaagaccatggcctctaaggttccagccttatcgtggtttggaggctccttcagttccttgtcatttgaatgcagaactggatgctgtgaatgagttctagaacatggttccatggggcagagttctgactttaaaaaagccatttactaaccaagctgcatggatttctcttttcccatttcatcaaggaagcaccccggctaggtgagctggttcatttcattcattgactcaacaaatatttactaagtgtctgccataggccagttactgttctaggcatgtaggagacagtagtgaggaagatrgatgaggtttctgtcctcagggacctgagatcgtagaggagggaagcaaacacagagccatttggagtggtaataagtgctgagaagggaagaaagggaatgtgggatgagggggctgcttagatgtgctgatcaagggaggaggtctctgagacaacagcatttgtattgtatggttctgaattgcaaaaaagagctgttcaaattgttatcagtggagggtgtccaggttcttggcatcttgaacaaagaattggacaaaatgcacaaacaaaggaaggaaagaatgaagcaacaaaagcagagatttattgaaaatgaaagcacacaccacaaggtgtgccttcacaagcagcaagcagctcaagggactggttacagaattgtctggggtttaaataccctttagagatttcccattggttacttggtgtatgccctatgtaatgaagtagtggctcatkattagtctgattggttgcaggaggggaccaatcagaggctgaagttacaaagctacaccctatgcaaacatctgattgtggaaagcaaccaatcagaggctgcagtgaagttacaaagttatacttctatgcaaatgaagatttggcccamrgccwamctgattggttgtgggaagggagcaatcagacataatttcaatttttcatctgccacacaagaaaagggtgggggatttgcaaagggagtagttctggtccttttgttactttggtgtggaaagttgaggttttccttttgattcagttctaggtagtcagcgtgaattggctttaggttccctgcctctagaccctattctcctgcctcaaaataaagagctatatagctgcactctccagccactggccacaagtagctattaaagtttgcatttacgtgtttttttttttttttttttttttttttttttctgagacagagtgtcactctgtcgcccaggctggagtgcagtgatgcgatctcagttcactgcaacctccgcctcccgggttcaagaaattctcctgtctcagcctcccaagtagctgggaatacagcttcaagccaccacgcccagctaatttttgtatttttagtagagctagggtttcaccttattgatcaggctggtctggaactcctgacctcaggtgatccacctgcgttggcctcccaaagtgctggcatttcaggcatgagccaccgcgccggcctacagtttgcatttaagttaactaaatacaatttaaaaaatcagatcctcagtcacactggccacatttcaagtagtcagtaaccagcctatggctaggagcaccataatgggcagtgcagagcaatggggagaaagggcactggggaggcggatgggagaagcagtaagaaagggaaactagatcacttgttggagagcacatgtatgcatttcaaagaactgcctcctttaatttcacttgttgaaaatggggctgaagccaagactagttatgtctgatagaatgttttaaagtggaattaaaatgatctctagagataatataaagcaggtaaaaaccagccatgaaaagatctttattaaggaatatggcatggctacagcaagtcctgagatggagataagtactagttgattccaggggccagtggatgaggtcacagttaccccttggccttagaaggaggaagccagacatcctaactctgacaccaggagcatactttacctaaaatcttaaagacaggacaatgtttaaaaaaatcccttcttaacacaattcttaacaaaaataggattttgacttttgtgtcttaggaggctagaattgtattctcatgccattaccaggaacggctgtgccttgacttcattttgtatcgtgtttcacaagatgctcatccctttttgcacctgcctctttgctaaacaggttttcttcctctctgtaaaggtgcctttgtttgaaccaatagtgttacttctctttactgtaaacagtgtccagtgactcttccttatcgtggagagccagcagccttttacaggaggagaaaagtcttgaaggtcactttctgatgtttacattataagtcatcatgactttaaaagatgaaaactaaaacaacaacaacaaaaaaccacaactgcctactgcttacccagggcatgttatcctattacatttgaattcaagtaacagctagtatttgtcaaatcataattgatctgataaaatgtaatctgatcattagtagctgtgtaaacgtaaatacactcgactcctgtttcatttgcccttgaaggctgtaacatggttccaaagtgtacctttgaaccggagaagtcgggccggttcacattgcagcctgtgtgcttcctggggcagcgtccaccaggtgtgtgcgggcaggtacaggatgcgagctcagtcctgcttcccctgaaatyctgtgacctggcagagggctgtgttcctgtgtccttacatcggatgtcctactgaagaaagggaaactgggacgaagctgtaggcacagtgggttctgaagatcagatataactgagggaaagttaggtcatgattgccacctggatgctgttctctctcttcacggtaggtctcagttacttttaytgtggacttttgcttgctgcagagggaacttacacctttcatgcctcaagctcattaaggcacatttctcttttattcttcagggacattgcatttatgaactcaaggcattgagtcacccagagagaaaaagcatatcccaaacatttcagtttctgggagttctaaaaagctaatgttgtgttcccatggccaacatttctttaagagaggtaaagcagaataactctaggtctataaaaatgctgatctgcttcaagttctaaatttattgtgaattatttatttttccctagtaattactgtaataccttagtaccttcaacttatatagcatttttcaaggaggcaaagcatcagtagaaatgttctctgggatttttttacctgatgttttaatgctgtgatgatttctcagccccttagtaataatgttagatgcactgtggaaaaactaggcacgtagctgttaagctgggaatgtatgaacggtatacatgctatgctttaaaatctagctcaatttttttttttttgcattgaccttgaacatgctgacaacataggtcggcatgggtaaagctaaagaatggccttagggtttgaaaacaactacatgagctctgtttcagacctgctgctagtcgggcacttggcactttgcagggatttggggcaggttttatgtttgtgtgcttctcttagaagtcaaagagttggtgaggtaactgcaatcctgtctatatcagtgtagtgataatgcagtagtgtaatgaagaatggagctgcacgtrtgaggtttttcaagtccacaaagatcaggtattgtctacggtcaataaagatttttttaaaaaaccctcttaactaaagagaggtaacttccttttcaaaactctgaaatttacatgtgctgacttataatgtgtgtgatcctcgttgcttttctgatccttggtggttggggtgtgtgtgtgtgtgtgtctgtgtgatgggctttttaatctttgagatttattctttttttttttttttttttttgagacagagtcttgctctgtcgcccaggctggggtgcagtagcacgatctccgctcactgcaatctccacctcccgggttcatgccattctcctgcctcagcctcccgagtagctgggactataggcgcctgcctccacacccggctaattttttgtatttttagtaragatggggtttcaccgtgttagccaggatggtcttgatctcctgacctcatgatctgcccgccttggcctcccaaagtgccgggattacaggtgtgagccaccgcgcccagccaagatttatttattttttacttacacatagtgaaattcattctttttgctgtacatctctatgagtttagataaatgcttacagttgaggaaacatcaccacaatcaagataaagaacagttccatgatcccctaaatatattttgcttcaaatttctattggcatgtttgagtatcaagtttactaccacttctgaagatggagccaagcccttttgtaacaaatagcacagctgtgtctgacacttttcatgtgaaaggttgcctgagatgtcagaagtaagatctggccagttgcagtggctcatacctgtaatctcagcactttgtgaagccgaggcgggaggaccacctgaggtcaggagttcaagatcagcctggccaacatagtgaaactccgtatctactaaaaatacaaaaattagccaggtgtggtggtgcattcctgtagtcccagctacttgggaggctgaggcaggagaattacatgaacccgggaggtggaggctgtagtgagctgagattgtgccaccgcattccagtctgagtgacagagtgagactccgcctcaaaaaaaaagaagtaagatctgattgacttatccttttctcaaagttataaatgggaaaattgtacaatctgaatattgtttccttgtattttaattaatgaatgtagaactgtgtaatgtattatatgcttttttaaacccaaagaaatttgtaataaatactttagttagtaaaaagaatatactgaaagtgaaaaaagtcaattttttgcactttagatttttttttaagtgagcttagttctgtgtggttttaagggcagtgaaatgctgtagaaggactgtaatctgcataactcaaactggcttaataagtggaatttattggctaatatcactgaaaggtaaaggtacagggatagacttgaggcattgtgggatctagaaattcaaacgatgttatccgcctctctttccccactcagctgtgtttccctctgtgttggttctattctctagtagactcttgcttgctgtatcaaggtgactgacagcagcttccggcttttattctactttctcaattccgtacagttccaacaagtctcagaatggggtcwcatgggctctgattgcttctcctgctccttatgacccccagggatggggtgggggtgagcggcagtgctctgattggtcagacttaggtcacctgctcactcctagagctgaaggagtgagagctccccctagaccacggtgcagaatgaaggtagagagtggcagaagaggtggttctttaagggaaattgagggacatgtatgtcagatcaagaaaacacatgtcctctgcagggacgttcaggccatgtasccagttgttgtctttgtttttaaataatttttataaacacctaccctaggctaaccttccaaataagcaaaagtttcagaattgatagttgattgattgattgttttatggcttatgagatgacaactgtttactggatgtgagatgtaatattttgggaggaaaatagtggaaattgagtgactgcgggactcggctaagatgggtagatggggcaygaggagaactggtcctgtgtctgtcaagggatcaatgagtaaggaaaaatgggcttcaaggacaaaaagccaggagaaaagaaaaagaagataccagagattggcaattgaccaaaaatttagcaagattaccattgctgaaatagcagaaatattgtcttggatagaaatgctatcagggacatttaatgagaatttatgaagattcaaggctggcatagctactctaatcatgtgaagagtgattgcatctagaataaagcccagattcccaaacctgacatttgtgatctggggcccatctccctctccaggctcatctcccctgctgctgccttgcaccttacaacgagctgtttgtagtctggaaggcatcacactaccctgtttccttcactattcatgctctctcctctgcctggaatccctctcccgttgaccagactcatcttttaagactcagttcagatgacagtttctctgagaagcattctttgattatgcctctctggcttaagaattcctcttctatactctcgtgataccttgtgcgtctttcccagtggtctcaactgagggctgttttgtctccaaggggacatttggcaatgttgggatacatttttgattgtcatgacaggtgagcgctactagttggtggaagccagggatgctgcttaatatccttcatacagcacacaggacagccccaacaaagaggcacctggccccaaatgtcaatagcaccgctgttgagaaccctgcttaccattgcactggcaacattgttggatacatctgtttttagtcttatcttcaccactaggctgaggcccatgtgtgtgatctgcatctttgtatgtctaataccacaatgcaccactgtagggtagttcctcaggagagaatagtttaaagatgattgtatacattttcttaggatagtgaccaatgaacaaggcaactggaggccgtactcgtctttgcgctaggtagccttaaacttgaggctctctgtattagttagttctcacattgctatgaagaaatacctgaaactgggtaatttataaagacaagaggtttaactggctcatgattccacaggctgtataggaggcatggttctggtatccgctcagcttctggggaggtctcaggaaacttacaaacatgatggaaggcaaagggggagtgagcacttcatatagccagggcaggaagaaagggagtggggaggtgctacatacttttaaacaacaagatcttgtgagaactctattatcggaatagcaccacggggcgggggggcgggtaatctgcccccatgatccaatcacttctcaccaggccccacctccaacattggggattacaattcgacatgagatttgggtggagacacagatccaaaccatatcactcctttatcttgccatgcctttgtcttctcactcttctgcaaaaagagctttggggtttactgtagcaaataatggaaaacattaaagaagtattgttagcatagttcttttgctttcaatttttacctaagttattgtccaattttacattctgaatggtgaactgggtggcctggccacactatttggctgcctctggcaaaaacttctgccctcacttctgaccattacattttccccctaccgtatgtgtagtactctggattggtaacgtttgatgggaaagaaaacaaaatcagaaagcaacgattctgagagcaggaataaggaatgttaagtcccctttttgacggctgggctttttttcttatgccaagtttaagtgcaaagcagcagttcccttgtgccctgggacttttgcctaggaayaagggactgccagaaaacctcagaaaatccccatggagatgtctctgaaaaccatgtaaacagggacattgtctaagtgggtcatcctgaatatatgatgcaggatggaaacctatttagttattgaatatttcagattaagaggacaccgcagccttgctttgcacaatcttgctagctttgtgagtttcactggggattggaggggaggcccgccttcaacttgagctgcttgtgttttggtkggtggtaatgccttagaaacagaaaggagccagctccccttcagccactcaggcttctgcctgggtttccttttaaccctggaatttcatgtggaccctcagctatgaaaacagatcacatatggcctgctgtcaagcataagaattgcctttttgttcttggggaattgcacaaagcaagtaggagacggggaagaagaccgttctaagcaggaaaatatattgcattaattcttcccttccattgcctcctccccatcttgtgctatattctggtactaggacttttgcttttttctaggctgaatcacatttggccatagcagaggaaaagtgatagctgttaggggtcttggaaggagtattgagttcctagagtgggaccatcttggccaggccgcttcttgtcctcttttggggctgggactggtatgatgttgaagtagcccatctctaagtcttcccctcctccctgccagcttaattgtgcmacattgttcaatcaagtcactgaatcatcagccctgtgatatctacaagcgcatgcatgtgtctgagtgaagtgagctgggcagttccatgatacccttttctrtgtatggagggtgaggtgtttctccttggtttaccctgaccaatttattattactgttccaaaaaggaaactgcatgattaatrtcagaatcaggtccaaaggcctctggctctggtgatggctaatgtgatttggatctagattctgtttaataacctgccaaaggcacctagctctttctctttttttgctgttttttgtttgttttgatttttgtctttataagacagggtcttgctctgttgcccaggttggagtacagtagcaggttcatatgtcactgtagcttcaacctcctgggctcaagcgatccttccatctcagcctcccaagtagctgggactacaggaatgcaccattatgcctgaatttatttatttatttatttattaagatgggggtcttcccatgtttcccaggctggtcttaaactcctaggctcaagtgatcttcccacctcagcctcccaaaatgttgggatgacaggcatgagccatcacgcctggccttggctctttcttctgtccccttggtggggacgttggggtgacccatatgtggtacatggcaggtaatgttcttttcatactagccagtcttctgttgtgattccactgtgtgtaagatgtgtccaaaatgaggagatgcatccccgcacctagaggtgtacagtctagtggtctttctgctcttcctgcttttttctgggaaagagactttttgtggggggttgggcgggggtgagtccaggacagcaagttcatcataaatgcaaatgggaaggctattgatatttttattcatagcatgaatgatgtaataaatgagtcacgatgtcagcctcttttaacagaatcacagaattttctttttatttatttatttatttatttatttatttattattttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaccagcatgctgccttcaagcgtctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacatggcaaccatccgatttctcaatcttttccccacctttcccccctttctattccacaaaactgccattgtcatcatggcccgttctcaatgagctgttgggtacacctcccagacggggtggtggccgggcagagacgctcctcacatcccggacggggcgacagggcagaggcgctccccacatcttaggcgatgggtggccgggcagagacgctcctcacttcctagatgggatggcagccgggaagaggcgctcctcacttcctagatgggatggcggctgggcagagatgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggctgctgggaggtggatgttgtagcgagctgagatcatgccactgcactccagcctgggcaccattgagcactgagtgaaggagactccgtctgcaatcccggcacctcgggaggccaaggctggcggatcactcgtggtaaggagctggagaccagcccggccaacacagcgaaaccccgtctccacccaaaaaatacgaaaaccagtcaggcgtggcggcgcgtgcctgcaatcgcaggcactcggcaggctgaggcaggagaatcaggcagggaggttgcagtgagccgagatggcagcagtacagtccagcttcggctcggcatcagagggagacmgtggaaagaggggagaggggagaggggagagggaatcacagaattttcaaactggtttagcatgctggctctgcagccagactgcctgagctcraatgtcagttgacttttctgtaaaatgggataataatagtaccagtttcatagatttgcaggagatgtgagattacatgaattcacttataaaaagtgcrtgatacttaaagccatgttacctttaaacttccaatccattcattcatttattcaacaaaaactacatactgtgatggttgcacaagcctgtgaaaatactgaaaactaatgtattgtatactttaaaagggtgaattcaatggtatgtaaattaagtatatctcaatgaagctgttttaaaaaaattaattgattacctattatgtgctggacacagctcttttaaactgaggcctagagcaggtgacttgctcaaggtgagtgaatggcagagatagttctagaactcaagtcctctgacacatcagccaagctctttgcaaactgtcagggatccaaatgaagatcgcaatccagattggaaactaaagtcactttctgtcctggtatagaaccaaagtttaacttaagaaagaatcgtgacgtgacctaaggaccttggcattctacttcaccacctctctctgcaggtattctcatttccacgcacctccacattttcgaagacttcagacaaatatatcacaaataacctatataaattcactatatgaaaagcaggccaacatttccaccccatccttcctctttcccccagctctggatataaaacacatatttttcagttagattttttcagttaagtgattactttcaattcccctgtttttggcatttaaaaatgttcacttcttattgcaagacagggacagtctttaaagatttttctgctcaccaccactaccaaaaactaataacaaattttgtcytcatggggaagaaaatcttactcattcttgagatttcacagccatgtctaaagatctaggctatataagaagagaggaatgccttagaaatgtaatgctgtttttcctacggaatcaatttctgtagaaatagaaaccatggtgcatccagagttaccctgcagccttctgctcctggcagcttgctgtgtgttctctgccacatgctttcttctgggatttcttccttctactgacatctggtacttaggataagggaaaaggctttccctgaaccagtgaaattgctatcaggaaaaaatgactcaagtttccaggcagcyatgaatgaggtgtttttctgggcggtctgagcaactatctttyggaaggatacataagaaggtacaagctgccagcccatccatttccctaagatgaacttgaagcacgttttctttcagcagcccagacagcacaggcttttcctagcagatgggtggcattacctcactgacatttaatgaataggttgcccccagggggtggaattgtagcaaagtctattatgaaatctcatttgctttgcatgaatcagtttaggagtcccgagaaaacaaaatttgaaaaatgaaaagtggccacatagcttgccctgtaactgcttggacatggcaggtaataatcatagtcagtttgcgcttttatgatggagagggctttcaattgatttgtatttcttgtgagtaggaacaaagccagttgtaagtaccttttagctttgttccctcctttctcattttctaggactgtagcatctggggcatataattgagctctgagagccgagagctggagggggagggggtggtcagaggaaaattattcaattcacacatataacatgcatatatatatgtgtgtgtgtgtcttaaacatatatgcatatgtatgtgtgtctatatatatatatatatatatatatatatatatatatagaaacataaatattttatcaagttgagaatgggagaatagatttctttcagcaaacaacctcaagcctattatacatctgatttatgaagggtaagaaattcaaccttaacccaagcaaaggtttaaaaaggcagcatgggtattattgggcttaggaaaaggtgaaggctgccttgctgccgtcctggaagattgagacagtggtaacaacacgtgcagcaaccccctgcacttctagaaggaagctgatatctgtctacatgtttcagcgtttgtctctgaacctagtcttttcttggtcacataggggaagcaacagaggtggcttatcatagcaatgcaaaagcctttaatgaaaaatgggctcaggttttggttcctataagatggtgattcccttcccccacaaaggcctttgtgtacatggggtgaggtaggggtctgagaaaggccactggaaatggaaggcttaacggccagtcctctgctatgtcccagatggaaagctccttgtatctaagaaaggcaggaaaccatgtcacctggcttctgatatgtaacaaccccaaattattctccgaccccttgaaggccagctgggctcttttgcatcagggggattgtgtttagaatttgtgtcaactgtctttgtagagatccttctggataactactacaattcctgggatattcttacagtgggcacatgacaaagacatgtgacattggcccaaacccccctcaacttggaaaaggggtggattcccccagctgacttgaagattctggtctgtggattcagcaagagtctgaggcctctgctgagtgagccaagggtggcttccggggaggtgagtgcctggaggagaatgttcccagagccaagatgggatgcctcctggtatcaaagtgatgttcagattttttctggaaatctagaataggataaatgtgaatagagattagagtgaacatcttctaggatttgaagcccttgagagcttctaggatttgaagctcttggtcttgagaccaagcctctgcaatgcatctggggtccgttgcacaagtgtgtgtctttttaccaggtcttatccccgcttcagccttttctctcctgttagggatcaaaacttgccaaaacagaaattttaaaaagacacgcaggatgtggggctgctcctgggaggtttgctgtgtktgtttggggtcctgcaccctccactccactcctgagtgtccaagggtggatgtccagaaatttagccacctactcccatcagtgtagccagaacctttgctgggagttaatctctctccctcattactttctgatctgcttgaaagacaaatagaggttagggaaatatattaatatcagtaagtctccatggatggcccaggtcaaggcagacaaaggtagtcacacgctttcaggggctgaaagacaagtagaggttagggaaatgtatcagcgcatctccatggataacccaggccaaggcagacaaagaaagccacgtgctttcaggtgcaaacagcggccgccttttttcactggacatcattgggcagctgttgctgtcatttcccacggcctctctggaggggaaacacagctggcttctgtgggccagcctgaaaccatctgcagctgcttgcatgctttcaaatgtaagtaagggaatttcagctgaggttaatctgggaaatcctctgtatgaaacattttccttttcactgttccctttccttttggatataacatatgacccacttacgaggcagcctgttggatcactggtccccaaggagctgtggatgtcttcccagattactcctgccaccaccaatgcgtctaccaccatgagagctgctgctgatgggcactgcactgtgcatgttgcatatgtgatctcatttagcactgtgacactccaaggaccacactcttgtctcattttcggataaggaagctgaggctccaagaggtccagcagcttgtcttaacagtgaacaggtgcaaaaccaagatttgaaaccagtttttgatcttggtttgatcttgatgccacatcccagcctctttctacctctgtaggacggytttgtgtctcctctgcattttcagcctccattgctaatctgacaccatctaaagcaggaatatccttattaatggaatagtgcttaatgggattaggcttacttctgtattctagacaatatttactgagctgttagatgtaatgtgttcagaaataatacagggatttatgaatatgtattaaatattagagtataaactttatcaagcagagaatatatttgtcctccagtgttgttgaccttgtatgttttttgtttgtgttacctccagagctggattttgaaagattaagccaagaaaaaaagatgagacattcaaaagtaaataaattagtttaggcctggcttttctggggccatggagttgttatcccaaagtccttgcttggacctctcctcctctccactcctcccctcccctcccctccccattgggcactgccagggcccagtacaagtgaaacagatgctyaactcctagacttgtggaggcttaggtagaccagcaagtcactattaggacagaaaaacaagaccacgtcattccccagcccaatcccttatgctttctttcaatgacacttaaaatttaagacccaaacctacatgatctggccccatctgccttttcagacwcttcttcctcctcgagccccttaccccatcctagccaccgaagccagtgatgccacatcccagcctctttctgcctctgcaggacagttttgtgtgtgctctgcattttcagcttcaattgctaattgtcctctcttgtcctcacttctttcactcccatctcagggtttctgcatgctggttctcctgcctggaacagccttctacccaccctttgtgacttagttcacttcccagatttcagagggcagctcagctttcccttcctcatggaaacctcccctgacctccctgagtagcccaaactctcctattgtaggcactctcagagcgcttctcatagatgcaattttacgtttgttygtaattctgttttgttttttcacaacaataaattttgagagggcagctctatgcctagtctccaccctgtgtccccgatgcccagcacagtgcctgaagcacagtaggtattcagttgccttggtgaatgaatgaataaagccaagccaagcacagtactcagatctcaagctcatagtcactgcatagcttgtgctaaccttgcagcaagtgagacactaagcaagtgaacagcttacatttcttagtggtggtgttaaatttacaaggagagcatgtcacctctcacttcaagtttccacacttttaggccattcttagtgttaatagcctgtggaggactctttgaggagagaagaggggaattccaaagattcagcttgataaatccttcatctttgacctcatgtgtattctacttaggaattaaaacgtagagtatggctgctgctacaaatcttctttgcagtttttcctctggctgatttttctactttacctggaatttttatcctgaatttttgtccttttttgaatccatgtggcacacatacattgccctaccaggtttatttgtgtttgagatttgagatgctatctgaggccaagacctccagaattagatgggcctttgttcccagagcctctttgaacagagagaaattctttgctatgttggcaaaagatccttcatatctatctgtctttctttcttgttcagacttctcttttggccacgtgaacgtggatccacctgccccgtcttctggcctatgctgtgatccctggaacatttcaggtttgagtgtcagccacatcttctttaggaccagtcaagggtttgcctccaggaacagtggaatctattgagtgccccccagggagttccccatatgctggtttgtttgtcacttggccacacagttctactttttcctctttgtctgcaactgaacagcctaggaaacttacaagatttctgctttttttkgggggggcgggggggtaaggtatcgtattttgagttcaatctggtcgcaaactggattctgtccagatttttgttgggatttcagatgtttagccccaaacaaattgaaagttaaattgaaactggtccagatgaggtcatgcttaagatttctcccacagcacaaatcgtaccttactggaagctactgtaagggcagttcttgaatctctgcattcccaatacatactcatggtaaaaacagttaacagttaattcgcttgtgttccagtgacttgaaaaataagcattagcaccctggagacctcgtcttatcaagttctgaaggatggtttttatagctagtataaacccttagtttatcagcttcactggcctagaaacccctcagacctgaatatttgggatcagcagaatgggccaagcttaggaattccaagaaggcagactcaagatagagggctgccaaagctcacagatgtggaatgaaaccagtttcaaaacctgattcttcrctcagttggaatgtgttttaaaacctggactcacttgagatgtttgcacctggtaagaatgtttcaaaccttgaattctactttgtgtaattatctgtgaaacgtaatgatgatagctccaagctatctcataaagctgctgaagtcttcaaagcattcattctatcttcctggagttacagaaacacaaaatggtaacaggtgtgtcatatgcatccagagactacctcgaacttttctctctagaactcaagctccagacttgagatattagttaatagattgataaattgactcaggttaagtggtattatttcttagattatatagtgtcatcctacagagtaaccccattttacaggagaaacaaagttggccagaggacgaggctagaacccctttctagactgttaattcaggcagagctctgtatatgttttaatggttagttttctaaagagttttacctagaggccaaataaatcagaagctcaaacgcatatgttctctgtcttctttttagactggcttgcaagaaagcccttgggttactttttgccagaaaagagcatgcagagtgaacttgtgacataatacattccttgaagctcccacgttatagtttcctggtaacatagagttgtttatatkattgctacttaaaacttggttgctttgtagatcctacttgggaattgaattaacttcagtgaacttgatagaagctgcatctttctgtaaagttttgggcaggttttgtcactgacattaggtggtgatgattttaaaggactcccattacttatccaacatgtgcacgcatactgtatatatgtcattagaaataattaggagttaattttcaataaggtccatttggtggctacaaattaatccatttaaaacccctgatatttgaccctattaattatatcctgctgttcattggtgcttaacccacagagctaatgagatgcctaagtaccactatttttcattgctctttactgtagggaagtaggtctctctttttctttttaatgtgagtggacataaaatttatcagcaggcatatccacagaaaactgactttattacaagtatccttttagacttgcaagctccctcagctagttaattttgcgtttaagtctatgtgattttcattctaatgtcttttggaattaaatgtaatgttgtaagaaaagaagcgtcygaccaataaagcaaggcagtctaggctgttttwtatatatatacgcactttatcctgtctaatgtagtgctcctattttctttttcatattctttctgttagagccaaattcactactctgactttgcrtaatataaatacagatatccttactcattaagaggctgtgttgttttagaaattagtaagtggctacatctgcataattttgcattggtgagagttggcttctttagcgaacatgattttgtatttttggagaggaaaaccttgggcccatcaggttagccttttctgagatggagactcaagtgggaccacccaggatggtcacagcttcaactcccacacaatgagaacttgtgactatagcctgggagagctgactatgcaggagacaagaaatcagagagttgggtccagaggtagctggcagaaagaagattctattaatattttaacctcagaagagcagcgtctaaatatgtgaaatgagtgctggcctagaggggaagggccatactcttaaccacctcaagctggtcttatcattgttgctgggggggatgtgtaaggctacaaccttcccttttaggtagagggaagagaggactcccttgtgggtgtgcacaaaggagtatgatgagaagagggtggtgatgggtgcttagcttgatgcttacattgtcccagtgcagctccatgattgcaggtaccttgagaggacccatgtgcagtaaggtgggaggttaggaaaagcagagaatgccagccagccatgagtggatttgagaggtctgaaggacaaaggcaatgttgctttgtatgggtgcacaaggggatatgtgcatttaaatccgtcaacagtccagaaattggattgccatttcagttcccaaacaaatggcttgtttattaaactaaaagcccctatctccattaggaaatattcaattccagcaattagccccagggtgaaagaggtctccctctctccagtctgtttttgctctgttcccaaacaatgctttgatgtgcaaggcactcctaatggaagataagtcatcaattagcccgatggaagrttaagctgaaaacagacttttcagggaagggattatcactgagctgttaatcactgattgacattatctattggggatatattcttatgggagacttactctccacccaggcagaaggtaacaaagatgcaaaaatattctagttgtttggtttttttaaaaaatgagttttagtgtcctatagcaccatagaataactgtagttaacaataatatacagtttcaaatagctggaagatgggcactgaatgttccccacacaaagaaatggcaaatgttcaagatgatgaatatgttaattgccctgatctgatcagtatgcattgtatgtacggaaacatcactatgtaccccataaatatgtacaagtaatatataataagtaaattttagaaataagagaaaagaaaaaatgtgagtttagaaataggatcttagatcaattgagtcggggtggagatgataatagttttctttctaaacaagtatcttttactttctttaagaattgttggtcataatatgattacattgctaatttatgaaataaaaagtaaggagaacctctaatttttttttagagtggggagacagtgtctcactctgttgcccaggcaggagtgcagttgtgccatctcagctcactgcaacttcctcctcccgggttcaagcgattctcctgcctcagcctcccgagtagctgggactgcaggtgtctgccaccatgcccagctaatttttgtatttttagtagagacgaggtttcaccatgttagccaggctggtcttgaactcctggcctcaggcaatctgcttgcctcggcctcccaaagtgctaaggattacaagcatgagccaccatgccctaccagaacctctatttttataagagtaagttgatatgaacaatattgtgaatgtaagcacagtgcacatgaggcaaatttgtaattctgtgcttgagttttacaagtgaaataagtttattttttaaactccaagtagtggcagatgagtgttaatttacctacaacttttcaggaaaatatcaattgcatacattaagctattttgctgttatttttttttttttgctttgtgccttttgtttttctttttttctttttttttttttttgagatggagttttgctcttgtctcccaggctggagtgcaatggcgcaatcttggctcactgcaacctctgcctcccgggttcaagtgattctgtctcatcctcctgagtagctgggattaaggtgcctgccaccacgcccagctaatttttgtattttttagtagagacaggttttcaccatgttggccaggctggtcctgaactcctgacctcaggtgatccacctgcctyggtctcccaaagtgctgggattacaggcgtgagccaccccgcctggctgccttttgtttttctagtacgctgatgagaccaaaaagaagatataataaaattaattgccaaaaatttagaaaatggaatagggtagttattctactaccctaatataatcaataactattgtactgcctaccactcttttttctcctgtttgctacaggggtgcaatccatttacctagattctgtttcctaattagcctcatagaatgtttcaaaaatcgtgacccatatagcttaatgagtacagagtttctgtctaaggggtgatgaaaaaatcttcaaaatagtggtaatggttacacaacattgtgaatataattaatgccactgcattgtacacttaaaatggttaaaatggcaaaatttaagttatatattgcacgacaataaaagaaagtgtatcaaaattatgcccctgcatttaaaaaaaaatttttttttggtagggggaagtaaaggattgacagatttcagagtctgtggtgctaggagaaaattttagggtggagttattctccatggggctcaaaacccaaaacttttcaatactattgaatattagcaataataagcttgtaattcaaagcagcagggtggtacgttgttaaaacttcagaaaccggtccggcgcggtggctcatgcctgtaatcccagcactttgggaggccgaggcaggtggatcacctgaggtcaggagttcgagaccaaccttaccgacatggagaaaccctgtctctactgaaaatagaaaattagctgggcatggtggcacatacctgtaatcccagctagtcagaaggctgaggcaggagaattgcttgaacccgggaagtggaggttgcggtgagccgagatctcgccattgtactccagcctgggcaacaagagggaatctttgtctccaaaaaaaaaaaaaaaaaaccagaaagaaagaaacatttaaaaaaaaaaaaaagaaaaacttcagaagccttctgaggttcagaggtcatgtttcggaggtcatgtttcagggtgcggtatttggagccytcccggaaacacaaaagcctccctggtgacattcttagcccctaggaagggcagtaatgacagcccacaactgacaagtactgatgaatagttcttgaaggcaaaccctgccctcagggagctctgccatagcttggcatgtcttctaraactacgtgcaaggggtcgcagagcagctaattctgccgcggtatgggcagtcaccaggaaacttcaagggggagcaggtttaacctgaatccttgctgaaaatagatgaatttgcctgggagtgagagaggaaagggcatgcctatgtggaggtaccagcaaggggacagatacaggaaaagggtgccaggccccttaattccaggtttaggagtttcttttaaaaaaaaagttcagtctcaaaaaactaaaaatagaagtaccatatgacctagcaatcccacttctgggtatagatccaaaggaaatgagatcagtatgttggagagagggactggctggaggggagggggattggggagatattggtcaatggatataaaatttcaattatgcagcaggactaaattcaagagctctattgtacaacatggtgactatagttaataatgatgtattatatattgtacttgaaagttgctaagagggtagattttaagtgttctcctcacacatatgtgaggtaacatatagtaattagcttgatttagtcattccacaaagcatatgtatttcaaaatatcaagttgcataccataaatgtatacacttcttttttcttaatcagaataaataaatagtccgagggacatttattgagggcctagttgttgggcagcatcttaggcttcttttggtttctaaatggtgccctagtcagggcttggtgagtttcagatccccagaaaaagtctgttcttagctttgatgggggaaggaagacccagagcaaaccacagtggcactgctgatctagagcaccctttagggtggctgggggtcagattacagactggaccacactcctaactttctttacccctgagacctctggagtcctagatgtggacgtggtgtttatggtgcattcatgyttctgaactcttttttttttttttttttttttttgagatggagtctcactatcatccaacctggagtgcagtggtacgatcttggctcactgcaacctctgcctcccgggttcaagcgattctcctgcctcagcctcctgagtagctgggattacaggcacctgccaccatccctggctaatttttgtatttttagtagagtcagggtttcacaatgttggcaaggctagtctcaaactcccgccctcaaatgatccacctgccccagcctcccaaagtgctgggattacaggcgtgagccaccatgcctggcctatgctcctgaattcttaaatactccaaatgatgcgatccaggcttacaagagaggaaggagagttagatctatgaatctaattaggctaaatgttttaaacagctcttctctcaggatattgtttttgttcatatcccaattctgaaattcattagccttatagaaatttattaagcctgaattacagagtgaaatcaagaagcatttttttttccttttttcttttctttctttcttctttttttttttttttttttttttgagacggagtcttgctctgtcacccaggctggagtacagtggcaagattacggctcactgcagtctcaatggctcaggctccagtgatcctctgacctcagcctcgtgaatagctggggtcacaggcatgcaccaccaaacccgggtatttcttttaattatttgtagagatggggtctcattacgttgcctaggctggtcttgagctcctggcctcaagtaatcctcctgctttggcctcccaaagtgctggaaatataggcataagccactacacctggcctcaagaagtaatttttaaataatrtttttcataagaagttgagccatgttactgaaatgatgacatgctgaatggtgcattgcagcattgcatagtgaaattgaggggacttgactaagttgggagctggcaaaccccttgccaccaccacagcctttgcagataaagtctttgccttgctttcccatcccctaayggcaaaatgaattgctaagatgagaaaaaggaattttgcaccatctgcaccaattctgaggttttgcaagtgatcaccaatgtggagagtatggttcagggctacatgtttatttttatttttattttgcatccagcgtgctcagaaaaactaaaggaaaaaaaatggaaggatgaacattttaaaatacaacaaagctgcatcatcctccagtcaacgttttggttccagctgccttctagcattgcacagcttgagatgtttgttgcttgtgttcctgcagcattgaagcccccactcccacacccagcccctgtcatttcctgttttcagatccccaccttctgccctgcatgttggggaggggtccatggccagaacggaatggcagctctctgctattgtaggatccctgctgttgtgctcgaacctgtatataagacaaacagtcattcttgggagtggccagacattatctagagaattccaaccactcagctgaagagaaagtcactcacctggagtatttagagaactccaggcatctttaagcaggtacaggtgggagacacagcccttgaagattaccatccgagatacagctaagagctcaaagtgaattcttagattcagtgagccatgacacatcatgtgttttggaagagcaaaaaggatgtcaagatgtgcttctttatagtgggctttggagagctggacaggccagggcttggctctcaactgtgcccctccttgttttgtgtctttgggcaaattacttaagctctgagcttcaatgtgttcatccacaaaatacggattagccctatttcacagagttgccatgaggatttattgagataatgtatgtaaatgtctacacattgtargtattcaattaataattgttaccatcatcatccatatcatctatatttcctgtcaaggaaactggcataccagctaagccagcaagcacatgcaaatagttctaggacccatttagagtatatgataaagtagaaaaagaatcttgaagccggtcttccttgttaagtttctagtcgagattgtcccagtttccacctttgtatctacaagaggcaagatagtggttaaaggccctgagacagattttcctccagttcaatcccagctttagcacttatggctggagcccttgggcaagtcacttaaaactctctgaaccttggtttcctgatatgtaaactacagctatcaagagtactracctcctacgcttgttttgaggaataaatgtaattatgcataaaaatcgcatggtctaatgcccagcatatcataaatgctcaacaaaggttatgagcacctcatcatcaactaaagttgctaatgcctttgaggactctcgggctctttgttccttctccagtttgacagggtacattaccattgccagctctgtgacaggctttgtaacctggcttctgtgtacaacagcatacatgtatgcttctgctccagctgggcagtcgataagcctgcagcctttgctggttgatatgcccttattccacaggtattctttgctgtttctgttttatctacaggtttttatttttgttgttgttgtttgtctttttgtttttgtttttgtttttttctttttttttttttgagacggaatctcactctgtcaccaggctggagtgcagtggtgcgatctcagctcactgcaacctccacctcccaggttcaagagattctcctgattcagcctcccgggtagctggaactacaggcgtgcaccaccatgcccagctaatttttgtaattttagtagagatggggtttcaccatgttgaccaggatggtctcgatttcttgaccttgtggaccttgtgatctgcccaacttggcctcccaaagtgagccactgcacctggacttttttttttttagacagagttttgctcttgttgcccaggctggagtgtagtggcacaatctcggctcactgcaacttctgcctcccggattcaagcaattctcctgcctcagcctcccaagtagctgggagtatgggattacaggcgcctgccaccacaacaggctaattttttgtatttttagtagagatgggttttcatcatgttggccaggctggtctcgaacttctgacctcaggtgatccacctgcctcggcctcccaaagtgctgggattacagacgtgagccaccatacccggccctgtctacaagttttaaaaagcatgaatatgttggggcaacccacctctgagaaggctcgaaaaatgctataattagcctgtggccagagtagagggcaacagtgaactacctggcattgaagtcctaccatgttcccattgtggggccagctgccttcacattctgtcctcttggaaatcctcataacagcctcagaaggtaggtgtattgatttcctagggcagctataacaaattctcacmaattacgtggttgaaaacaatagcaatttgttctctcacagttcaggagtcctgamgtctgaaattacagatggcagggttggttcmttctggaggctttgagggmgaatccgttccatgcctttctcctagcttctcgtggttgctagcaatgtgtaacatttcttgacttgtaaatgaatcattccaaattctgcctccagattcacatggagtttcctctgtgtgtatatctgcatgccctctctttcccttataaagacaccagtcactggatttggggcccactctcacccagtatgatctcatcttaacaaattatatccgcaaagatcctatttccaagtgttacattctgaggttccgggtggacatgaattttggggcggggcactatttgactcacttcagtacttattatacccatttaacagatgatgacccagagtctcagggaggagaaaatcccttgcataagcatcacacaatcagtttatgatacccaaggattcacaaaccctgacctgcttttctctagatttgtgtacttcccaccgtatcactttaccacatataaacaaacgtagaacaaagagtctaaaacctatggcagcaaaacggtcaacagcaggcagccctgggatcaaagagggtctctggagggtaaacaggatgaagcagaggctttgcaagcaaatggcgatcccttccttgtttctggttctcagacttcatcctgtttccataatcagtattacttattggctctcaaccatccggctgtgctcctgggattccacagtcgggcagagagattcttcataaatgagagaaggtagtagtcggtttcgtttgcattaagagaaggagcacatttctttgcacaaagtaaaataccctcccacgactccscactgctccccgtatccctgctggcttatgcttatcatgcatcccagtggtgaatggagaaattccatgctttccttctcctgcagaggttccttcctggcattcagagccgtaaaagcagtggacggaaacagctgaccagccctcagctgctcccagagtctggctgcctaaacttttcccagaggatggtccagcagtgctggtccagggtgggcttgggagagcagagctataggcaagagaggtgtgaatccatgtggtccccctggttctgggtaaaggccagggctggggcagaatcacagtcagaaccagggtcaggtcgtcagtgtcaagggcaaatatctttttctttaaaccacaagtgcacctctggtaccatgctcagaatcccttgtagagagtggcatccgtttgctgcatgagatgggagaaaaattagcggccctggctcgagtcttcattgccccttggctgcctgccgtgtcctatttctcatcaggccagtgtccccagtgcctgtcctgatccagaattaccacttaaccctagtggagcaggactctcagactgaccatctggactttcctcgagttctcttttcctgccagagtgtgtcagagtgaattggattagagttctgtttgctgcacagcctggcttcacatgaggctttgtgcttttgaagaaacttgagacaagactattcatgagttcccagagtgggtggcaattcacagtgatgctgatatccacgatcgtggggtggttctgtgcagggatctctaaaccttttagaaccttccaccagtttccctgcaatcaataggtagctgattccatcagatcaaaccattttcctgttggaaagtggtaggtccttttgttaagtgttcttagaactcaccaatgatttcatcgaaaaagcatctctgatggtttttctttctcctctggcattgtgaacattgtcttggagaagtgaaggtttgccatgtaacacctgcctttgagcagggaagaacatggtgggtaaatctacgagagagacctgttctgttccctggactcagctcccatagagtccaccactgaccttagaccctcaggctccaccggatggataggaattgagtaacagaagggtaggaatcccatacataatcagtatggaatttgggattgcctaagtgcagagttacattctgttccaagccccagcattcactttaaacattaataagagatatggtgctttttgcctatggaagactagattgaacaaacccaaaatattatttttaaaactactcaaaattttaaaatactaaaagaaaaaatgggactcaaatttaatgagcccgtgtgtgcgtgtgtgtgtgcgtgtgygtgtgtgygcatgtgtgtgcgtgtgcgtgtgcgcgtgcacgcgcaccttgtaggtaggtgaggagattactagattgactctcctgtacatttaagttaaatggaacaaaaaaaaatgactrttgcttagaataatggataagccggcctcctattttttgttctctacttgactgatcagtccttgggaaattcttcaatgggattttcctatgacatattctgtctgtgacatagttcatgaaattctacgacatttgattcccaagggggaatctggttactcacagcgtgtttcacaacttttctgggaacaggcagctcttggaaggaaaatgtctatgtatagcagtgagccaataactcatcttcagtgaaaacggaaggtgatattgtcatacagctgtgtagagtgagagtactcctaaacagataataaattacagccagaaagcaaaacctcctcaagagatggccaagttttggtacacatttgttcactgtggctctatgaaagacctcactttttaatatgtggatggaaaatggagatcagaggtgctgtaaaacctaacaagtagatgagccctggccgtttaaaagtctaaatgtatttaaagcttgaatttgtaactttttaatttatgtatgatactctcaatccttgcttttccaattacaatactaatacatgctcagtcatatgcatctttgtttgtttttgttttgtttttgtttcttgtttgtttgccttttgagacagggtctcattctgttgcccagactggagtgcagtgatgtgatcacagctcactgcagcctcaacctcccaggctcatgtgttcctccggcctcagcctcccaagtagctgggactataggttcatgccaccatgcccggttcattttttaaaattattttttgtagagatggggtcccactatgttgcccaggctggtctcgaactcctgggctcaagttatcttcccacctcagcctccccaagtgctgggattacagacacgagccactgtaccctgccaataatccacatctctatgaaataaaaaccatggactccacttcagcttttcatcacmcctttagcactgagtttccccattcctattctccagggttaaccactgtctttgtctaatttctgctgctgaaagagtatacctgagtctgagtaatttataaagaatagagatttggttcttacatttctggaggctgtctcatcccatagaagaaggtcagagggcaaaagagcatacarcctgtgagagacaagagagagccagtcttactttgataatgaatccattcctgggttgaccattcgtgaggtcagagccctcatgaccttatcgcctcttcaaggtcccatctctcaacactgttgtatttgggattaagtttccaacacatgaatttttgggagacacattgaaaccacagcagccacagataagctatatatatatakakakagagagagagagaactatagagagagggcaaactatgtatatagaataaagtgtrtatatatagtgtaagatacwtatatatatatgtcgttttgtgtgtgtgtgtgtgtgtgtgtgtgtgtgtgtgtgtatgtagttctacttccaagaatttctactacagccatggaggcacatgtagaaaatgatctatattcaaggatctccaatgccacaatgtttgcaacaataaaagactagaaataacctaaattaatagggaactgatctttttataaaatggaatatatattatatatatatattccatgtatatatacagaaatatacacacacacacacaaattatatccttattttattatttaatttaattttkgtttttgagatggagtcttgcctatcacccaggctggagtgcagtagcacaatctcggctcactgcaacctctacctcccaggttcaagtgattctcctgcctctgcctcctaagtagctgggactacaggagcccaccaccacgcccggctaattttttgtatttttagtagagacaggatttcgcaacgttggccaggctggtctcaagctcctgtccttaagtgatctgctcgcctcggcctcccaaagtgctgggattacaggtatcagccactgctcccagccttcttgacttgtagagagtgaatttatctcctccaggtgcctaatcacccatcaggagtgccatatttccttttagtgctttcccacctgtctctctgtattttttaaatgcttacttccttttttcagaagttaatatatgcacatattctaacattggaaaggtgtagaaaagaacacagtgaatagaagcttacctacacctgatgtccagtgactcccttccccattccagagaaaatctctgtgatcggtttcttatgtgtccttccagggatagcttatgaatatgcaaatatagatacacacatacctacatatatacaaataaaaatatgtacatataagattattcatattcatgtttgttaacatcaaaggtaacgtgctctttataaaatgttccatagcatttattagtagattttgaagattgctacatataaattatcatagagctgggagttcttctgttcttttaaagttgtatgatattccatttaatgaaaacatcaggccaggcacagtggttcacgcctgtaatcccagcactttgggaggccgaagtgggcaaatcatgaggtcaagagatcgagaccatcctggccaacatggtaaaaatccgtctctactaaaaatacaaaaattagctgggtgtggtggtgggcgcctgtaggcccagctgctcgggaggctgaagcaggagatttgcttgaacccgggaggcagaggttgcagtgagtcaagatcatgccactgcactccagcctggtgacagagcgagactccatctcaaaaaaaaaaaaaaaaaaagaaaagaaaaagaagataacagttccctattaatttaggttatttctagtcttttattattgcaaagattgcggcattggagatccttgtgtatagatcattttctacgtgtgcttctatggttgtagtataaattcttggaagtataaccactgggtcaaaagcattgtgtattttaaagtggggtccacrttgccaaattgccatccaactttatggagttggatgagggtacctctctcattacatgctgataactaatatataggtggaaaacttgtagtttttgtgtttcttttttataaatgggattgagagtcattctgtatgtctaagaatagtttatatttctttttgtgaaccgtctatccatatcttttgtctagttttatgtttgggttgttgaccttttttatcgattgcaagggtcctttatattttaacaccatcaagccattataataacgtgagttgtgaatattttcctagtttatttctatttgagccaccattggttgaatcattttaccgtatggcaagccctgtggtgagcatgtcatgttttacaactgctccctaagttagcagtggtattatgccattttacagagaagggccccaggtctgtcggatgccaaagttgattcttaacttgaactctacaccccttttgcacatacctatttatatagcatcatttcaggttgtcatgcaattatgataaatatccttttcacaggttgcatagcattctattagttatacaaatcaaaattttcagatgctgatacttagactacacattttcatcacctataggttttcactgttataaataagattgtgatacatttcttctaaaactctgtcctccccaatgcaacaagatggtgccattgctcctgcaggagatgagataccatgcctgaggcagacagcagagtcatcttttgagtctaagatccttgacaagggaactcaacagattcggggtagaaatggggtgcatgtcaggggatggggacattttattggcctgctagacttctcagtgcctttcccttaaatgtcaccagtagcttcacctggttctggaatgaaatacaacacacattagggcttcagaccctcttctctctgaaagcctgccctttgtttttgagacagagtctygctctgttgcccaggctggagtgcagtggtgcgatctcggctcactgcaacctcygcctcctggattcaagygattctcctgccctcagcctcccgagtagctgggattacaggcatgtgccactacacccggctaatttttgtatttttkagtagagacaaggtttcaccatgttggccaggctggtcttgaactcctgacctcaggtgatttgcctggcttggcctcccaaagtgccgggattacaggcatragccactgcgcccgggccaaaagcctgctttttgatcagcaatattggagacagttgtaggaaacactgaaagactgcaggatgcagtggggagggcgaaggccgggagttgacaactatttttttttttataaaatagtatttcaaataatatttctaacaggaataaatgagatcatagtgcatgacatagctgaggggtccatatgtttgtatgttcttgtggattcttctcaaccctctgctctgtagctttctatgccctgagcaccagagaagcattaccaggtctgggtgttctttaagcctttctaaagagagttgctgtttctgtttgccttttctcatcattttccccttaataaattaagggctaagtgtgtcttagtttcccacactttactccaatcagggattcctttgggtaaacaaactcctgtcttaaattgtaagtattcccatctgattcacatgtaagggcaaattgttttaaagacctggctccatgctgagatgtagggtcttttggtgacggggcttggaggaggaacctacctgaaaggtaaggagggagaggacaagactgggcatgtgaggaggaagggcggttgtgaggcccaggcttccttctctgtgtgccttgaattgggccttggagcagcttgaaaagctgccccagcttcgctaagcaccaggaagcagggaggggaaccttcctagtgccaccctttcccctgcacctgctactttgcaattccaggcaatgggctggctcttaactgtgtttgaagccagcctctctaccctgaggacctcattccttcctgaccccttcaaacctgtttttggaactttctgtcacactaaggtgactggtgactgtcacaaatgggaaagttacatttagcagaataaaatccttccgttaaagagataaagttctgacaaggggattgtctacaagctgcgcctccttctaggaactcttaaaatccctctcagcaaaagtatcacctggtttccaaggcagctgctgctcctatcctctcacaggctttcttgagactctgcccactcaaaatgagttcacctttgcccaaagttcatgctaaaagcacagaacttacagagattaggagaagtgaattgtgagggtttatgtacctgggatctcattttaccgaccagaaaactaagacctagaagagaaatgaggccttcccaaagctcctagcagctggcctacgctttcaaagtcgtctcttgctgccttacattacagacacttcttaaggttttttcttttttgatcatggctcactgtagccttgacctcccaggctcaagttcctcctgcctcagcctcccaagtagctgtactataggtgcatgccaccgaacctggctacttttcaaattttgtagagacaaggtctcactacgttgcccaggctggtctcaaactcctggacccaagtgatcgattctcccgcttcagcctcccagcactgggattttacaggtgtgagccactggtcctggccttcagatttttttcttttatttgcattagcccaaacgcttcttgggtctgctccttcctgagctgcctggtgcggcttctatgagcactgctgcattttggggattcatggcttctagccagagctctgttcctaaccagcgggatgaccctagggggtaggtggctgccattggctggggtctgcccctctgcagagtgcatgataatccccactttgccattaatgggaggattaaatagaaggtatagaagggtatgtggcacagacaaggcacacagtaggagcaccatagatattggctgcgtgatgatcataatggtatcaattgtctttaaaccccagtggctagactttcataaattgaagtttacttcccagtcaaccaggaccaagtttcaaaatggcttcttttcccccagggcaaggcaccctcagaaactaacgaaatcaggttacggcaaaacagtgcaaatttattttcagaaaacccaccccaagctcagagtctacacttaaagggtgtagaggtgtgagctgcagctagacgttacctgctggattctactctggtcatttctctccagagactccactgtcatcaagtgtgggatggctctgtttatgcttttgcagcctcagcctagcttgctggtttttcatgtctccctctgcctctgagtataatccacttttctggagtacctaactgtgactttgccatagagtatttatctaacctcaaccctatttttgcagcttgggttgaggggagactcaggcaactgtgtgaatgtgtgtgtttttgtgtgcatgcacaaatacaaatgcatgggtgtgtatgtgtgagtatatagattagtttgttagggttgccatgacaaggtatcacacattggtggggggaggcttaaacaacagaaatttatagtcttacagttgggaggctagaagcacaaaatcctcagcagagttggttcctttggagggctgtgagggaaggatctgttccaggcccctctccttggcttataagtagttgtgttccctctatgcacatctctgtgtctacatttcctcttattctaaagaccctagtcatactggattagggcccaccctggtgacctcacttaaatgtgattacctctgtaaagactgatctccaaataaggtcacattctgaggtccttggtgttaggagttcaacataagaacttgtggagatgactcaagtcaacacacaacagtgtgcctgtgtgtgggtggagcatatgtgtgtttgtgtgtgtagtggactctggcgtctctgagacaccaggtcatttgcaaacctactccttggaaaatagtactttaagagcacatacagttgtctcttgtgaatagggcagatttaaaacctttttctaaaacaaatcttcccatgggtgtggaggggcaggtgtggtaatggagtgggtcccgggtgcccctcttgcatcgctggtcgagggcacttcataatggaaagtccttccctggttcttcattctcaagcagagcaatgccattggcatgtgatttctgcctcattttacttcagatgactaagtagcatcttgaagtgcctttggctacacaacagaacattccaattattccacagggcagcataaattcggagttcccttggagctccctggtgacttgataccaccaagtcagtcattgaggaactccccaatatttctaaataaatttggaaaatgtttttagcatatggaaaatgttgtttagatgctgtaaatagttgtaaagtctacttttagcctccttttcaaaagagccttcctgggctccatctactctgattatcccttccttgactcgtgtgcttgggagggtcccaggaggactgctatgctggctggtgtgcagaccacaggtgaaccctgttgcatctttcagctgctcaccaggacaaactgctctaaaactgaccccaaatgagctggccccacagaaccatgtgtagcgtttgtcatctttcccccagtttactgtaaatctcagttctctttgacctctaaaatcttactgaaaaagtgagtacttcatggtactgaactgacctggaattctgactgactttctagttctgcccgtaagttatgccctaaattttccaggtcaatgtagagttccagggaacgaggtggacggaatctggaggcagagttgagccagtgggtgttatcaggcagggggcactgataaacacgccaactccctgttagacttagtgtagtgctgggggccctattctgaggtgacactgatgtctctactcaaggcaaatgcacatctgttttcttgatggcagaggactgttgttagccatgggatggtgcagccacttcctccagatattccttgaaattagagcactcatctcagacttcagatgcatctgtccactttggcatggactataatgtagccacttaaaacatatcttacaagggccattaaataacataaaaagtgcttgtgaaatgatatgagtaaaaaaaaagttggcacagaattgcatttactgtctggtctcaatgatattaaatatgtatttctgagaagatgacaatggaatgaaataaaatattaactttttttctgattggaggggtaatgaatattttttattttctaaatgttctgtggtgagcatttgttatcacacacagacacacgcacacatgcacataccacatgcatgtacacacgcacaagcacacaccacaggctgtcctgaaaagtctgtctaactggagatttctccagggtctttcagattttttgctgcctcaatacccctgggatatcaattccctgcttgtcccagggcccacctctgaattgccgagaagacagtggtagctgattcacatcaatgctaactgattcacctcaacgccgccagctcctgcctccctgctcagccttgagcgtgacaggagcaggccgggcctgctctggctgggaatgccgctgccctccagctccggccagccagggaggggccaggcctctccgaaggaggttaaagtccttctttgtgtgaatggccttttagggagcagagggagggcccacggtgacatcacagtcttccgtcaggaggctcaggaggaatttgtccagcttgagccagggtgcacgcaggaatctgtctggaaaaaggcagttctcactgaggaggtttgaggcgcgcgctctgggcagggtaagccaagtctgctgacttatcttcgtgtccttttctttctaatttgaaaggacaggggtctttttttgaggccagtgtctttatggaggaggttttctgagtgtgtcatgtgctgtggagtcctttcttgctggagagtaggcagccgagctcagactggtgtcttgcttctctctctcttttttttttttttgcaaatcttgtaaaactctcagcttttgtgctaagaggcaaagaggacgctcagtcctgcacatatagtgcaaagctatatgagtcgtctgtggcagatcacgctttgaagatggtgcaagtgtgtctgtgagaatctgtgtgcccttttccagaacaaaaccaagtgactcggtgattctgkcgcctcgtttcttagccatctagcatttgttcaagagactcagtcttgtggtctacagctagccttctgtttccatgctgtggaactcaccacattcacagggtggcctgggggaatatggttttggggggaatgtgtggtgcttgtctcttggaggtcccatgggtatggaaggagaccctcgccagctttgttcataggcacagaatcatctgtagacagagggttaaccacaaatgcatctggcactgttttctcttttcttggggctctgcctcaatatagtggattctgctggtccacagtggtgtttggcttttgatctctgccatgacctgctcaccaggcgtgaacccaagatctggaactatttttaaaccaagagggacacagcaaatttataaagaactgaaaaactaggcttgcttttgtctttagcagaatcggttaccctagaaatctcaccttgcaggagccagagttccctctgtggccttgagcttggtttattctggggtagggactaccttgcaaaataatctccagtgaaaagggcctttggtgagaagagcctccgagggctccttgatagggcgctcagtatccctcattgaggaaaacatgaaactcacatctctccttattcacgggaaacccggaagcctctcagtcactcctgtaagaagtgggtctccaagtaacggaaagaaacaaccctttcatcagctgctgcagaaaaggcaacagcagcttccttcctttcctcccctccccgctgctgacccccaccacacacactgtcttcagtttctttcacagaaagcccaagctgtaaatatattcatcaaataacaccttaacattttccagatgtgattggagccactgacttttcagcagggctaagaggaggattgttcataggctaagctatggtgctgggggagactccgttctatgagaaattgaccagtctccttcactaggaatgtgggtcaagacacagggaagccttgtttccagtgaaggggtggggagttccagaagtattttcatcccrtcttcagacctgtacctgaggcataagacagagagaatagcagaacagtgattactcttttgaccaataccgtagaagctctcagaaaaaaaggctggacctgcaggagcaggaacaggactcctggcctccaaagggttgagttttctttttagaactgccctagtcacattgagctgtaatggcttcatggcaggagatccatggaggcaaaccaagaagtgtttttagtatctgccccttttaaggcccacagcattgacccgagcctgccgggtccaaatttagcctgcgtttgccccaggagtgcttgaggtctggagtctggccggctgtcttccatcagccaggaggggaggctctagcctctttagggagtggcttagttcccagtttcccacaatcaacacgggcccctagttccacaggccggaagaagctctgctcgggggatggaagaggaaagcctgcacaggactggaatgtggcccaggttatcacccggggcctctcctctcctccacttcccgcttataggctcggcttagaggcccaagtctaaccctcgcagcaagcagttcccagactttcctgctgtcagtgccttcaggggagggtggaacggcccactcggagtcccagctccttctccttcctgtcgtcgttagcagggagggccagaggaggtgcagccagcctgcttagaaactttggtgcaccgcgctttcttcaattctttttgcccggcacagtttgcgccgttgaagagggctggaagtttatttccagctattgctgcagcacttccttctcctagtgctgttcgttcttcttatgggaactggtactcactccctccaagtctgtgagcgtcttgctggggatggcggatcaccttggagctctgaggacctcgcacggcccaggctgagagcatatagctctgcagggtcccaggatatgcttatggatccaaggtagtgttgacctsttcaacttctgttcccttccttatgcttcgggttccctcggtttggggagttagcctcccccagacctcctgactgcagctttgcctggtttgtccaaagctgatgaggttcagctgatgtgggcatcttttaggtttctgggcatcatccaccagccaggtgcacttccttccatcccaccctcaccccttctgcatttgccttcatgctggagacatcctgacttagccagaaagttaaaaatttaggaagaasctctctaaagatagccacacatagctcgtggaaccagttcttcatcatgattgtcattgcgtcctgcgcactgaaaacgtgacttacaaaagagaggcaggatgagaagggaaaacggagatactctctgatttcacagctatgaggaagttttgttttatagccatgcctctgttcctaggccaagagtgagtttatatttttggtggaacttataaataactggattaaaggatcgggtcacctattatctggagaaaagcatttctaatttaaatgtcatggctttagtaggaagtaatctgggttattcaaagcagagaaacctggttgtacagcctgatgtttgagtaatttggttcacactgtgcatttaggctaggagcctaggaggtcgagatgggttaggcacactgtcgagctttaacagcctgaggatggtggggcagaggggaggctgtgaacacagtgaacattgtccttgtggtgaaggacacctttctgctctccgcctgggctcaggcagacctgctaaggaaaatgcacttccttaaagttatttctgtccatgacatgcctagctgtaggcctaggtaccctgggcagaaagaacacatgggtgtctatgcccagtggggcagggatcagggccctgctgttgtgttttctgtgcaaatgtaaacaggcttctagaatctcacttgtggtgttggtgaagagttgcagccttttcccacagtgtccatcataatgacatggacatgggatcttaatattttacctctggcaagtggccagaggaaacagaaccccttcagagaccagcccagagggtgaaatccccagaccgtgcaagaagtcacatttctagctgacacgtagagcaacagatacgtctccagagagttaactctccagggagttcatctatttctgaccaagactgaataaagaaggtaaagggatcatcgacttttaaagctaaattgtgagtctcacatcatctgtagagattcaagcaagcaaaagatcaaccaaaaagccaagctaactctgttttgatccatccactcttcttaccatttcccatgtcattttaaaagcctcctaatattgagactccattttgatrtatcaggatagaatgagaagaacccaccttcaaatcctggctagggcacttactagrcaggtgatcttgggaaacgtccctctatttctctatacctcttattctgaagttttaagactgaaataaaattcatgcctttcccacttaacagagggccakttttcaagcatcagctgacatatgtatgtgcatgtactgtgaaatgataagctattagrcatgtgtcaaccagaaaatggggatgccacacttacagcatgcccacaggacaggcttgtcagggctgtctcattcacttgtacatttacttggctagttgagttgtggagatggaccaggttctgttttaaccaatgtgtgacccctcctctgcttcccatgtgactggagccccaggtctgggtggttcttgactgctcattctacttactgcatttcaggacttaacttttaaggacattttgtgaaattactccctctgttgcagcacaactgtatcttcctagtcgtgttcagcttcaactaaaattcacatgtaaggatctggggttggggaaagattagggagattagagctgccatagattctgactttgagtctttcccgggccttttttctttcatcttttcttcttgatttcttttcttctaaaaatctcctgctcttttcccaaaagaaaatcagtctgctgccagaaagaatataatacctgtcatttaaacctcagtgtaaaatggcttaataatagtgaacatttgcattaaccgttttacagtttacatagtacttttaagtacattttctaacttaattctcaaaacagatttgggagatattattagtcctgcttatgaaggagttctgttctcagcagaattccataattacaaaaagtctggtaggacttttataggtagagccaagaaatgaccccagactctggtctttggacgctaaactctgaattaccacatttcctgcattctttaggtggagacataggcacctgtgttgtaaattaagccacgctaatttgctttgcaaaactattaaacactttttggtaaataaaggcgactttagttgcagcctggctaccaggttatgttaaacacaggtctctgggaccaaattctggcactcatacagacttgwgttgaataaacatttataaaaaatgctatgaggaaatctcagctccctaaatttctagatgctccaaccccaccttgcctgaagacagatgtggcaactttatgaagacaggattctgttaccattttagtgggtggtaagcaaccgaagtcccctgagccaaaggctagaaacaagatcgtttagttttcaaacctcaaacaccatccctaagggtgtataaaccaaagggttcgctctattggcatatcccctttatgaaagggtgaggaagatctctaatccacaaatttgaacaccaccaatttcacggatttctaacattcattatgctaattgacaggccactaatttcactaatgaaaacctatttctcaccttaattatgccaattagcaaagcttcaggggttcttgggagttaaagggagctaagtactggaggaagccacctgtggggcgtgggatctctcattggatcctagatgaccatcccttgagtttatattcccatttaggatggttgtcagaccctggaatgtaatttaaactaattccagaagcacacagctgtattaaattgccccgatcaagtatgtgaaagtaaatggtaggcatcctaaccagctgttaactattctagaatttagtgggaagggcaggtttctgtgtcgtggtattagggctctacctggagggtgaactgggccgatctaaaaagctcccacagcccctttgcaccytagtttttctctgaccttagaaaacccagtttgatgattctttcatatcctcctgtttttgcattggggcatagttcatttcaaaaaggactttcctggtgattgaatgaatgtgcatcttatctgaatctggaatcackttygcctaatttgaagcatggagaaaattctggaccttcttatcttcaaagagagcaataagcatttgttggtttaaacaagacatcatctgatgataccaagcccagattcctgccyaatccggataggttagatttccagcccatttccatttacctggtgtagttgccagtggctttgattctatcaggccatcatgcatgaaggcaaattcttactgctgacagtggaactcaggaattcgctcttttgttatcattgttgtctaactttacaaaacctcaggacctctggtgcatgattgtgaatcagtaattcagagttgtttatctctttaaatacttccatgccaattagaggttaaacctgctgcttcctgagtagatggaattgagtgtcatgaagaattttctgaatttatggggaaagggggactggatgccatatagctcacaagaaggagggcctctttcctgtttacaccctccagtgtctagaggtttaaaaaaatgtatcggaaaggaatcatcccaaattacactggaacccccaaactttgacttttaacaagtaactagcgtgtgtgtgtgtgtgtgtgtgtgtgtgtgtgtgtgtgtgtgtgatggagtttcactcttattgaccaggctggagtgccgtggcatgatctcggctcactgcaacttcctcctcccaggttcaagcaattctcctgcctcggcctctcaagcagctgggattacagaggcacctgccaccacgcctggctaattttttgtattttcagtagagatggggtttcaccatgttggccaggctggtgtcgaactcctgacctcacctcaggtgatctgcctgccttagcctcccaaagtgctgggattacaggggtgagccaccgtgcgggcttcttttttttttttctttttgakaccaagcctcacttcctcacccaggctggaatgctccaacttctgctctccgggttcaagagattctcttgccaaatagctaggattacaggtgtacaccaccatgcctggccaacttttgtatttttagtggagacagggtttcaccatgttggtcaggctggtctcaaactcctgacctcaagtgatccacccacattggcctcccaaaatgttgggattacaggcgtgagccaccacacccagccttttttgagacagtctcacttcctcacccagactggaatgcagtggcactatcttggctcacagcaacctccgctctccaggttgaagcgattctcatgccaagtagctgggattacaggtgtacaccaaccaccatgcctggctaacttttgtatgtttagtggagaggaggtttcaccatgttgatcaggctgttctcaaactcctgacctcaagtgatccacccaccttggcctctcaaagtgctgggattacaggcatgagctattattgcaccctgccaactaactagcatattttaaaatctcagtttgaccgatcacagaagacataactacttgtaaaataatttctgattcaaagataatggcagttttgtattttttttcaaacaattgcaaaagtatattgtcaaattgttgtcttagattttaaatatttggtaccaaaacaactatttctagttcaaaaagggtgccttggaaagagctgatacaatttttgaatcctaaaaagaaaacgtggaaagtcatctgctcattcatcatcgagcacttgaagtgtgaaacattcaacagaaagggataatgctgatgtgaggagcggaaaagtgttcttgggaaatggctttggagataagccccatcactccttcctctgtgattagcaacaagagacaaagagaagcaatttcttcacttgcctgattcagactaagaaaactctaatatagacttagggctttcttggaagtacagagaactcattttttttttaaagggtgttgtcttctggagcttattgttgctgctaatttcattatgaccctgcagaataacctcccctcatgtttaatgaacggattaattaattaaactatagaactaattatttgccttttagtttcctttactattacgttgcccttcttcctctcctcaggtattctaaagcatcttgtgtttcaggagagcagtgttttctaaccatatttcagtcctaccagcttcctactgatttcccactaccctccgcccaccccggcccccaagccaaaaaggatagaaggagagctctgttgttcccatgcagaatattagcagtgagtcattggccaaaagaagccaggggtgagggtgccataggtaatctgactcatcttagcagtaccgtgaatctctctttgtttgtcttcttatttcaataataattttccatggagtgggctaattttggcctaggtttacttgaaattgaatggcagccagtaagtttcagcattcaaattttgtgtaatgcttaatgatatatgagtagaagttactgacaatgtctcatccaacaaaaagtttagttaatagttttaaaagggctggccatgcagggtggctcatgcctgtaatcccagcactctgggaggccaaggctggactgcttgagtccaggagtttgagaccagcctgggcaacatagcgagactctatctctacaaaaaattttaaaaattagccaggcatggtaatgcccacctgtagtcctaagggagactgaggcaggaggatcccatgagctcaggagttcaaggttgcagtgagctatgatcacatcactgtgctccagcctgggcaacagagcaagagcctgtctcttaaaaaaaaaaaggaaggtggtggcaaaaactrctatttaatgatggtcaaaaataaaaaataaagatattagcaattataaatattaattgtgttaagtatcactcyttaacaaagaccagacctagactggaagaaaatcagagaatggaagatgttgacaaaagaggaacactcattatttgtgcctgttaatggagaagacatatacattacttgaataatttaagtctgaaaggaaatgtggaaagtgaagagtgaaggaaaccccccagttcatggataactcagagagtttttcaacattctgacagcagtgtagagcacttacgatgaactccagtgttttcttaggtctcaagaacaaatccataattatccacttttttgggaaggattttgaaattaatttcctgagaatcgtcctaaggtggtgttttaatattctaagcatttaaaattgttgaaaccttagataaatgaaaattacactctcttgcaattttgcattgtcctatgtcaataataccaggcacattataaacttgagacagggaaacaaagccaacctaggtgttgtaaggtccttgatggtaactcaaattaagtttatactttactggaattctttgagataagccagagtcctttgatatgaaaaagaaaatcatcttataatttgaaaattaatgtttctaatgccaaataacaaaattacataggctagataactggtagaaaaataagatggatgggttgggtgtggtggctcatgtctgtaatcccagcacttcgggaggctgaggcgggcagattacttgagtacaggagttcaagaccagcctgggagacatggaggaactctgtctctacaaaaaaaaaaaaatatataaatatatatatatatataaatcagccaggggtgatggcacacaccggtagtcccaggaggtagaggttgcaatgagccgagatggcacactgcactccagcctgggccacagagcaaaatcccatctcaaaaaaaaaaaaaaaaaaaaaaaaaagccctcaagacaaaaaacctccttccttaaaaaaaaaaaaaaaagaaaaatatgatgggttttaaaacattaagaagatagggttttcttattgaatcacaaactgaagatatcacatataaagcagttaaaaaactggaggagaggtaccattggccattagtttttcaaagcagtgctgacttcttaactaaagagtattattttgatgcaatcccagaaaacagagctgtgcagtcagtggctttggtgatggtgttcataaggcacatggtcaattacagccatggcagtgaggcactgtagcctgtgtgctgccattaaagggatctactgttttccagtattttattctgcaaagattttccaaaaagtttcttgtctccagaataactgcattacatctggcagagagtcatatgttttaaagatctgttcatacaaaaggaccttctttttgcaatcctattaatagtcgtattgcacagcctgcaatcatttgccgcaaaatacttgggaagactctggtacaataatgatgtaatctcttccaccttagtagataaaatttaaaaatggcactagcatgtaaacaaaatggaatccataaattagagaggattgggcacctgttactacaagaaaatgaacatttaagggattattagaaaatatctattcaaaagaatttgtcactgtggtttccattttccttcctcttarttatgagtcagtttgtcagcattcacatccataagagatgcagtatttaaccctgacttttgtttactctttattccagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactrctgtgattctgctgtggatggaacgtacaatggaacatcctccccagagcctggtgcagtggttctggtgggcggcctaagcccccctgtccacgaggcgacccagccagaacccactgaaagaacagctagccrgcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagmagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgtyggttgatgaccccttggagtatcaggctggcctcctggtgcagaatgccattcaacaagccatagccgagcaggtggataaagctgtgtccaaaaccagcagggatggagcagagcaacagggacctgaagcgactgtagargaagctgaagctgcggctttcggctcagaaragcctcagagcatgtttgagccacctcaggtgtcttctcctgttcaagagaaaagggatgtattaccaaagattctgcctgctgaagacagggyrctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcrctgccctccagaacatgctacaaaactgctccaggtaagtgaggtgcctcacatgagagacagatgccacagcagtctgttgttgttgattccagctcatgggtttctatgtggagcctcctctgtgtgtgtctggaataagtgttggggggacactggcatgagaattccagcatacagggacatgcaacaaaagtgtcaagagtgtcctctagaagaaccctgagcttgcatggagtttgccactttccagaggatgcaatagctccttctttgttgttctgctttggccttggtttattataaagaattgttctcttttacttgaaagcctgcctcttgtctgaaggagaggctgtttgtggcatagaaccagagtggacccatgtgtggactatgttggaatcagtagcttgaccctcagtatctagttaaacccatctgatttgggagttgtcctctactaactaaccccttctgaatgctggtttccttcccagcaatgatagtcatggcatggcattgcagactggtccatrcaaaatgcttttgttcatcttccgtgtaactgggtttttcttcttaagtcaccacaaagcaactactttggaatcaggagtggacgcatctgttcttgtcatgtgacccatttggaaaagttgaattactcttcacaaaggcaggtctttaatcccttcatattgcctgggtggtcccttttttgaatactttgtatagatggttgatgttaattagagtgctaattattattgctaccatatggataacagtgtgaccagttgtttttattttccatgtgaatgtgatagcaatcagggatccacagatcttcaactatggaaaacgctgctcaaagcgtggtccaagctagtccaggaatcatttgctactggttcattctaagttcagacatcgagagtaagcatttgaaaactcctattgcaatgtgatattgtcctgaaatccaagcgtgggatttttgtattttacaaaactattgcttcataatggactggtggggaaaaactgatgcttcaccagagaaaatttaagaatcgttaccctaaaggataattgttgacacttatcttggtccatccatatcttaatcttatcttgacacttggcttccatcaaacctacaatgactcaaggtcactcttctcattaactttttaaaattggaaagaatctccaacctaaagaaaagttcccaagtacagtacaaatgtctttctgttttgaatcatttgagagtaaattgccmacatgatgccccatcacccccaattttgtagactgctccctaatgtgggtctctgatgytttcatatgatgattttcaggttgtgcatctttggtaggaataccaccaaattgatgctgtgttctcactgtatccaaacaggtagcacgtggtattagtttgtcccattatggtgacaggtgtcaactctgatcacttaatattgattatgatcactccattgagggagtgtctgccagccttctgcacagtagttacttttttcttttgtaattaatatacattttgtagggcaatactgtggtattctgcaattttcaccccatttcttatcaaacttcatttatttatgtcggtatgatctcatggattcctgtgatattcaatggattcctgtgatattcaatggattataatccatttcttttattatttttatccgcaacttgttcagttacagctcacgggagccctttctggctaacttgtatgtcctttggagatgtccccgttttcctttgaatgcttcctcaatttctggcatcgcaagatattccagtttcatcttatactttcccaaccctgaaatcggtcgtctctctgaagagcactagtttctgatgatggagaatggtatttagaaacaaagatctgagtgctagctgtgctcattgttattgcattgtcactagccccaggcactctcagtggacagaattagaaattacacacatctctcttgaaaaccatgagtttgccctgatgctttttaattcttatttaataaaaagttcattcatactttctccctttccatatttgtgaccaccttcttgacaaaagatacttagtttttattatctgtaatatgtttattatttaactagccctccttcccccacactccagtataaccagtctcctgttttcctcaccaaacttgggctccgacatcattttccaggtggccactgccacgacccttcaccaacaccctccttaccctccctgggctccaacactacagcaggtaccatcttattcagcctggcctagtgacttttggactgagttgtttgggaaggaaaggaaagggaggaagaagaggaagagtgcagtgactttcttaatatatgccatcaaattggtgataaagtttcaacaaatgaataatgggggggcgggcacaaacattcagaccgtagcatgagtattttcaggcttctctgtctctatctcttaatcgaacccctcaccatattacctccaactttatttctagcacataaacaactgtctaatataaagacatttcaatgctttctcctgattcccccaccggctgttgtccatcaggcttccccaccaggacygaggttgccttaaacaagtcagcatcctaaggcttgccactggcatcccagcaacccagtatcaatctccccagtacttccctctatgctaatgctgatctcttctcccatatcccacccccataggattgatttctggtccctacaaggggatggtaattcatccgtgcaagtctgttccaatcttgatgtcgtattgagtacaatcatgataatgatatgcatacatgtcattccttcatgtttatctctagaacatttaaagcaggcacccgggcttcccagaattacaacatgagttgaaagaaacggaatgtaaaatacaattttcttcctgttcatgcctggaaatctttggagtattgcttggctggccaacctccaagttcatgatcggggagaaggctgacacrtgactctgagcagccaaactagacaattcatggctagggtcagaactcctggcttcagtggttttgtgaatggaggtgttaccaagttcctgcggcacatttcatatttcatgccagaagaagtgactccactagtttgttgtgtgactcagattgatgattggatactaggtgatgaaaaatataatttttaacttctctggtagaartcatgctggtggcatgctggaatcctaaaaccttaaagcaaataaaatccactgagagccaagatgtggtaaggaaggagaaatcttctaattctttccatacaaaagttatctagacagaaaccccatccccctggtgtggaaatgctatttgtttttgcttttagtgcttttgcttttaaaagatggacaatgaatgatagaagttctgttttgaaaaggatatagtcattgttaatgaccgggtatctagaaattatcttgttggttcttattttactttttttttttttttttttttgaggcagagtcttgctctgtctcccaggctggagtgcaatggggcaaactcggctcactgcaacctccacctcccaggttcaagtgattctcctgcctcagcctcctgaatagctgggattacaggtgtccatcaccatgcccagctaaattttttgtttgtttgttttttgtatttttagtagagacagagtttcatcatgttggccaggctggtctccaactcctgatccgcctcaggtgatccgcccgccttggcctcccaaagtgctaggattacaggcatgagccactgcgcctggcccttatttgacttttaaaggaagaagctccacttaaatagaatttgagtgacatttgtttatacagaggtgaataaaaatgtatagtccctgctctcagggaacttaatggttcagtaagagaaacaacattaaacaaatgaggcaattttatgacagagaagcacagagacctgtaggagcacaaacaaggaagaccatatcatttggaggataaagaaagtcttccttccttaggaaattactgtctaagctgagaactgaaggggtaaagttgggctcagggtgtaggggagaaggaagggcacctaagagaggctcaaaaggaatagagaacttggcacatttgagatatttaagagtaagttaatggaagagatttaaaacaaaacagaaatagatttggagccagacaaccaagagctctatcaatcatgttaagggttgtagactttagagtttaccctatggtcagtgagaagccagtgagagtttttaaaggagtaattatctgaacacaaccccaagctgtcctgccttcactgtgagttgatggactaaatgtcttcctattgtaatgcatccatttcataggcttggattgagctcttcctgcttatgagcacttccgaaggcaggcgccatcttggtgaacaccctgtatgttatgtgaggggccatgctcccaatagtgtgtgcatgtgtgccctctgctgatggcacttagaattagagactaaaaggaagaaggccaggggtggtggtgcatgcctgtaatcccagcacttttggaggtggaggcaagaggattgcttaagtttgagacaagcctgggcaacatagcaagtccccatctcttaaaaaaaaaaaaaaaaagaaaaattacctgagtgtggtgacacatgcctgttgtcccagctacttgggaagctgaggcaagaagtttgcttgagcccaggtgttcaaggctgcagtgagctgtgatcgaaccattgtactccaggctgggcagcaaagtgccaaaaaaaaaaaaaaaaaaaaaggagagagagagaataaaggaagcacctttgcaggtacatgagcctgatttgaaggggtaactcacacagtgctgtaaaacacccttgaggaaagaattagggggtgggatatccaaacattgtattgaagttgcagttcaagaccttttcaaatgtcttttcatattggggttgccaacagttctcactttagtatctgtgtctattattagatatcctggtttcacttccaagttctaagtatgccagagaaacccagttaggtgatgatttgtttggttttttgagagtttctgttttcatgccagatgttgaatttatttaccaagtcagatcattcaccccgtgagacctacattatggagagtggcaaaagagaaggtgtagtttgctattaagttccataacttggggtatctgttcatgtcttctaatttgtggaaagatgtgatagttataaatgttacttttgtaagctgtacaggaagtgttgacttctgctgctgtctgtttagataagattagacatgaggtgatcattacattattataaagattcttaactgggtctctgttctttccccttcattatctgcaaatatcacaaaggaaagtcttaggaaaaatatgtttgcgactgtccacacattcttcatgaagcagagcttggtggagtgtgccatgctaaattagagccacatgaggcacagtttcatttgaggtgccctcattgctccatgggggaagtccctgtgtcagcatctgacagaaggattgatgatgagagagctctccatcagtagtacacagtgcctctctttcctgcaaggcaggcaccaactgtgcagcttgtaggagcccttctggctgtgtgaagctagctaaagcttattgtggagtgtccacagatggttattgtccaccaccatatttctagaacattctctggttacaaaagtctaatcatggtagttacaatttatcaaggccttaaagctgcatataatactagttatttcacacttgtcatttcttattttctcactgaatcctcccaacagccctctaagatacaaattacctcaactcttgaggccggatatatttctagattcagactttttctgattttagagaatttataaagtatatactattatttagaaaagtaatacaatgaacatactattatttaacacaactggcaggttctgggtcaacaccctgtgatcaaattaaatttctactctaaaacttgagaagaagaattagttacattaagtgggtaaagactaggagaccttcatgtcagctcatgtcaggttttgctgccaaataagttatgaaaaatctttcttttcagagttttttggatttgggaattatatatgaagagttgtggacctgtaataatattctttttcaaagaattactactagagcccagagagattaagttgcccaaggtcactcagcttgaaaatgggagagcctggtttcaaactcaggctctcatttgtctccaaaatccatcttctttcccctaccttctccttcccatttgttgagcctgctctatgaggtatacagtaatagcttctctctccaacctgtagctcaggttccctctaccctttcccaatcttatgcccaacccctgcattttcctgggtccttcttgatcctccttttaggagccactgtggctctgcaatccttcttttgcggtggcctgggtgtataaatttgactctcaggggccatgaaacagtgcttccctagtgacccaggatgattcctttctgctttcagaactcaattccaatgccccaaattacagtaggcaaaagcactcgggctgtccaaagatctgagcggatagccaagggactaacttagtccacatcagccatctagcctagctgctcttgtgagttctttttgaaagttatttcccaggaagaagctctgccatttactccagaaacaggttcattccttgaaaacttcgaaagaactgggtactcaagcaaggaagaaatttttaaatttgaggatgagcagggataagtgttcattattctgttaactaaacatgaacatttttggtgtactagggtcaaagtcaactaagttagttgactggtgatcattgagcaccatgactacgtactgttctccttgccttttaaaaattgatctttctgccttggcccagacttccctgtgttctctttatctaaatccagcaagtatgttttcttgaaaaatgcatgccatttggaaaggaattggtaagaaaagactatgttgaagctatgtttggcaaggggtgaaggtgtgcaatgaaatcaggacttttcaaagtatagaattccacattctctttagatattacccttaaaggcttggaaaagacaactgccatggttaaacctgcctgtcagcctcactcttctttttttttttttttttttttttttgagatggagtctcgttctgtcgcccagtctggagtgcagtggcgctatctcggctcactgcaagctctgcctcccaggttcacgccattctcctgcctcagcctcccgagtagctgggactacaggtgcccaccaccgcgtccagctaattttttgtatttttagtagagatggggtttcaccgtgttagccaggatggtctcaatctcctgaccttgttatccacctgcctcggcctcccaaagtgctgggatttgggattacaggcgtgagccaccgcgtgcagcccagcctcactcttgagatcctatgggcccagaagtctttattctgtgacaagcctgcagttacagcttctgggcagcagaactttggaaaaagcagaacgttccccaccagctgaattccctggtacaagcaggttctgctgttcctgctgattgtgctgggtcttcagatagatccgtgtgtctgggttggctcctgctggtgctgggccaccatgtgatgtcctcattgcctacttctgcatggcctctccatgctgcaagttagttaggggagcatcttatgaggaatcagactcagccatgcacaaaaacagatgcatagttttcaggtgacagagaggaggtgaatcaaagaacctaattcttgcaagttccttggtaagaaataggaactaatcaaaaccaggcttgggagcaggatgtcctctgtgactgctggggttcagggcagaatatgactgtgtcttttaccagccatagttacttgctgtgtacttccctaaggagactggcatttcagatctatttgatctttgtgtgctacatacttatggggtggaaggctaggaggtgaggtggggcagggagagagtgtatggggcagacaattagagcaccaaagaatatatgtgtagttcttgtaacgagattttctttctcatggccttgaaggtaaacttaaaagggttcccaaaatgtgtgtgtatctaactcacaagtattaccagtctctcttttatttcccattactcaagtataaatctatgtgcgaggtggctcatgcctgtaatcccagcactttgggaggctgaggtcagcagatcacttgaggtcaggagttcgagaccagcctggtcaacacagtgaaaccccatgtctaccaaaaatataaaaatgagccaggcgtggtgtcacatgcctgtaatcccagctactcgggaggctgaggcaggagaatcgcctgaacctgggaggcggaggttgtagtgagctacaatccctactgcactccaacctgggcaacaaagcaagactctgtctcaaaaaaaaaaaaaaaaaaattatgtgtgatggtcagggagaatatatgctaaaatatgacagtcacttctctggattcatatctcaagcttcattcctgactaccacttgctagctttgtgaccaacttacttcacctctgtaaacctcagtaaaataggaataaagttataccaacctcataaaaatgttgagacagggcctggtacataaaaagctcccagtaagagttattattgttgttgtcattacaacattacaacattacagttgctcttttgttttaagaaaaagcttagaggctgatcgcttgagaccagaagttcaagaccaacctgggcaatatagtgagaccctgtttctacggggggaaaaaatagctgaatttagtggtgtgtacctttagtcctagctactcaggaggcgaggtgggaggattgcttgagcttgagttcaacgctgctgtgagctatggtcatgccgctgaactccagtctgagtgacaaagcaagaccctgtctctaaaaagaaagaaaaggccagaaagccttagtagaattatttgtgagttgctcttttgcagcagttgtgagcctgaaataaataaccgaacacacatgataaaattgctttctattcctagctgggatttttttcagttacttccttagaattaacatttctcttagaaacttgaggtcaggaataatgagttttcagtagtccactatgattcgaaaaactaaagagtaaaaagtccatcattaaatgtactgagtgaataaaattacatgtattaccataaaaatgttttccttctggggggaggtaatcttcacacagccaagcccaccatgctagtagaaatgtatttgaagagaggatcttggtggagaattactattcaccataattttcattcttactgttttaattaacttttttcctttttggccttaaactctgcttgccctgtaagagcagagttctttctttccttctagagttttcatcatcttccagttgtgttcataggtataaacccaatatcagcaactcatccaacaacttgacttacctttaagcaataatatttgacagtttctcagacttgtttgccaagcagtggtatttctcatttctgagctaagtttataatctgaagattcatatcatcacattctcccacccctggggccttcaaaggaggagatgaaagaagaagggaccagctcttggtgtgcgggtcacagctggaaccgcacaagtccgtgcactctggggctgacaagcaggatgttcccttgtactgagaggaaacgaaattgaaaatgcaagtctgagctcatttctttctggtgacttgtgggtcgcttcagatgtttgcaaccttatcccaatgctgtgtgaagaaaggaggtcattgaaggaggccctggcttaggcatgtcctctggtgagtgattttgttcggttcagtttggtttttaaatacgagtgggtgaaggctttttcttttattttgagaaatgtggaaacaaaggctctttgatttaagacctcagacttcatgcatagagagagtaataatcacccaaatcataatatctgaccaaaattttcaggacttttggaatccccattcctggctttttaaaagttagacctgaaatccagaaggaagatttggacagtcagggatgacaatagctgtattctgagtgcatgcagccttttctcgggttctttgggtgggaggaattgcagattcttttctctgcctcctgtcagcacggctcgccacagatgcccaagggaaatccatccggcctggaaaatccagaagcacagccaaggcatggcttgctttctctggaccacagagtggtataactatttatgataaataaacaggaaacaccaatttatgctttcccactcatgatgggactaaactagctagtttggagtgaaactctttgggcttccttgctgcttagtctaccttgcaatgctacagtcttgtgagcaccaccattgcagagatgaacagtttttttccttctgagctcctctgggtatgcaccgcctgggatgatggaagggcttgtggatctgcctagtccataaaagttaaagcaagcaggtttacctgcttttctcagcgtgggctaataatatttacaagaaaacttttctggtttgttttatattttaaaattaatttgtgctgattgtagaaaaaaatgtaaaaagaatcaaaagtgattcataatcctactcccccaggaataaccacctttctagattttctccatgcccataggttcatggaagccaatattgggttgatacttgcattcgtttctattgctgctatgacaaattaccacaaatatagtagcttaaaaaatatgcatttagccaggcacagtggctcatgcctgtaatgccagcactttgggaagctgaggctagagaatctcttgagcccaggagttcaagccctgggcaacatagtgagaccttgtctctaataataataatttttaaaaatacacatgcattatcttacagctttagaaggcagaagtctgaaattcatctgctatggatgactatctgaccaaaataattttcagaacttttggaatccccattcttggctttttaaaagttagacctgaaatccaaaaggaggattgagaccagcctggtctcaattgagacccctgtcccgcaaattcgtatactgaagtcttaaccctcagtgtggtggtgtttggaggtgggccctttgggatataattaggtttacatgaagtcacagagtggagccctcatgacaggatcaatgcccttgtaagaagagatatcagacagcttctctccccaccatgtgtggacacagcaagagggcagctgtctgcaatccagggagagagccttcagcagaaaccgaccattctggcacctcgatcttggacttccagactctaaagttgtgagaaaataagtgcgtgttgttcaaaccatccagtctatggtattttatggcagctcaaacaaacctaagactgggctaaaatcaaggtgtcagtgggtagtgttccttctagtggctctggggaagagttcactttcttccctctttcgttctgtatgctgcctacattccttggctcatggccccttcctccatcttcaaggccagcagtgcagcatcttcagatctctctctctctctcgctgaccctcctagttccctcctacaattacatcagacccaactggatatttcaggatagctttcccatctcaagtacctaaacttaatcacaactgcaaagttctttttacctctaaagcaacgtattacaggttttggggattaggacttggacattgttggtgaggccattgttctgcccaccacaggaggcaacatatagtgttcatcttatgctgattgagtgtctgccatgtgctatgcacttttgctttctttcacacagttaagaagtggtgaactaggatttgaacccaggcagtctggctctcccgcctgcactcttgaactcctgcaatatatctacttctgcagtctgctttttctcttaatatagtttgaatattttctcatgaccttaaccattcctctaagtttgagagtctaaaacatcatttataatggctaactaatacttcattgcctaaatgagccatagctaacttaaccattcttcaataggaagatatcttggtgtagttaaaaaaaacacagtgctgaacgttcttgtacatgagctgtgtgcccatacttacttattaaatgaacttgggccagaaaagttccctggaagctggttaactactgtacattagacaacagtatttcctaaactgtttttcttcttttttccccttctgtattcatttacttactttaaaatttttttccccttctgtattcatttacttacttttaaaatgaggtctcactatgttaaccaggctggtctcaaactcctgagctcaagtgatcctctgacctcagcctcctgaagtgctgggattacaggcatgagcctctgcacctggctttttttcttgaggcacttaatagattctatgaagtgaggttttctggttaactaaacttaagaaatgctgcactcccattcctgaattagagcttcacaatcatattagcactaaaaccagaagtcctctggtaaacaaatccctctctccctccttgttttctttaacccagagtttcccaagcttaatttgaccaaagatttttttctttgaggcatcaagtaactatcctacaaagctaaggtcacaggacacaatgttagaaacacatctttggagtcaaccaagtgaagccacttaccctcaaactccttcaaaggcttaagtctaaaattactccagatggaatagtttgaatatgatcacgtttatgaaataaacttaaacgtttcctatcctccactcggaatttcagtctaacattgttgtagtggttccttacgttccttatagaggtcacattatacctgttccctgctctgtaaatgtcagggctggccatcagccaagaccaatacggacctgccctgaggtctacatggcactgtgtgttcatgttgttgtttaaggatagtgaccgatgtccttcaagagagccgttctggccgggcacagtggctcatgcctgtaatcccagcactttgggtggctgagacagactgatcacttgaggtcaggagttcgagaccagcctggccaacatggtaaaaccctgtctctagtaaaaatacaaaaattagccaggcatagtggtgggtgcctgtaatcccagctactcaggaggctgaggcaggagaatcgcttgaacctgggaggcagaggttgcaatgaacccagatcactgcactccagcctgggcaacagagcaagactccatttcaaaaaaatgaaagaaaaaaaagtgttctatagagtgttcagtgcaggtgaggaactggatggcaggatgttctcattgaaaatggggcagatttcaggcatcacaagctattgaatcattacaggtgaataaaccaatagcagagcaaagtttgagggagtaagcaaagctggacctggggttactggggaagttctgggtgagatgcacactggatcagtgaaaaagaagcaccaaagataaccatcatggtttggggagtctaatggggcatgtcctcttggccaagggacttcaaggggccttatggggtcatgaaaaagaatgtgattgagctcccaggcctgtggcacagactatttgcatcacattcatttaatgatcttcaagacccaaacagtggtgctgtctgcagtgtccactattgggggaagagcatccggagtgctgtcaccgtcctaatggagaggacctctggctgcaaactctggacctctgaggaagttgtcaggtgtggaacaggtttctctccagccttttggcagcctgtgtgattcctaagatggcacccagaattctggtgcctggtttgaaccatacttggggaggatcatcagagatcacagggcccagcagaggagcctggctgagctagcttcccttgatactgaccagaatgatggccggaagtctggggatgaggcatagtgtcttctctctctggggacctgtgatagcctctcctaagggggtagatagaaccagaacatgggctcagttatccaaagcgaccattctcagcccccttgttcctggaagcccctgctccagaactgctaagccagcctttctttcctgctacttctctgacctctagtggctagaactggaaaaacttgctcaagggatgaaatcatcaataagcaggaaatgtctttgatgttaaatggctgtccacttctctatagtaatccttcaccctctttacaacattctttctgcatacatcccatcatttaattcagccatcatcaacactgggtttgggctccagactgtgactgtcactgtcttatgtaacttgggctggagttggcatctgagcctctgtggtcatgacatccaggtgtcacgacatccaccctaactacattccagggttgttgcaaggctcaaatgacatgaagcctacaaaagaagtggtatataaatccgcttgttactccaaagccattgagtctgtgattctgtaagcctaaaatgttttaattcatatattttggtgaaggcatttaagccctttcctctgattctctatgggagattctgtcccaatccataagcatttacttgtggttgttatatatatttcataatggacttactgattactcaacaaacatgaattgcctacctcgtgccatgtaccacagctactgctgggatctggcaatgatcagacaggcaaggctctaccctaatggagtttgcattcaaatgaattaaggggattcatagacaggtgaaacatacccccctgtcctcaggatgacattatagcttaattgagaagacaaaagcttcaatagccagataagatttaagtcagtatgtgaaaatggccttcacagaaatataaacaggagttccactgtgctgtgtgtgaaagggagaagctagaagcaatgaatataggctgtgctttctaggtgtttaactctggaagagtggctggtgggaagtgatctggacacttgagaggtcaactggaaaatgatgaaaattaacctggtaattggtgtctatttctggtcccagaagagatgcaaaaattttatgcagaatatgcatgaaattgttcatctcaccctatagtcacattattcttkgagattccaattaagtggtagctagaatcattagatgctttctgttctgaatattaaccttataaatattaactttgtcctcataataactatctgagggtaggtacccttatcatcatacccattttactgatgaggaaactaagatatcaaaagagtaagtaacttgcccaaagtgatttggctgccaagtcatggattcaagcccaaaccggctggctccagagcttacacgctcaccactgtgctatattgtttcttaagccttcaattaaaaagtcaatcggaattttcagagatacatactaagtgtgcaggagtgaggtgacctgaggtctgggattggtttaaaataattcagcaagtctaaggaaggaaggaagagccaattatgctaaaatcttgataaatgtttactctgggtgatgtttataatgtttataggggtcattatagcattccctaatttccgtaataaaaaataggaactgtttctagtgaacttggagattttgaaatacttattattgtactgttaatatcaaaagacttttcagttatctgggtaatttagatcaaagcaacaaatttcactgttattaatgtaatgtggccatgaaatgcagtgcccttttctgtatattaaaacctattttccacctaatccccaagtgtaacagctaaataccttaaaaaaaatcaagaagggtgtatcctgccaaacatatttgatagaatagcaaaacgtttgagttagaagagaccacaaagataacttcttccaaaattcccatttaaccgctatggcagttaaagctaggagaatttaagtgatcagcccacgattgaaatgggaatatgaaacgatgatctatagtcagtcacgtagccaagtactggaagagcaggagttaaaaacctgggtttcctggactccaggcctttgtatctctcatcagaaggaggttgtgccagtaaagggctaagcagcccatatggaaatgtggacaccaggcttcacttgtgattcctgctacatcaggcagttgccaagttagaagcctgggatgtaagatgaagaaaggtgagtccccttcggcttggaactggaagaggtcaaatggccctttcccctcccaaacggrgccatgcaagccccatttatcttgtgtgttttatccacattccttgttcacaggttttagccgcatcaaccacaaagggcataattggaaaaatcataattgttatacttgaagatacttctcagaagtgcatttggggctctgtgtcaataaacccaccccatgaagggccagaagccagggccaggcatttcttgggagggagggatggaaatggtcttggtgagggtgcgtagagtcaccacaccactgttgaattaatcactgacctcatctctccatcctgaggattcttggaggacattgcgagagctaaaatctcctcattcccaaggctggtgtgcaccttttccattgcctttgttggtgtacacttcttaaggtctgggaggcctcaaaccccaatgtttcaggaccccagcaggtgaggtaaatgaataaagctggccagtgtaagaccggggcaaactgagaagaacaaacttcatccttattcaaaggttttataacactgggctgtctgcacaaaaagcctgggcaggtcagcagacaattgacttcctctgctatagaggatagaccctggtgaggaaagcaggaggcctgggtaccatcactggctccctatgacttgagtacagccttcccttggcagagcctcaagcgctttcatctgttaagaagtgggtctgtgagtctccaaggtgccaccacctctgacagtctaattctgtgatctgtgatagaatacatatctcaaaacaactggagccactgtcggtctgtccaacatatatttgcaaaatgcgtgctgkgcctgtttgatctaactgactttttggaacttggtgtccttgagatctttggatgggtttgtgcattaaccttaagtgctttgatccctgtaatataataaaatggcctacacttaaccatcattctggtaccactctctgtgtcagaggttgttgctcttttatttgccrgttttctttctaaaagcagtcatgagcagacaagcttagaaagggtattytcttcgtgttgtttcagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtaagtttttcctcctttcctctttcacttctctgagyrcggccatcggtgtggcgtgtggcattccagttcaggcacaaatgtgtatgtcgttgtctggtcagcattagggttccagtatcagttttcatatatgtggtttcacatgcctggaactgggtttgggtttttgcctgtttcaaaaaaaaattgttgatcttgcagggagctggtcctttgctgccaagtatagctggagtcgaccagcaaggctagtgtgtaagatgtttggtgcatagaaagacagcatgcaagggccacgcagggagaaggttgcaagtgccctgaaatcatccctatgcacctgggagctgatttctaccattgcccagtagagattttatttctctagaaaaggatgaagatgctgttccttcaaagccgacactctaggcaatccctaacaatgttacagtgcttaaaagactgagtgtgtttggggctgttaacaagcccatgtgcatagcttgamagcaaagagccagtgaaaatgacagttgaaaaccacatggctactctgctacacccaagccctcggaactttgcacataacgttcaaattaactgtgaaggaagtcacatgctctgtggtttctttctccggttagagacataggaactgttgctctacacagtcccaggagcctggagatcagcctcagggttcatgccaacctcctgtgggtcttctggcaccagtctcttagcacatattgaagtcatcacctcctcccctgactgcacttaagtcacagatagcttgggttggttgaggatcctactgagtttacctgagacagtcctggcttatgcctgttgtggtgttgtggttattaatatccccttcaactcttttgttgttgttgttgttgttgttgttgagacagggtctgtctctgtcacccaggctggaatgcattgatgtaatcatggctcattgcagcctcgacctcctgggttcaggcaatcctcccgcctcagcctcctgaatagctgggaccacacgcgtatgccaccatacctggcttattttttaacttttttgtagaaaggaggtctcattatgttgctcagactgttcttcaactcctgagctcaagggatactcccaccccagcctcctaaagtgctgggattacagacatgagccactgcacccagcctgcctttcactcttgaaagtgtcccagtttgggtgataaaccatctggtcaccttaaacttgaatgctatgaagttcacagtaagaattccctgctgttttattgccttttatatcctarctggctaagttaaaggatttctggagttgaagcccagatgctgaaagttgctttcaaaatatatggyggtaaagaaaggaagaaagcaaatggatatctggcagcctggcttctcacttggcatctcccaggctttcccttttgtttacacctgaactgcgtggagcactggctcagctgctgtattaggctgcagctattctactgggctcttcactgtattagacagtgggatgatgcccggccctgggtagctgctgcagacatttccactgctgaacctcactgtaggggagccagcagctcctttcgtgagcctgcaggatttttccctggctactcagtcactttcaccagcccttctttgaagccccacttcaaaggataaagtttgccttaagaattttctgaaagttaaatcattttgaaacttggtgctctaggtgtctggtttcttttctcccagtgactctgctctatacatcagcagttttggtagaatttagccaagtgggtgccccacactctgatgtggatggggaagaacaagtagaaccacttagcatgtgacccacgcgagtgtttgctgaacacactctacttgtcacttgtgtatgtcttttgtgttggagtgcagatgatagggaaaaatactccatacagaagggtagaggcagttctcactcatttcgtaaaggcagagggctggaagctcttttgtgcacacgctgacactctggcagccacctaacaaatgccaaccaggttgagtttttcctctgcatgaatgaagctgcttggaatcagcgttttaatatgctgattgcccttcacttacaaatcaaagaggcagcctcctgtctctatattttccagtaaataaacattttgaaaaagaaagagacctaactaattaagctgttaatatccctggatcttggattcaaagccaaatgttttgcactgttattgctattacaacagaaccaagtttgctgttgttgaaaattcttaggatcaggacaaaatctaccaatccactatatgctcatttaagagacccaaatctaaaacaacaaattcagattgcttctaaagcaaagatatgatcatcagtcaggcttcaaatgagagccttctcctagcccttccaatttaggggaccttttctcctgtatctgtgtcaatcactggtgaatgtgttgaagtttacctgtagggatgaacaaacattcatttttttcctaaccaatctgtggccccttttccattttttctttttctttaataccagaaggatagtaatagagagcagatggattgctggggggatgagttgtgtaactggcttacctatccgtagaagcataaagttaattctcttaaaggtaaagtaattctggtctctagcctccatttacatacactattctcacagagaaacatggcttcttagactctccaccctctaagcacctcagtggctcacacctacacacccagcatctccccatgttatgcagcatcacccctggcacctccatttgccaatattttttccagtaagccacttggcagcattttggcatgccgttttggagatgataaaccacacctgagaatcaatgcctgtcgcgtgattagaacacaaccatgtgtttgcccatcgaaagtaacagttatttgtgaattgagcaaaaataattcttattttttattctttttaaggagaaggcagagttaaaaacaagacaggcgctgatcattggaatgtgtataaagtgtgatatgttagacacaatgatatcgaggagagtgaaagacagaaggagaaagatagaatgtagctacggctgaagttttgctgagtgagaaaaactgatctttgccatcaaaacaagttcagtgtyccccgagcccccatcrggggtgtggtggcctctggggtcctgtccacagggactcagctcagggccctgctctctccagttttccactttataaaaagtcatatgcagagaggcccctggcttatgggagtcagggagtggtgttatccaaaggttgtccccaaccagccatatttgttactagctcagaacttgagcaaagtactccctttagttgccacagtcttcacccacctgggctgatttctttgtcctgtatattggagtcaccaatgagtatctccagcctcacttattaatggacctcttggctaattctgagggcaggaggattaccatccccamccctacccacttacccaaggctgtttaccaacctatgcaaggcctttgtgtgaattaggaaaaaaaaccacccttgttcctctatgaagatatgaagatgcagccctgcaccagccacacatttggggggtagagtaggggactgggctttagtaccattcatccctttagtctgatgcttttgtgcagtgcacacaacacacacccagatgcagcaatcctattcatattgtgggtttctcttatctggaaatgttctcttatgtggaaatgtccacttatctgggtctcataccatttctgctcagtcatgcaattcataatggactagtgaatcctagtttcctaaagggcttcttgatgccttgcaaagcgactgcctccaaggtggggttgcccactcatggacctggaagacatttggatcagtgggcacaaatgatgggctatttggatgtttttccttcaggcatgaagaacccctctaggaaactctgattcattagtccatcctgagtgacatgactgtatttaggcaaacagtatttttccagccaattgtttccctaacctgacctgagcctcagaaagtgaagatgatgggtcattgagtcaatgatgctcatgaacatctcgagggtttgctttgcctttctcagttgaagggatgctgaccagagtccaaatcacagcctcctggatgttcagccccatctttacttttagcgcaggatctgccctcagtggggttttccagtgtgctckctctctctttctcatcccatgacttcattactgagaggtcatccaaccactctgtctcatcttagaacaagagaagacctcgtcggttttcctgggctacgtcaaagctgagagttcctggcacacattacccttccagaccaggacatgcattgagagttgtggccatactctcgctcagtgtgtgaaggaagcctatctgcctcctgtttccccagacgctacaggaagctcagtgatgccttgtgcttccctaactctctcttacgttctcactcgtaccctagtgaagatgcaaaggagagagaagagctcctgacttgtcagctcccagccattagcccaatcatgacagaactataattcctaagtgctacatataagaagcagtcagcaatcacagatgtgtgatcccacctaactagtctatggctatcaatgccccaaaccaataaatgctttaaatgccccaagcagtgtaaatgtacgctcattaccataattctggagagggatgtcccaaattggtcctgccatctcattttccatagtcaggccatttttttctgtactttgagtaagacttttagtcccctataggaactaaaggatcatttcagttcctaagtgctcatactaataatcctatataatcaccagaaattgctatcaaaggatgatcccactctcaggaacttacccaggcccccagggttctgacgagggaggctgtgtggtctccctaggcaagactacccttaggccggtttcagagaatctgcctccacaaaccaactgctgtgattaggatcttcttttaatggaacaacaggttacaagacggctttggggttcagagaagcctacgggaagagaaaaggctatttggctacagactctagcaaatccaaaatggcccccaacgaccttgctggtgggcagctgattgtgtacagaggggaaggaatcttgttaattcaaagtacagaaactgaaagcaacgttttgaattaacaaagtacggcttatctgatatttttattagtgaacaataggktatctagttgctgcaaagaatagacttataaataaactaatatcagatggagaaagttttggcatgggtgtagaatggcctcctggtatwacttcccctcccatcctcttctggtgtggtgcctgttcccggctagggggtgttctgtaagtgtgtcactgccatgtactaaccctggtcttttccctctctgccagtacacttctaagttactgtcttgcaaggtgacttccgaggtacttttcaatttgtttgtcttggtcttactgaatgcatgatccaggtgcatgctgttgtggtttgccatttcctgatgagttaaacgaaaatggcaagaaaaatgacttgtctccatatgtatttttttgtgcctgttctgaawtatgggactgcctcgaaatgttggagtccatgcaacagtgatatacaatggtgtggtttgctgtgctgtgctgtgggggcgagtgggagggtactggggaagaccttgcctgctcacgaatcttgaagacgtttggaccagaggacacaagtgatgggctattttggtttttaaagtttctttaggcattaatagcaagtatacttggcctggttggaaaacagtgcagctcatgcagattgagctatggattttcacccattctttgtttaccttaacataaagctagaaagctccattctatagatttaagatgaaccatcctaatctacagatttatcaaatgtaaaccatcctagacctccctccctccaatctttaaacgtgtatttttattttagaaactctaagccttgatttctccaaaagcctccttgtttaagagacaaggtcttactctgttgcccagggtggagtacagtggtgcaatcatagctcactgtagccttaacctcctgggctcaagcgatcctcctatctcagcctcccaaagagctggaactactggtgtgtgccactatgcccagctaatttatttttttatattttttttgtagggacgggggtctcgctatgttgcccaggctggtctcaaactcctggcctcaagtgatcctcctgcctcagcctcccaaagcattgaggttacaggtgtgagccactgttctcggtccccaaaagtcttctttccttttacacagatttcacaaatatatgtgctataaatatgtgtgctatgagaaggcataatatttttctcttttaatttttttctattttgtccattttttctttttgctgagaaagcacaatatttttcatatttttatttctgtattttattttgattttaaaagaattatttcaaatatacagaattctagagagaatcattcgttcattcatttaacaattttcaaggctctactatgtgtcaggcattgttctaggttccaagaatacagcagtcaacaaaacaagttcctgatatcatggaactggcattcagaataatataagataataaaataataaaacccacctacccagctttgtccattcttatcatttcatgatatttaatatttttaaaagaaattagtattgcaaatacaatttaagccctctcgtacttctcccagttccctcctcccttacaatctcgcagaggtaactatttttgagcttgttgttcatcatttccatgcatggttttatacttatactacaaatgtgtatatacataaacaacaccttatttttgcatgtttgaagacattctataagyggtaaatcatgttgcagtatcttctgctcctgactttgttctgtctgcattgttttgagatgtgtccttgttgatcactgtggctctggttcattctttataactgctgtatggtattccattgaatgaatatatcactatttattcaatcttctrttatggaaatgtagactatttccagtttttcttaccgttagaaataatgcttttatgaatgttattatacatgtctctttatgtacctatggaagaacctgtctctatatttaggagtagaagcactggctastagcctgatacatcctaacatttactagatattgtaaattatttttcaagttggttgcattaacctgtagcataataagttttttggtctctctatttagccaaagaattatatttaaatatagagctgacctgctgattatcagtaattttctttcataagatatcaaatgaatactgagaatatcattctgtaccttctttaacgtctaattgtggttctcatctggaggatggcagtttgagaattaggactaagcccgtctcccctttgagtccatttaaaacaatgaaaatctggtcaaatatatccaaggaagatagagttgggcccactctgtcttcaatttaaaagcaggttggaagatgaaatataaatattaatatgaatagggtgatattatttaacatatctgtcttttgtttcatatgtccaaattaaaattttctatattgattgctttcaaagttaagcaattcacttgaattccctaagcattagagagaaaaattaatattaaagggttgttgagagataattgttttttattccctaccagacctgaatgtgaatttgtgaaaacaataaaactttgtttatttatttagtttacttttttttttttttttttttgagacaccgtctcactctgtcacccaggctgaagtacagtggtgcgatctcagctcactgcagcctctgcctcccatgctcaggcgagtctcatgcctcaacctcctaagtagctgggactacaggtggcagccaccatgcccagctaatttttgtatttttagtagagacaggttttcactatgttggccaggctggtctcgaacacctagtctcaagcaatctgcctgccttggcctcccaaactgctgggattacaggcttgagccactgcacccagccacaataaaactttaaatcagatcgttttttgttttcccttttccatttccatggggagtgttgattgctcttctctggtgtgtctccttctggactccttacagccattgggcagccagatagtctggtggcctcaagcatcaactctgcacccagagtgcagagttcaaatcttggttttgccttctgctaactgggtaattctgggcaagttacttaacctccctgtgcttcaggttcttcatataaaaaatgggagtaataacagcataaatgtcatagactagtagtgaggattcaaacagtaacatcgtacttaggacatgagtatgacattattagagccccagagacatatgcctttttgcccagaaaataaaggaatgaactttagaaagtgaagttaatatgcagtaataaacaagtaataaaagctctaaatttgctagagattcacacacacacacacacacacacacacacacacacacacacacacgtctgaattaattacagaacagatactcattcaaataccttgatttttgaatcttctgaagaccagttgtggtgcagctttactcccagacacccctgggtcataagccttatgaacccaaagacagctttatatcaagattgccaggtatttcagtaaggatgtttattttcttgtctgtgccattactagaggctttagatttcactagaaatttattgtatggccatggtaagtgattgtatgaccatggtaaatgggcatacatactaggggaatgaattaagaaaagagagctcattgttggtataagtgaattactggggctcttgacaagtagatgtccaaacccaagctatactaaacgtttccataattatgagtattatttttctgcccattatacttttcgtcactaaactccatgagggaagggactattctatcctcaacacgaagcactgtgccttatacttggtaggaaactaataaatatgtgtaaattggattgatagatggcttgtaacaagagttcctaaagagcagagcaaactcaatttgctcaagttgtttgagaattaaaatagggtttaaataacaagacaaagaacattccaagaggatggggaccatagtttttagaactttagatttatttttagctttgatgtaaacctttctgtttgtatctgcaatctgaaaggcaaagagatgatccttttatacaatgtagagttctttataaaacgccctatttgtatgccacttcataatttatatatccctttcacatgatgatagaaataattattccatcatagtttgagagcttactatgtgctgggaactatactttacatacattgcctcattgatttatccgtccaactttatgctgtagtttttatgatccccattttacatggggatactgaagcacaggggtaagtgacttttccaaggtcatgaggatttgaagtagacctgcctggacttctgagtccacagtgccttctgagaaagcctgtgaagtggggtagctgtgttctccatgttatagataagaaatgtgagataaaagatgaacaacaaaggacaaaactggaaatagagcccaagacttccacgtgcagtccagtgctgtttttcagttccatgctaccacacattagactattagaaaatttctctatttaactatacagatttggaagcatgctttcctcctactaatttgttattcgtagatatctgtggatattgagtgagtgaccgtgatatgcttacatacaaaacacattatgcaaaacacacatggcttgtgtgcttaacaatgcatcattcattcagcaaacgtgactgaggaggaaaaggggaggcttcacagaggaagatatgttgaagctctgggtggtccattcctttgacaaaggtgcagagaagcaggttgagatggacccccgatctcccatctacccacaatctgcttatgtctgggctcccacctctgcctgtaactgyatctccttgcttctctggagttgccaactgtattagtccattttcatactgctatgaagaaataaccaagactgggtaatttataaagaaaaagaggtttaatggactcacagttccacatggctggggaggcctcacaatcatggcagaaggtgaaggaagatcaaaggcacgtcttacatggcagcaggcaagacagtgtgtkcaggggaactgccctttataaaaccatcaggtctggtgagacttattcactatcacgagaacagcatgggaaaactcgctcccacattgaattacctcctatgagtccctcctgctacacaaggggattatgggagctacaattcaagatgagatttgggtggagacacagccaatccatatcaccaacatcactgtcccttgcctaactgattatatttagaatgagcagtgccttcattgcagtttgcataatcaaccaatgttggctctactggacttttcttcaaaatcagaaactgtacatcctaagcaaatgccagaacaattggcaagaatgcctggacttgttttctgcatggtcatgaaatagaaccatttttcatatgttggcaacctaaatgccattaatctggaatctcttcttgatcaaactgaaactggaccagataggctgaagtctcctctcgggattccacagactgccctagtgaatgggaggaagggaggctctccctcagtggtggtgagcctacttgtccttagtgttgtcacctttcatttcattgattagcatgtggggtctgaagttgcatcagaatgctgagattgcttctattgatccaagaacttttttttttcatgtaatggcttttttagtttaattttgccaaagtaggtttttatactataaatatcatcatggcttatataggtttgcaaagcttgatggactgaatccacactggtcccattgtttggaattattttctggtttgcttgtttatgaagagactaagaccatctatagtgtgctgtctaatatggtaatcactagtcacatggagctattcaaattaaaattaattaaaatgaaataaaattaaatatttagcttctcagccacactagccctatttcaagtgctcaatagccacgtatggctagtggctaccatactggatagcagagatacgttttcatcattgcataaagttcaattggacagcactgatctgctgcgtgtagggatctgctttatctgaaaacttgatgcagaatcacggctagttcaaagaaacttgcagaacatttcatgaaaattaaatttctctatggtgaaaactaggggtcaagtagcagatgaatactggctgtgagatgaatgcataaccagaacctcccattcccctttttccagcgtctctcctatctcccagcagtgctttatcactttctcctctcaagytgayaaagagaaaggaagaaagaaacagagaagtcggtttatgttcataattaacatccatgaactctgcataattttttcccctctctttacaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactayttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcrttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaragtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgygcttcaygttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaataatggctgcttgtttgaccgtgagggaggttggaagactgggccaaacagtggcacgccagcgtcctacttggccgctactgtgtgacagcttctggttcctcatgtttgcaacaaaggaatcaatccgagctgagggggcactgctgcaccaggctgttcccacagcccccttttcaatgctgtccccagccaccctggctagatgccagaagctgcaagtgcctcttaaggacatagactcgaagccacagcaagagctggacaaacagcaggacgaacggtaaactccagccttgcctgtagcttttggctctaacctttagaatacattatgagcaccggccgggcgcggtcgctcacgcctgtaatcccagcactttgggaggccgagacgggcggatcacgaggtcaggagatcgagaccatcttggctaacacggtgaaaccccgtctctactaaaaatacaaaaaattagccgggtgcggtggcgggctcctgtagtcccagctgctcgagaggctgaggcaggagaatggcgtgaacccgggaggcggagcttgcagtgagccgagatcgcaccactgcactccagcctgggggacagagccagactccgtctcaaaaaaaaaaaaaaaaaaaaaaaaaaccacattctaagcacctgtatttggctctcctctgcaaggaatagctgatggctacatgttgacatgaaggactccttttgttgtattcaacataaagcccctttccccaaactcttactctggtttctttattttcctactcttcgactacccccaactctttttctttttctttttcttttctttctttttttcttttttctttttttttcttttttttttttttttgctagagctttattgtggtataatttacttaacaaaatttattcatttcaagagcatgcgaagaccacaagtttctcaggaagcgtcctcccttctacttcctccctcccgcttcagtctccggctgctccatcccatcaccgagccctgggcccctgacccctgaccatcagttttcctagtctttccctcggcccctcctcttcctggtacttcctttccagctgcctttttctctctctccgcatttgtaactcttccagcctttttctccccaggatttccaaccatatcttcctgttctgagcatctgggggtgttctgtggcacctgtcaggggtgatatctttcaacctctaagtggtgagagttctgaatttggaagtgggggcacccctttaaaaatttgatcaaagtctagtaacagtggataacacttgtgaatgtcactgagaatgtgacaggcactccaggctctccatgactatgatacatttatatttatatttatattgatttccattttacatagtaggaaactgcagccccgggaggttagtttttcaatgcatagcttgtaaatggtagtgcttgcatttgaaccccggctcttaactgctcttcccacagaagcacacattggcagcttcacatgcgtgtgaagtcgaaatgggcttgcaccatctccccgcactgtactgtccaggaaagaggctctcagggatcaaagccaaggctgtgataggagcccaagtctaggggaagagtgaggttttggtgggagcaacaaagaactttcttcctttggatgaactttctctgggctcttctcttcgagatcatctctcccaggagatggtgacagcagatggcccaggcatcgcagctgccaaaagaaaggacccaaaattgactgcaaatagggtgataaaaatgtgataaaattaaactgtggtgatggttgcacaattttatttttattttatttatttatttatttattatactttaagttttagggtacatgtgcacaatgtgcaggttagttacatatgtttacatgtgccatgctggggtgctgcacccattaactcgtcatttagcattaggtatatctcctaatgctatccctctcccctccccccaccccacaacagtccccagagtgtgatgttccccttcctgtgtccatgtgttctcactgttcaattcccacctatgagtgagaacatgcggtgtttggttttttgtccttgtgatagtttactgagaatgatgatttccaatttcatccatgtccctacaaaggacatgaactcatcattttttctggctgcatagtattccatggtgtatatgggttgctcaattttaaatgtactgagaatcatacacttgaaatgagtaaactttgttaagtaaattataccacaataaagttccagcaaaaaaaaaaaaaaaaagaaagaaagaaagaaagaaaagaaaaagagttggaggtagtagagggagtaggaaaataaagaaaccagagtaagagtttggggaaaggggctttatgttgaatacaacaaaaggagtccttcatgtcaacatgtagccatcagctctctcactaatgaggaataaagcttcctctccaggctgcctccaggaaccaggggcagtggtgctgtgaccacgtatggattcagtcctggtcctgtttccatccatcactactaacatctggaggcctcaggcagaggtagggatgagatttggcaggcaggcgtgctgggaaggaaggaactcaggccatgtgtgaaaaagcaagtctcctgcaatggtagaggagggtacaacactcacaatggaagttattttttgggatgctctaaccacaaaactaccaatgttaaaaggcattaaccctttacccagtagagggcagttatgcagggtctttgctctgtgatgtgtatctgtgggaagggatgggggcctgtgtccattacccaggctcatctcccctgttttgtatttgtgacagaggctgtcattgtgagacacacaaggccatgaggttactttggagcactgctcattttagttaggggattcctgggccatgagagggcagtgactatactcctccctacacggaactcacaccaaattcagaattgagctgctagggacatagagaacaaatgggaaattgaaaaggagaatgcaaaagattttaaatgtacaagatgacaccaagtgaaaaaatggggactcaggaaatacctggagatgccacatcggcaatttctaaatgttgcccaagcattcacatgctttctctgggagaaagaagagtatttgcatggtgcgcattgtttcatgttgcgaagacatggtgatctcaatgtcagttaaccttgatgggagagttatccaaactctggatggagagttctctttgttctaagttcaaagtgggtggactctggacaactggaatgagtctactgctacctgagacaagtaaaaacacaaatcagtttggtttttctctgtctgctcatgtatggaacattcagtctctgcagcggtcttcagctggttatatcaaagagcctctggtgagccctggctctcaaattggagtgagttctgcatcacctggagggcttgttacaaatctgggccccatttctgatctactgaatcagatctactgattctgggtcccatcccagaatttctgatcagtagatctggagcgaagccccagaattttctacctagctccctggagatgctgctgctgctggtccagggacctcctttgagaaccatcggtctagagtatgagaaatgaatatgtctgggcctgccacttatgtttgaaaatgggggaactgatacatgactgataagctgcaaacacagccacgtgtggttctggggtgttgtgaatatttgttgggggcttttgtgtgtttgtgcagcctaccgactcaccattttgtgggccttggtgaagcagaactttgactccacttagattctcgaacgaggcccctccaactgtggctaaacagattaagaagaaagtgggggaaagaggaaaatatctctgtatgttcagactttaatttcagggtaagatcaaggaattcatttgaccactggaagaagtttttattatgtgggctgatgcacaataacataagtttggacttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttaaccaggatggtctcgatctcctgacctcgtgatccgcccgcctcggcctcccaaagtgctgggattacaggcgtgagccaccgcgcccggccaagtttggacttaataacataaggaccaataacataagtttgtttgagtgacatggttacataatttgagatgagaagcaaagtaagaagttattcttatttggtcgagggcagcacatctcaattctgactccacattagaatcacccagagagttttaaaatttggattcagttgacatgggttggggtccaggtattaatatgctctaagagcatcccaggtgacccatatgcagcaagccttgagcaataccaccctgtgcagtggctctaacctgtgcttacattaggatcagctcaagtgattttaaaaatactagtgctggctgggtgtggtggctcatgcctgtaatcccagtactttaggagaccaaggcaggcggataacttgaggccaggagttcaataacagcctggtcaacatggtgaaaccccatctctactaaaaatacaaaaattagccaggtgtggtggcacatgcctgtaatcccacctacttgggaggctgaggcatgagacttgcctgaacccaggaggcggaggttgcagtgagccaagatcatgccactgccctccagcctgggcaacaaaatgagactgtctcaaaaatcaataaacagacaaaccagtgcttgggcctcagccccagatattctaatttatttaatctaaattggtctcagacatgagtgtgaacatgggtatggcggcacacgcttgtaatcccagctactcgtgaagctaaggcaggagaatggcttgaaccccggaggtggagtttgcagtgagccaagctcatgccactgcactccagcctgggcgagagagcgagactcttgtctcaaaaaaaaaagaaggaatataacatgtggtgaaataattgatcagcatacatcaaatacatataaaatacattaaatgaatgttaataggtggtgccataaaacaaaatatttaaatagataatacaggtaaatataaacaaacaaatgtatgcttgtattgctctgtcaccaggctggagtgcaatggcaccgtctcggctcattgcaatctctgcttcccaggttcaagtgattctcctgcctcagcttcctgagtagctgagactacagacgtgtgccaccacgcccagctaattttttagtatttttagtagagacggggtttcaccatgttggccaggctggtcttgaactcctgaccttgtgatccgcccacctcatcctcccaaagtgctgggattacaggcataagccactgcgcctggccgtttctttctttctttttttttttttttaagtctcacctggaagcaggcagctagttcctgcacagaggtctctggacaggaccctcaaatagactttacttttgcaaatgtctgcccatcctcacccgaccctccaaattcaaaggaaggatatgagctttccctgaggttctgcaggccacaggatgcatcctttgttgccctatgattgtttgactcatctgtcacctccacacctaagaatgctgggcactgggaggaatacagccaagattgggttttttttttctgtgccctgcagcctctggtgtttgccagtggctgacacacca

SEQ ID NO: 10718 - DNA, 76573 bp, Homo sapiens
  misc_feature (1)...(76573): n = A,T,C or G, or insertion/deletion polymorphism (see Tables 1-2)
ggaaaatgtgggaaagtttagaacttcctacagacttgctgaatggctttacccaaaatgttgatagcaatatggataataaggtccaggctgaggtggtctcagatggagatgagaaacttgttgggagctggagcaaaggtgactcttgtcatgttttagcaaagagactggtggcaatttgcccctgccctagagatttgtggaagtttgaacttgagagagatgattttgggtatttggctgaagaaatttctaagcagcaaagcattcaataggtgacttgggtgctattaaaggcattcagttttatcagggaagcagagcataaaagtttggaaaatttgcaacctgacaatgtgatagaaaagaaaaatccattttctgaggagaaattcaagctggctacagaaatttgcataagtaaccaggagccaaatgttaatccctaagataatggggaaattgtctccagggcatgtcagaggtcttcactgcagctcctcccatcacaggctggaggcctaggagaaagtggtttcgctcgcccagggaacccctgctgggtgcagcctagggacttggtgccctgcgtcccagctgctccagatgtggctaaaaggggccaatgcagagctcgggccatggcttcagagggggtaagcctcaagcctcagaagcttccacatggtgttgagcctgcaagtgcaccgaagtcaagaattggggtttggaaacctctacctagacttcagaagatgtatggaaacacctggatgtccaggcagaagtttgctgcagggatggggtgctcatggagaacctctgatagggcagtgcaggagggaaaagtggggttggaacccccacacagagtccctactggggcactgcctagtggagctgtgagaagagggccaccatcctccagactccagaatggtagatctaccaacagcttgcaccatttgcctggaaaagccacagacactcaataccagcctgtgaaagtagctgagaaggaggctgtactctgcaaagccacagggtcagagctgcccaagaccatgggaatgcacttcttgcatcagtgtgacctggatatgagaccagagtcaaaggagatcattttggagctttaaaatttaactgccctgctggatttcggarttgcatgggctctataacccctttgttttgtccagtttctccaatttggaacggttgtatttacccgatgtctgtatcctcattgtatctaggaagtaactagcttgcttttgattttacaggctcatgagtgaaagggacttgccttgtctcagatgaaactttggactgtggacttttggattaatgctgaaatgagttaagactttgggggaccgttgggaaggcatgattggttttgaaatgtgaggacatgagatttggaggggccaggagtggcattatatggtttggctgtgttcckacccaaatctcagcttgaattctatctcccagcatgtgttgtgggagtgacataggggaggtaattgaatcatgggagccagtctttcctgtgctattctcatgatagtgagtaagtctcaagagatctgatgggtttaccagaggtttcttttttgcttcttcctcattttctcttgctgctgccatgtaagaagtgccttttgcctcccacaatgattcagaggcctcccctgccatgcagaactgtaagtccaattaaacctctttttcttcacagtctcaggtatatctttatcagcagcatgaaaacagactaatacagtttccctcctaagaagaaagcggttttggacttctgtattttgttttgtttcataactatgtactttttttttaagaaataaaaaggtaagctctttactcatttttccctcctctttcttgccaagtcacaagggacccctaaatcctatatccagcattacttaagtaaagcctccaaatcagtcatatcagaacagtttcaagctaatgagattgttcacttactttatttggcaaagttttagttactgtttttttaacctatttcattaaacctgggacataggtcatattgtataaaattaaatggtccattaaagtactcccccatcagaaaattttttaaagtacagttatttcttctgatacaacttgggatgtgaaaaacatcctaatggacatgcagtgcaactcagcctttatgtgtgatctccagatacctaaagaaattgcccatttaaattaagatttgacagtttttactgagtcatctttctaatataattatgcccctgcttccatttattctttttggagttacatttttcttttatccatatgtatgtatccatacttatgttaaaaacttagaaatttcagaaaagataccaagataaattttttggatatttctttcttttttttttttttttttttttttttttgagaccgagtttcactcctattgcccaggctggagtgcagtggtgcgatctcagctcactgcaacctccaccttccagtttcaagtgattctcctgcctcagcctcccgagtatctgggattacaggcacccgccatcacgcccggataatttttgtatttttagtagagacagggtttcaccatattggccaggctggtctcgaactcctaaactcatgatccgcccacctcagcctcccaaagtgctgggattacaggcatgagccaccrcgcctggccttttggatatttcttttcagcctttattctgagtaagttttcttgctttaggttttggttttgtaaaacaatgcaaaatactgtttttgtttttcttttaactatattaacataagtgtttttatattaatacaaattcttcaaaaatgttatttaatagttacaaatattccactaaataaaattactatgatgattttatatttccccttcatcacagtagacaagcataaaaatgataacaaaattatccaatcctccaagtcctacaaaaataatttattagggactctttatagtcttaaattttcaatgtctttacccaaacagaatataagacttcacgttagagaaaaaaaaacataaatgtcagaagtctctagcacaaagtattaaaacacagtgctttttcaatgatcaaacgtttggaatctattaactgatttttaaagaagttacactagcattacaagagaaatacaaataatggcctctatgctattatctttttttaaaaaaatggatcaaaagacatgggtggattccatagggatgtttgcaagtaaaattctttgggaataaccgtctcgaggatgttcgagtaccaaacttactaccttattctcagcataaaataaatattttcttaaagcaactttaaaataggaataaacattttggagaagttaaaagagaaggaatggctttccacttaattcataccttccctgaaacaggtttagtatgaactccagactactgatgtttgttcaaagtctctattagaattttgctgtccaactgagattgtactcctatagtcaatcaaattataatcataaatagtaccaaataggagtatatcttggcctatccacatttttctgctctatttggaggcatgcataatttaggaaagcttgaattcagtgacaatcctcctttccaaaaccaataggattagaaattctcttctatgttgaacattgtttaattaaggagcagcataacctattggcaaatgactattataaggcaaatcctataccataaccaaaactattgtttgaaaatactaagttataatactaagtatactcatctattgagtcaattaatgtatttgtctagggatatatttcgcagctgaggtagaataccatgaagatgcagagttgtttttaaaatgatattctctgatgcatttactacaaacaaggtcacccgctgatagttatatcattttctttatgttctttggttcacaactcagatgcttgagctgactcaaaattcctttttcaggaaaatatgggtcctaacaataaatttaacaagtagaagaaaatgactttcatatgtatagaaataaaaggcaggctctcctgtgtgcaatttggttgcttttaattctaaaaatatcaagaacccaaaattgtttgcaataagctatacagaagtcttatctccaagtctcaccagaatattgtttcacatcagctatctaattactatcctacacacaattaaagcaccaatggtcctctctaaggtattaaagagagatggtcagagataccttgctactcacgtgtgttctgtagatgagcagcatcaacattacctgggaacacgttaataaatgcagatctcagaacccaggtcagacccactgaatcagaatcttttacatagattccccaggtgactcctgggaatattaaagtttgagaagcacattgactaaatcagttatgttcttcctcagttgcacattagagtaacctggagagcattattaaaaagatgtctgattcccacccaatgaagtatagttaaaaaaaaatacacgggatttaaaatcagaaaactcagatttaaatagcagctcactcacacttactctaattttatataaatttcatctttcaagatttcatttccctcagagaattatagtgatgataaaatgagtaatgtgtgtgatcatatttgtaaactataaaatcctaaaccaatgctattgttaatgatttgtatggtataaacccaaataaatacgtctgttgatcagattaaagtatgctctctctgatgttaatttttcaaagtggtctttgtggatcaattgtatcagtaataaccgacacttgttttaaaatgcaaagagctcttcccttcctcagacctcatgctcaatctcaggaaggggaatacagaagtttgcatatttaatgacctagcaatgtagcgcaattgctttatgagctaaaagaggaatcccataagctaaactcattcctgttaccactattccagctagtactagcatagttgttggacctccaacttctatgacctcttactttacataatatgggaccattcgtttaactcacatactgtgtccttttctggattagtcatactctaggtatgaaaaagtacatggaaaggactaattgaacaactgagtttgagttgattctcataagtctatgagtactcataagttgacaaaaactcctttttgtcacatgcttagtggtgtatctagtgaccctcttggggaacagaatacagatcatcccaacactccttgtttcccacctatatttatgccatggcaatccctccttcctggatatcgggcttacgtcctttttactccctctatcctaataaacttcctatcagagggaaaaaaactctctttcacagattgtattatacaaatgtctatcttctattccatggggtccacggagtgtgtgctcctagcagtgatggcatatgataactgtgtggtcatcagcaaattcctgagataccctctcatcataaataaggtgccttggctgggcgcagtggctcatgcctgtaatcccagcactctgggagtccaaggctggtggatcaccggaggtcaggagttcaaaaccagcttggccaacatgatgaaaccccatctctactaaaaatacaaaaaattagccctgtgcagtggtgggcaccggtaatcccagctacttgggaggctgaggcaggagaattgcttgaacctgggaggccgaggttgcaatgagccaatatcatgccactgcactccagtctgggcaacaagagcgaaactccacctcaaaaataatataaaataaaataaaataaaaaaggtgctttgtgttttcatggctactgtctcttatgaattaggatttctcaacagacaaaatgtattaatagttacatatgaatgcacttttgtggaaaacacatcattaatcatttttataaaatattacagttaatgcctctggcttgcatagatatttccttgaatgagaatataataatattgggcaaagtaaacttttcatttactttattactaccatttcagttctttatattcagttttttatattttcaccatctatgctgtattgaaatcaattcagctgaaggaaggaaaaaggtctcttccacctgttcagcccacataacagtggtgattgtgtttcaccggacaatcctcttcatgtacataaagtcaacatctaatggcactacttcagagaaactggttgacctgttctgcggggtagtaatgctcatgctcaatcttatcatctatagcctggggaatatggaggtgcttggggttatgaagaaattgatcagtatgagtagamcctggtgctggaaaaatgatgagaacctgacatctttgagttcatgtacaaaataagctcacatattttgaggcaagaattttaaatataaatagaacagaagaaatgacgattatgtctagaaacaaaatttcagcattagaaagaaatttcaacattaataatctaatatttatctttaagaaaatgaccatgacctcataaaaatacagagacaagtaatctaagaagtacatgtaaagttatgggagtcagacaaaaaatatttataattaagcctttccaagaaaagacaacataagtccttaacaaataaaatatatttgtcagccctctttggaataccttttatatatttatytgtttatgcttatttgtttttttacccagggaccttatctggccctcacctacatttctagctacatacttcacccttttctgtccatacccatgttgcctccatccccctttccacatactgtgttccattctctatgtatttacacaattatttcaagctctttcacacctaagtgcaacagtacatgctacttcctctgcatgataacatttctccttcttctctggtaaaatctcagaagagatgggcaaagtgtcatatcctctgcaaagctttccaatactgtcattaaaacagtaaaaacaggccaggtgcagtagctcacacctgtaatcccagcactttgggaagccgaggcgggcagctcacgaggtcaagagataaagatcatcctggccaacatggtgaaaccctgtctctactaaaaatacaaaaattagctgggtatggtggtgcgctcctgtagtcccagctactcaggacgctgaggcaggagaatcacttgaacccgggaggtggaggctgcagtgagctgagatcgtgccagtgcactccagcctggcaacacagtgagactccatctcaaaaaaacgaaaaaaaaaaaaaaacagcaattacttttgcaccaacctaatacttattccctcttctatgctacccagacctttacttctgctacagtggtctttcttttatgctataaccatttgttagtttctgaaatcttctcaatggcaggaccrtggctcactgttctctttatgaagtccaatgccatgttaatttaaaatagtaggcagcaataaactgctgaatgaactaattaattaaaattttaaaagaacagtaaaaataaaagtccaagtattcaaactaaaagaaatgaactttatatattatttcatcccccaaaccacaactccaaatacttttggtataatatcagataatccttttgttgttgttctttgagacagggtctccctctgtcacccaggctggagtgcagtgatgcaatccgggctcactgaagcctccacctcctaggcttaagtgatcctcccacctcagcctcccaagtagctgggagtacaagcatgcaccaccatgcccagactttttttttttttagtagaggcgggattttgccactttgcccaggatggtctggaactcctgagctcaagtgatccacacgccttggcctcccaaactgctgagattataggcataagctactgcacctggcctcagatcatcttttaggggaaaccaggggaaaaaagatcgaataaaatatactgcagaggtcactgggttgagtaagacaaaaaagcatatcagtatacattattctctgataatcaactgacacgagattacygtcgatgactaaacttctttgaaagagcactaattctttctctctggttcagaaacaataaataactttattctaaatattttccccctataaaaattttaccctgggtagatagtgagttataattatgcaataatgttgcctaagatgttatcactattcttgtctgtatgtttgccccaattctgtactacaaactcatattcaatttttaagaacaaattttaaagtaattgcaaatattgggtgatgatttttagagtatatgctaaaacactttggagtaatgtttctgtatttagcaggaaattcagtttgcagcatatatggaaaaaccccgactcaattcaaaaaaatcagaagcaaaattctaatactccctcagaggaatgtcagcataggtagcaggaaaaacaactattcttttttttttttttttttttttttgagacggagtctcgctgtgtcgcccaggctggagtgcagtggcacgatctcggctcactgcaagctccgcctcccgggttcacgccattctcccgcctcagcctcctgagtagctgggactacaggcgcccaccaccacgacccgctgattttttgtatttttagtagagacggggtttcaccgtgttagccaggatggtctctatctcctgacctcgtgatccgcccgcctcggcctcccaaagtgctgggattacaggcgtgagccaaggcatgcggccaaaaaacaactattcttaaactttataacaatttctctcttgctctcctgtcttcctgaaatatctcttaaaagaaattatttcatttctctctytttttttttttttttttttttttttttgagatggaggctcgctctgtcgcccaggctggagtgcagcggcgtgatctcggctcgctgcaacctctgcctagcggattcaagcgattctcctgcctcagcctcctgagtagctgggattacgggcacacaccaccatgccctgctaattttttgtattttttagtagacatggggtttcaccatgttggccaggctggtcacgaactcctgacctcaggtgatctaccagcctcagcctcccagagtgctgggattacaggcgtgagccaccgctcccggccgttacttcatttcttaaacttgcacatttattgcagacagagaaggttttaaatcctacagccacttattacatgtacaaagtcttgtggcttttgcagtttggcgagcaggagggaatagtgcgcggcggctttttctcccctgttgcttgggtgagcaggagggagggttacagtgttgcaggatcccttcagtgccgtttcgccaaccagaaatctctgtggccgccctgagctctgccgggggcctcactcgggtcctccggactcgctccgcccgctcggcccggaaggctgtgttcaactagtgccaccagcccggatcccacaccagccgtggctccacgctcagcctgcggctggactcagcgtgccacagcagcttccgtgttgggcactggcgtctagacgaggtggtggcacccgaaaacttggagatgccagcaaccgcagacccccaagggatgttacagcttttgctctgggagtcccgaggtctgagcccccaggaaatgttacagctctctctggttctgccgcctgcagctcagtgaacacgggcatgttacagcttgttcattccccaasctcgcagcctcagtgagatccgggttcctgtcccacaatcaagaagaataaggtgcgtggacaccggagagtgagtaaggcagagaatttatttagcaacagaaagaaagctctcagggccgggcgctgtggctcacgcctgtaatcccagcactttgggaggccaaggcgcgcagatcacctgaggtcaggagttcaagaccagcctggccaacatggggaaaccctgtctctactaaaaatacaaaaattagccaggcgtggtggcaggcgcctgtaatcccagctactygggaggttgaggcaggagaatcgcttgaccctgggaggcggaggttgcagtgagccaagatcgcgccattgcactccagcctgagcgacgagagtgaaactcttctcaaaaaaaaaaaaaaaaaaaagctgtcagcaaacaggggacccaagagtgggtcgccgtctgtctggctgagtctggctggtttttatgggctcagaatggcgaagtgggtgctgatggggtccatgcgtggtcttggaaaaagcaccattcaattggttaaaaggcattgaggaagttctcacaccggtggtggactctatccatccagcatatccgtcttcaggcttcaggctgtctttggcttgaaggtcggctttcaccagggactcatccctgtctgtgtaagaatttgtctgtcctctgtcactatcactctgagcctaaaactccttatttgtaaaatgtcagtaatgtctgttacagagttctctcaaactaatgcttgagggtagggactgtatcctatccagcatttagtttccagcactagcagaaggacaggcacattcccaatgctgaataaataagacaaaaatttaatcaacaaaaatgaagacaatcatatgttatactgtccatcatcattaattaatttttaaaaaatttaaatagcatatgtaggataccttgcatatgctttgtattcctttaaatggtgctgaaaaagaaatgtctggtcccaatttaaaagtagttaaataagaatctctggagattagacttcagaatcagtacattttttagtttgccagatgattctaattaaaagccagattggcaatcactaatcaaactgcctgttatttaaggcttttccacactttggaaccatggcatatgttacactccctgcattgtcatatttcatcttctctgatgaaatgtttcaccctctagggagtcttccaaaactgccccagagtaatcaaagccttcctctctkcagtccttgccactttcccatactgtagtgcttagctattatattgtaatcatttgagaccttctcaaagtttcccaatggcaggaaacatggttctatgttttaaagagagagacggagagatgcccaatgcccaataaaataaaaatactaggaagttaataaatgaacatatggaagaaaaaattaaaaggataataaaaattcagtccaagaaacacatgtaacacatggaataaaagagaatgggagagtaacntcagcaggatggccaactagacgtgcctaattatcattcctaccacagaaagggaccaagacaatgaataaacaactacatttcaacaagaatgattaaaagagcgtgccggagtacatcaaggaagtggtagaaactttataaaacacagaaactcaggctgactgcatagaaaagggaacaaaacaccctgcctctgccacctcatctgcccatatgggatcagctggaaaccaggagggacttctctgccgggaaaaggtaagcaggaagcctgcagcaactcccattaccaccactgcagtctttgctatgagaaaatcctacagtcctcatggagcctgaacccaatttaagggagctgcctggaattcaattctactccagcaaacaagcccatgttgtgccccaccccacccaccctcgtgtcccaagctgccactggacttgccatcttgaaatggaagccactgcctctgggggtcagtaggcactgcacctctccatttctgagtctccaccatcactgcaccatgctcacacatggtagtacgccatttatcagctgggctcaccaacccctggaaacaggctgcmtaggagacactccatcttccccatttcagtggctgctgcactccactcctgactattcaaagccttggcatcccatccccaggaaagcagtgcctgagccagcagagttgccatgacccaccagcatgtaaaccagccttgtgcccctctgctggggaagccacatccaacgtggtgaagcagttctgcagccttggtgcccaagccaacctgatgcctcaagcccagaaaactagagctatggcccaggaaagcagctgcaattgcagtgcccaagcccacacagtaccctgcctcttggggaccaggctccccagcccagtagagaacccacacccaagccagcagagcagtcatgccttctcagcacctgcaccagcctggtacctcgaccccagaggactggagctttggctcagggaagcaactttgaccctgtacctgagcccctgtrgcaccctgctccttagggaccaggcactccagcacggctaagaaactgcacccaagccagcagagcagtcaagcctcctcagcgccctgaaccagcccagtgcctcagccccaggggaatggagctttagcccaggagaacagctgcaaacttgatgcatgagcccagcccccaagsgaaacataactttggctgacctgtatcacccccaccttagggctgaacaaccacagtgccctacctcaatggatctggaccagccctccaaagtctgtgctgctgaggtgcaccatctccctggagaataaagacaacattgcactgctcctcatccatggagctgaagccacagctgctccacacaactccttgctgccaagaaatgggcccttgttgctactgtattcagctccacagagcctaacccctgctgtgtcgcaccattacaggatccacagtcaccactatgcagtaccctctctcttggtgtccaagttgccactgtggcctcttgtctccagaattcaaattacagattgccttgctccccaaatgtgagcctctggaacacaccttcatccctggaaccatgccagccctatactctgatccccagaatcagagtcacagctatatccctaccccawgaaaccaaactgctggggagtgtctcatagtcacagtccttggcttgatggaaaagcttcagccacccatgcctaagagagtaaacctgcacccatgtcacaggttcaacagtagttcaacaagacacaatccacagccactccaaccacctgtgtggtgaaacacagccttgttgtgrcttccagtggccartgtcagataacacatcaagagagatcccctaagctaagtctccccactgtgaagaaaatgaaaacacgaagatctctaaagcctttgccaccaagaaccctaacattytaccttgccaccactgctgccagtttcctgcagcctaggccactaaggtacctacagtcatcactgacattgattatagctgaaaaaacctcatggagactacagtactatgcccacccagacccacactytacccaawtgacagtcaacacactctatccaattgacacaataagacccatcttcaagggaaagtcttcccctataaaagctattgtataaaattaaaaggcaactgtttcatcagatacacagagatcaatacagggacacaagaaacatgaaaaaaaaaaaaaagaaggaaacatgacaccaccaaaggaaaacaatatttctccagtggctgaccgcaaaagaaatggaaatatataagctgcctaaaaagaaattcaaaacaattttcttaaggaaactcagtgagatcaagagaacacagaagacaagtcaatgaaatcaggaaaacagtttgtgatctacatgagaaattcaacaaaaatatagatttaaaaaaaaaaagaaccaaacagaaatctagaagctgaataagtcaatgaataaaataaaaaatctaatttagagcttcaacagcagactagatgaagctgaagaaataatttctgaacctgaagacaggtcttttgaaataatccagttggggaaggggagaaagaatgaaaaaacatgaaaaaaatcctccttatgggactatggagcgccattaagcaaacaaatactgcattgtgagaagaaattgagaaaggcacagaaaggttatttaacaaaataattgctaaaaactgagtctcggtagagatatacacattcagatctgtaatacatgtaygcaattcaataaatgtgatgcctcatatgaacagaatgaaggacaaaaaactgtgattatgttaattgatgccaaaaatcatttgataaaattttacattccttaataacaaaatctctcaaaagagtcatatacaacagatccacagctagtattatgtcgaatgaggacaaactgaaagctttccctgtaaggtctgaaacaagataaagatgcccactttcaccaatttcatttaacatggtactagaagtcctatccagagcaattagacatgggaaacaaatagagagcaacaaaataggaaaggaataagtcaaagtttccttcttagcagatgacataatcttatatttagaaaaacctaaagatgttatcaagaaattcttacaactgataaacaaattcagtaaagtttcagaatacaaaattaacatgaaaaaaatcagtaaaatttccatatgccagcagtgaaaaatctgaaaaataaattaagaacgcaatcctatttacaatagctgcaaaatatataaaatatatagggataaacttaaagaagtaaaatagctctataatgaaaactataaaacattgatagaagaaattgaagaggacacaaaaaatagaaaaatatttcatattcatggattggaagaatcaatattgttaaaatcttcatactacacaaaatcatctacagatgcaattcctatcaaaataccaatgtcattcttcaaagaaatagaagaaacaatcctaagcttcacatggaactacaaaagaactagaatgatcaaagcaaccctgagcwaaagaacaaagccataggcatcactctacctgatttcaaattatattacaaagttatagtaaccaaaacagcatggtactggcataaaaacagacatgaagaccaatggaacagaacagagaacccataaatcacacatttacagtcaactcattttatctgaataggcatttttcaaaagatatacacatggccatcaggtatatgaaaaaatgctcaacctcactaatcatcacgggaatgcaaattaaagacacgataaaaaattattccagttaaaatggctgtcatcaaaagacaaaaacaatacatgctgacaaggctgcagagaaagaggatctcttgtatactgtttgtgagaatgtaaagtagtacagccattatggaaaacagtatgaaggctcctcaaacaaataaaaatggagcttctatatgattcagcaattccatacctggatatatatcaggtatatatccaaaataaaggaaatcaacatactgaaaaaaaatctgcactcccacgtttattgcagtaccaatcgcaatagccaagatacggactcaacctacgtgttcattgataaattaatggataagaaactgtagtatacactggccccacagaaatacaaacaaccattagagaatattatgaacactttctgcacacaaactagaaaatctagaagaaatggatacattcctagacacatacaccctctgaagactgaaccaggaagaaattgaatccctgaacagaccaataataagctctgaaattgagtcagaaatagtctaccaacataaaaaaagcccaggaccaaacagacttagagctgaattctacaagatgtacaaagaatagctggtaccattcctgctgaaactattccaaaaaattgaggaggatggacacctccataactcattctaagaggccagcatcatcctgatagcaaaacctggcagagacacaacaaaaaaagaaaacttcgggtcaatacccttgatgaacatcaatgtacacatcctcaacaaaatacttgcataccaaatccagcagcacatcaaaaagcttatccaccacaatcaactaggctttatccctaggatgcaaggttggtttgacacatgcaaataaataaatgtgattcatcacataaatgaatttgacaccccttcacattaaaaactctcaataaactaggtattgaaggaacacacctcaaaataataagagctgtctatgacaaacccacggccaacattatactgaatgagcaaaagctggaagcattccccttgaaaaccagcacaatacaagcatgccctccctcaccactcctattcaacatagtactggaagtcctggccggccagggcaatcaagcaagagaaataaataaagggtatccaaataggaaaagaggaagtcaaactgagaggtgaagccagctgggcttctgggtcgggtggggactttgagaacttttgtgtctagctaaaggtttgtaaacgcaccaatcagcactctgtaaaaacccaccagtcagcactcggtgtctagctaaaggtttgtaaatgcaccaattagcattctagaaaaggaccaatcagcactctgtaaaatggaccaatcagcgctctgtaaaatggaccaatcggcaggatgtgggtggggccaaataagggaataaaagctggctaccccagccagcagcggcaacccgctggggctcccttccgctctgtggaagctttgttctttcgctcttcacaataaatcttgctgctgctcactctttgggttcacactaccttttatgagctgtaactctcactgtgaaggtctgtggcttcactcctgaagtcagcaagaccacaaacccaccagaaggaagaaactccagacacatctgaacatcagaaggaacaaactccggacacaccatctttaagaactgtaaccctcaccacgagggtccagaaggaagaaactccagacatatctgaacatcagaaggaacaaactccggacacaccatctttaaaaactgtaacactcaccacgagggtctgcagcttrattcttgaagtcagtgagaccaagaacccaccagaaggaaccaattccagacacaaaactatccctgtttgcagacaacatgattctatatctagaaaaccccatagtctcaacccaaaacattcttaagctgataaacaacttcagcaaagtctcaagatacaaaatcaatgtgtaaatatcactaacattcgtacacaccaattccagtcaagccaaagccaaatcaggactcattcccattcacaaatgccaaaaaaagaataaaatacctaagaatacatctaaccaggaaggttaaagatctctataagaagaattacaaaacactgctcaaagaaatcagagaagacacaaacaaatgggaaaacactccatgttcatgaataggaagaatcaatatcataaaatggccatattgcccaaagtaatttatagattcaatgctattcctgttaaactaccattgagattcttcacagaactgaaaaaaaaaaaaaaactactttaaagttcatatggaaccaaaaaagagcctgaatagccaaggcaatcctaagcaaaaataacaaagctgaaggcattgtactacctgacttcagactatactaccgggctatagcaacgaaaacagcatggtaagggtatgaaaacagacctatagaccaatggaacagaagagggagcccagaaatgaggctgcacacctatagctatctgatcttcaacaaacctgacaaaaacaagcaatggggaaaagattcactattcaataaatggtgttgggataaccagcgagccatatgcagaagattgaaactggacccctttcttatatcatatacaaaaaattaactcaagatggattagagacttaaatgtaaagcacgaaactataaaagctctggaagaaaacctagrcaatactattcaggacacaggccacaggcacaggcaaagatttcgttacaaagatgccaaaagcaattgcaacacaagcaaaaattgacaaatgggatctaattaaactaaagagctactgcacagcaaaacaaaattatatatataaacatatataaaattatatacataataaaattatatatatattatatatgtatatataaacagagtgaacagacagcctgcagaatgggagaaaatttttgcaaactatgcaactgacaaaggtctaatatctagtatctataagaaacttaaatttacgagaaaaaagaaaaaaccccatgaaaaagtggacaaaggacatgaacagacacttttcaaaagaatatatacatatggccaacaatcatgaaaaagatgctcaacatcactgattattggagaaatacaaatcaaaatcacaatgaggtaccatcccacaccagtcagaatggctactaataaaaagtcaaaaaataacagatgctggtgaggttgtagagaaaaaggaatgtttatacactgttggttggagtgtaaattagttcaaccattgtggaagatagtgtggtgattcctccaagatgtaaagacagaaataccattcaacccagcaacccattactgggtatatatttgaaggaatataaattgttctattataaaaacacttgcacatgtatgttcattgcagcactattcacaatagcaaagacatggaatcaacctaaatgttcatcacttatagactggataatgaaaatgtggtacatatacgccacggaatactatgccaccctaaaaatgaatgaggtcatgtcctttgcaagaacatggatggagctggaggccattatccttatcaaactaatgctggaatagaaaactgaataccacatgttcttcataagtgggagctaaatgatgagaacacatggacatacagagagaaacaacatacactggagcctattggagggtggagggtaggggtacacggagaggatcaggaaaaataactatgggtactaggcttaatgcctgagtgacctaataatctgtactacaaactcccatgacacaagtttacctatataacaaacttgtacaggtacccctgaaattagaataaaagtttaaaaaaaagaaaatgtggtatatacacgatgaaatattactctgctataaatgaaattatgtcacttgcagcaaaatggatagaattggaggaccttatgttcagtaaaataagacacagaaagaaagatgttgtatgaatagaatggtagttaccagaggctggggaggggaaatgaaacaaatttgcttaataactgtataaaaatacagtatggggccaggcatggtggttcacacctgtaatcccagcactttgggaagctgaggcaggcagatcacgaggttaggtgatcgagaccatcctggccaacatggtgaaaccccgtctctactaaaaattagctgggcatagtggtgcatgcctgtaatctcagctactccagaggctgagacaggagaatcgcttgaaccagcgagttggaggttgcagtgagccgagatcgtgctgctgcactccagcctggtgacagaggaagactcggtctcaaaaaaaaaaaaaaaaaatacagtatgatagaaggaataaaatctagtgcttggtagcacaatatggcaactataattaacaataatttattgtatatatcacacaataactagaatagatttccaatattcccaatacaaagatttaatgaatatttgatgttgagtatcccagttacctagatttgatctatactgtgcatttgtatcaaaagattacataaacccataagtacatacaattatcatgtatccataaaaacaaaaaattaaataaaatttttaaaaaatgaaaaaatattttcccaacatgcaaaaatgaaaggcatttttcactactataccagccttacaagaaatgcttaagaaagtgctccaactggaagtgaaaggacaataatcactgtcatgaaaacatatgaaagtataaaactcactggtagagataaattcataatcaaattcagaatactgcattactgtaatggtgatgtataaatctttcaaatatctagtacgaaagttaaaagtcagtatggtctaaaataactatagcaacaataggttgttaaagaatagaaaatgtaggccgggcaccgtggctcacgcctctaatcccagcactttgagaggccgagacaggcgtatcatgaggtcaagggtttgagaccagcctggccaacatggtgaaacccctctttttttttttttaattatactttaagttttagggtacatgtgcacaacatgcaggttagttacatatgtatacatgtgtcatgttggtgtgctgcacccagtagctcatcatttaacattaggtatatctccaaatgctatccctaccccctccccccaccccacaacaggccccagtgtctgatgttccccttcctgtgtccatgtgttctcattattcaattcccacctgagtgagaacatgcggtgtttggttttttgtccttgtgatagtttgctgagaatgatggggtgaaaaccctctccactaaaaatacaaaaattagctgggtgtggtggcagacacctgtaatccctgctacttgggaggctgaggcaggagaattgcttgaacccgggaggcagaggttgcggtgagctgagatcacaccactgcactccagcctgggcaacagagcaaggctccattttgggaaaaaaaaaaaaaagaatagaaaatgtaaaaagataaaaattgcagcaatgaaaatataaattattgggagagggcaaaagtctggaatatttgtgtgtgaccaaagttccgttgttaccagcttaaaataatctattacaacaacaagatttttaaatgtaagcctcatagtaaccaagaagcaaaaaataatagcagatatacaataagaaagagaaaaaaatcaaagcttagcactcctgaaaattactaaagcacaaaggtaagcaacaagagagggaaaaagaaacaaagaatctataaaatgatcagaaaatgataaacagaatggcaggagtaggttcttacctatcaataacaaccttgaatataaatggattaaattctctaatcaaaagacaggtggctgaatgggttttaaaaaagatccaactatatgctccttataagagaaccattttagttttaagggcacatgtagactgaaaagtaaagggatggaagaagatattccatggaaatagtaaccataacaattataagtagatatgcacccaacattgaagcacctaaagttataaacaaatattaatgaacaagaacaaagaaatagccaaacaataatagcaagagacttcattactcttctttcaacaataaacagaccaaccaaacagaaagttaacaaggaaatactggatttcagctacactttgaccaaatggacctaacaaatatatatagaacttttcatccaacagcaccagaatatacctttttttctagtgtgtatggaacattctccagaatataccatgtgttaggccacaaaacaaatcttaacaaattcagaaaaattaaaatcatatctagaattttttcctgatcacaatagtatgaaactagaaataaataataggaggaaccttaaaaattttactaatatgtgtaaattaaacaacatgttctggaacaactactggatcaaagaagaaatcaaaaagaaaattttaaaaataacttacagcctaggcaacaaaggaaaacccatctctacaaaagtgaaaaacattagccagatgtggtggcacatgcctatagccccaactacttgggaggctgaagtgagagggtcacttgagsctgggaggtctaggctgcagtgagctgtgatcacagcactgcactccagtctgggtgacagagcaagatcctgtttcaaatatatatacacatacatatacatatatatatgtatgtgtatatatacacatatgtacatatatacatatacatatatacacatacatatacatctatacatgtgggtatatatacacatgtacatgtatgcacatgtatatatacatatgtacatatgtgtatgtacatatatctatacatacatatgtatatgcgtgtatgtataaacacatgcatatatacatataaatatatttggtatgttgcgtttccattgtcatgtgtctcagatagatatagagatagatagatagatatagaaagagatatataaaatatatcctagacatatgacaatagaaacacaacataccaaatctatgggatgcagcaaaagcagttctaaaaggaatgtttatagccataaatgtctacttaatgtaggcatttattcaaaaatgaagaaagatcccaaataaatagcctagcattatatctcaaggagctagaaaaagaacaacaaagtaaacccaaaattgacagaaggaaggaaatagtaaaagtcagaacagaaataaatcaaatggaaaacagaaaaaacatataaaagtcaatagaacaaaaatttgattatttgaaaaattgaacaaaattgacaaacctctagctagactaagaaatacaggaaagacttaaatgaaatgaaacgtgagtgaaaacattacaacaggtgcctcagaaatgaaaaaaatcataagaaactattataaacaattatataccaacaaatttaacaacctaaaggaaattgatacatacatttctagaaaaatataacattccaagattgagtcaggaagaaatagaaagcttgaacagacaaataacaaataaaggaattgaaaatcatttaaatcctcccaataaagaaaagcaggaagatttcatggttgaattctaccacatattcaaataattactaccaatacttcttaaaccttcattaaatagagctagagggaatacttccaaaaatattttacaagaccagcatcaccctgatatatatgccacacaaggacactgcaagaaaagacaactataggccaatacctctgatgaacatcagtgcaaaaatcctccataaaatattagcaaaccaaattcaacaacacatcagaaagattatgcatcatgaccaagtaggacttttcgttggcattcaagtctggtttaacatatgcaaatcaatcaaagtgatacatcacattaacagaataaaagataaaaaccatatgatcatctcaactgacatggaaaaagcatttgacaatattcgtcatcctttcttgataaaaatccttcacagtttagtacagaaggaaagatcttcaacataataaaagccacttataaaaaaaaactacatctaacatcataatcaatggggcacaactgaaagcttttctgctaagatctggtaaaaggcagagatattcactttcaccatttctattcattatagcaccattagtactagcaagtacagtcagacaagaaaaaaaataaaaggtatccaaataaaaagaaacaagtaaaattatctctatttgcagatgacctaattcyatatgtyagaagttaatctagctagaactaactagaaccccaaagattctaccacaaaaagtgttagaactaataaatgaattcaacagttacaaagtacaaaaataacataaaaaatcagtagcatttctatacacaaataacaatctaactgaaaaaaaatcaagaaaatcatattatttatgacagtatacaaaaattgagaaataaatttaacaaaggaggtaaaataattttatactaaatactgtaaaacattgatgaaagtaatcaaagaagacacaagtaaatggaaagataccccacattcatagatggracagattaatatttttaaaatgtccatactacccaaagcaatatatagatttaacacaatttcaatcaaaattccaatggcattcttcaraaacaattgttttaactcctgttataatatggaaccacacacacaagcacacacacatgcgtgcacacacccacacacacacagccaaagcaatactgaggggaaaaaagcaggttagaggcatcacagttcctgatttaaaatgtattacaaagctatagtaatcaaaaccatatggtacttgcatacaaacagaaagaaagatcaattgaataaaacagagttcccagaactaaatccaaacacgtatgtcaactaatttttaacaagggtaccaagaggacacaacaaggattgggtagtttttcaacaaatggtgctgagaaaactggatttctacgggcaaaagaatgaaatyggactcttacaccacacacaaaattcaactcaaaatgaataaaatacctaaatgtaagacctgaaatcataaaatacctagaaaagaacatagggaaaagctcctcaacattggtcttggcaatgagtttttgtatatcataccaaaagttcttactgcaaaaataaaaataaataagtgatattaaatctaacraaaaacacatttttatagaaaaggaaacaatcagcaaaacgaaaggcaacctactgactggcaaaaataattgcaattgataaggggttaacatccaaaatttataaggaactgttgcaactcaatggcagaaaaatgaataacctgattttaaaatggggaaggaacttagacattttttaaagacataaaaatggccaataggtatatgaaaatgtgttcaacactactaattataaaggaaatgcaaattaaaacaccatgagatatcacctcacatctgtgtgattggctattatcaaaagataagagataacaaatgttggcaagggtgtggacaaaagggaaccctagttcactgttggtaggaatgtagactggtatagccattatggaaaacactgtggaggttctaaagaaattaaaaatagaactaccatatgaccctgcaatccctcttctgggtccatacccaaaggaaataaaatcgccacctggtagatatctgtactactgtgttcattgcagcattattcacaatagtcaagatacagaaacagcctaaatgcccactgatgggtaaagaaaatgtgatgtctatccacaatgaaatattattcagccttttaaaaaaagagagagagagagagagattctgtcatttgccacaacatggakggacctgaaggacattacagtaagccagacatagaaaaatattgcaggatcttattcatttgtggaatttttttttgaaagaaaggtcatatacacagagatggagaatggaacattggtaaccacaggtgggaggagatgggatggaaaagaattggggagatgaagatcaaaggatacaaaatagcagatatgtaagatgagcaattctagacatacaatgtgagtactgaagttaataaaattcattgtattggggttttttgtttaaataagtagattgtatctgttcttgtcacacaaaatagtaactatgcaagatggtttattaatcagcttcactatagtaaccatttaccatctatatatatatcccaaaacatcatgttgtaaacctcaaaccccaaaaaaaattatttaaaaaaaagagtaagatttatttagatttttaaattcccaaacaaaaatgtcaaatgctttggcagaggaggggaaaagcagctaatctttaagcctaaaaaagagaaaaggaagtaaaagaatttaataaaatacactaaagaggtcattaggtctgagtaaagcaaatattcacatcaacatttatctctaatattaagttaaagagaaaatatattagttgactaaagtctacttggagaatattggcaattctctctgtttcaaaagcaatatatgatcttattcataatgtttttcttgcataacaatttccacttggaatgatttttgagttgtaatatatggtgatgtttcttaagatagcatcgcccctctaattgtatattcctatcccaattctgcactataaactcagattgtaagagtaaatttttaagtaattttatatatacggtggtgatttctagaacacggtcaacacaccttggaaaataaaagttgttttttgtttatttttggttttgccacagaggaaattcaatttgtagcacagatgaaaagactgattcaaaatccaaattcagaatcacccagcactttgggaggccaagacaggaggatggcttgagctcaagagttggctgactgcctgcggaacatagcaagacctcatctttacattaaaaaaagaaaagaaaagaaaagraaaaaaaaaactgaaaattagcctgggcaaggtgacatgtacctctggtactagctactcagaaggccgaattgggggtttgaggggaatattgcttaagcccaggaattccaggctgcagtgagatatgatcacaccattgcattccagcctaagagacagagcaagaccctgtctctaaaattcagaatcaaaattgcaattctccttcagagaaatatcagcatcattaataggcaaaataaccttttttataataattttttaagaatgtctcacagttcctcttgtcctcctgaaatacttccttgtatttaatttattcctcaaactgactctgaaattaatataggaaatatagataaacaacagacttaaacggtggctgcaatttacgacctgtgtgacttttatataagcctaaattttcttatccaccttatagagccatctggagctaatcccagaatgcagagaaaatatcatatccagaattgaatccccagcccctaacatgcacttacacagtgctgaatacatgagagcagtaatcaacataaaaatgaaggcaacacacatattacattatttataggcattacttaatgaaaacaatttttaaaagacaatttacatatgacagctagtacaccacatggtatatgtaacgcattaattaagtaatattgcctaacccatccattgtttttctcatttgctctctgattcttgaaattaaggacattaagcaaggattctggtgtctgtatctgaatgaggcaatgagagacaattatttgytgcacttgccaccagcattaattaatgaataagaacttaaaagataatatgtaaattacctagttacctaacacattttmtggtaatattatgcattatttaaatatgacttctcatctccccccttatctttctcatttgtcctctgagttctggaaataaagtagttaatcataaattcctggtggtttgaataaggcacagagaggagggagcattagcaggaagtgatcaaagaggactgctaaaggagatgaactctgagggtcagttttcattttgcctgctcaaggaaggaatgggctacaggtgaactaagggtggaaagagactaaaaggctagatttttatttagaggatgaaaataaaatataacgagaccctcccatgagccatctgctttcacataatgcctcatttaacctttaatgggctaataaaacactcaaatctattgaattattccatgctatttaacacttatgatatgctcacctctggcctcagggggatttcaaattttttattcattgtctcatattctccattggaaatatcagtctactttgattttgaggtgtattaggaaatcatataggtcggatcagcatggaagccaacacagagaaagagagaggtacactctagtcataaaatgtaaaggggaggacttccgatttctgttgctgtcactttggctgaataagctcctatcagacccaagcacctcagaaatgacaactacaaactctctgcaaaattttttaagagtatcacttagaagaagtaacattttggtgtgagtttcacatttttatggctatagactgactaggcacagcataggtttggaaattctgataataaaatggctctttatggacaaaccagcagaattctggagaaacagccaccataaagtaagggaggaattccagaacgcagattcccagcagaggaaacatcaaattctgtgtaaaaacttgccccagttctctgattgacccctgcaccataaaggcacaatccagctaaataccaatatgtatatatacagggatcccttggtatctgtgagggatggattccaggactcccatggatacccaaatccatggatgttcaagttccttatataagatggcaaagtatttgcacagaatccacactcattttctcatatactttgaatcatctctaggttacttataatacctactactatgtaaatgctatgtaaacacctgttaagctgtatttttaattcatattatattgttatttctattggcttttgcctgaatatttttgatccaaatttgttgaatccaagttaygtgaaacccataagcatggagggctgactgtaaaaacataaatatagatatagagatagagatagagatcttgaactgagatgtgtattggtaacaaaaagatcaagtttgtagttggagtccaacctgattgcccctaaagcaaaaacatcaaaaccatttagaggaatgtaatggtattcagagcctccacaatattgttctaggacaaccaggtttgcctgtcatatgggtaacagaccaatgcaccgaaacagtgggagttgcagcagagaaagagtataatgattgtatggtagccaaataagaaagtggaaaggaaccttaaatccacctcaccaaggagttttggcctagaatttttagggaattttggcaaatagggggctgaggagctaattgcttagggtgtgtggaatgcaatctttaataaagatgtaaaaactacattttggggctgaattacttcctcagagagggtcttcagactggctggcatcgatggacccattggaatgcaggatctggaaaatatctcaaaatggaaaacttgacatttcttaacattaaagatgttatctacagaagttaggaccttatggcaggggctatgtgacttttaagtagtaatcagctgtacagaagtgggccatagagcagtctggttaatgctttgctatgtttctacttaaagcttatgcttttgttaaacttagcaatttagttttatcaattttattaggatggcttcaatatgacattcacaatgtctaggatactatgtttttctctaataagggcaggaatatgtgtggatcctaaatctgtgtaatgctctcattcatgttattttgttgtttcttcactgtttcctcaattaaagtaaaaattttaaaccaaagggtcaggaaagttatttgagaaattcaagtctatttgcaaacagtcaagaatagaatggaaactctaagaaattggataggtactcagtaccctgaagcctataagaaataagacaaggtaagtgctagaggctgatgaaggaatgtaaaacgggcctgactgaggatttntcggcaagagatttacaactttattatccccagtgccaaagtgagctttctaaagcaccaacccaaaaacatcagtttctttcttataactgtttgtagattctgttgtcactgcagtgatttaaaaacttttcctcacaacagaatactcattttccaaataaaatattatgtggaaccttagggaatataaaacagacaaaagtagggacaggtaggaggttgggggtatcatagatctgacttctcagaatttgctcatgtatgtggtagccctgattcagcctcctggactccagagaacagagggtcatcacctcaaacctatagaggtattgacttagattagcatctgaagccctgacagtttggctccaaactacctttccagtcttctctgtcactgccccaacagtaaaacccaagttccaaccattccaaactcttagtagtattccacatcttggcactgtttcatctgtctagaaaattcttgcttacaataccagtaggagaactgctcttcctagtttatccaagcagaagtgcctttcccttcctgggacttccccttcaagggatttacatatattctgctataaacgcatttaacatacagcactgtaattgtgacccamctaagtctgtgacccacttaagttaccctcatcctatggccagtctcagcatggtgaaactgcaaaagaaactaaatccataaccaaatgtcttaaagaacgttgtacatctttattgagattatcaagacacactgaggtaaggtcacataaaaccagcatcaaagctttcccaaaatcccatgtagctaatttttccttttcctctaatcctatttttgctgtatcagtgtaaatatcttcccttctatctttaaaatctccagtatgcactgggttctttctcactatgttatttcttttctagagatggttcaagccctttcatatgacaatcagcttatttaaattattaaaaatccaaccattattctgctcagtccaacaaagacccaacaaagagtccagcttagaaggtaggagagaaggaaaagccataaataagtattctttagtatttttgtctacaatgtatgcgtcaatctgtattccacaagactgtgctccctaaccatgtcttcattttcatttccaggttgtcttatattttttatatcaccaatacttagcacaatgcctgagacaaaaataggtattcagtaaatactggttgcttgaataagtaaatgagtaataaatgactgaatgaatgaatggaatgctcattttccacaggaaattcatgtaattgcaaaaatacctaattcttacaacagtaaacccattatcactgcgttctcagagaactatgctataaagttatgtagaaataaagtaaattttttgaatcatttaacagtaatgtttttcactcaaagacatcattgctcatctattgaaacacaaggcaggccatatttccccatcatctgggttagctgcacaaagtctcacattgccttagacacctctgcacaaaagatggcttgccagtttgcagccacaaggaaatcatccctaggaaaaatagcttcatttttccatttctccctctattacatatatacaggctaggtacctaataccttacagtgttccccctttacttctacatgatcaaatctacttcattctgaattattaactgttgaaatcatatagcattctgatttttagcaagayattttctacttgatcttcccaagaatggtgtagataggggataaaagattaagttggtaaaatggtactttctcttagattatagaatttaccattcaaggaataaactaaactctgttagccatgagaaggaaggtggtttggatgagaatccttttacccataagtttctgtccttttccttaactctgtcatgaagagaaaaggtaactcagtcctggatttccctctttcttttaaatattaggaagagaaaaatgagaatttcgggaattagtggaatcatcaaccctcatatttattttggaacctctgggtaagagctagccctacattcagagtaaaatacttttaaaaataaataaagaagcatttaaattccttccaagaagcatttttgtcacagtatactcttcacagctgccttcacgtctttgttcctcaaactatagataagaggattaagcataggtgtcaccactccatagaacagggagatgattttgtctgtgacttgttctttgtctgcaccagaagagtctttagccttgggctttgcatacatgaaaaggatggttcngtagaatataatcaccactgttaggtgggcagagcaggtggaggaggctttgtgccttccttctgcagaaggaattctcaggatggtggagagaataaaaacatatgtaacaaaaataaaaagtactggccctacaagaaaaatcatactagcaacaaccatgctaataatatttatggagatattagcacaggccaattttaagacagccaagatttcacaagtaaaatgattaatgacgttatctccacagaaaggaagccgcattgcaagggaggtttgcaacacagaattgatgcctcctccaatccaggaccccgcagccatggacatgtatgaagccttgctcatgatgatagggtatcntagagggttacagatggccacatagcagtcaaacgccatcatacttagaaggacacactctgttgctcccatagcaaaagagagaaacatttgcactccacacccagagaaggaaatagttttctttgacgttaagaagctgctgagaaatagtggaatagatgaactagtgtagcagatgtccaagaatgataagttactgaggaaaaagtacatgggggtgtgcaagtgggtgtcataaacactcacaatgatgatgactccatttcccaacaggatcaccaaatacatacataggaccagcacaaagtaaatggcctctagctctgggtagccagaaagccccagcaggacaaattctgtcatgaaagactgattagagtttcccatgctaatattttctttcaccaacaggaattctgtagtggctggaatgtgtgtggatcttttacagcagtgtctgtaagaatcatttgcattcttgaatggcttccctatgggtaataaagacctgtaattggatatataaatagcacaagaatatgttacgaccctctaagttaagatcagttagacgttcagacttcatgaaggagtccccagctctcaaaaagaatattcttgttaaagaatagattaaaaacacatgcaactgagttagaattatgaatctcatttgcattataaatttaaattattttaatacaatgttaccatattttgaccaaataatccagaacaaatagaaaatgtatgaaatattactagccagcagatatctgaccattttaaccaacattattatctgtaaccaaacatttttcttcacactatgttatacctaacaaaattgctgttcttcagttactaaaacaaagttatatgtgaaagttctgcttcaatggtaatttaatcttaattgcagaagagtcttgtgggctaaaagaataaatagaaaagacatttttaggaaaaaggacttttggttattcctaatttaggacaaatatgaatacctgaactatcctcctaagaatattgactagagaagaagtattacttataaaatagtaagggaaaaaattgagataaaattattcttgttygtctttttcaatacagattagkaaatctttctaggtcaccctattgttctgcctgatatacacgatggataaaaagttgacctcagaaaaactctagtgtacatttctcaatctataatcaaaccataaataaatgtataaattaaagaatttcagtaatgagggatttgcttttttacctctaagtatgagaaaatacatattgccttcttcctgcakagaagtcagcttcctctgctcgaacagctgttctgctgatcttcctctcmctgcatatttggaaatacccatgataatgagaggtaggtcactcaaaaagctcttaaacatagcaatttgctataattatttgtatccttatttgatgtaatatggagtatttctatatttaaatgccaaaaacagaagtcctactttttaaaatcagattgctagcctcataagttccatctcaataacctcacaaagataacwaaaagaactatctgcttctcagttctcattaaaatcaagtagctgccattgctattgtagaagccaattaatcattggcaaaatagaaactagctctagtaatgatgaaagctggggctcttggcagtcttttcactagcagaggattcttcaaaagaccagccaatgaagcaccaaagcaactcaaagtgtttgctgctttgaggatgcttctaatcccaaaagtaatttaaacctcacaatgtggattggacagaattttaaaactttctagtacttttgggacgaagtctctcagaagcaattaaaacaaagttgttgatacaatttaattaaagtttaactcataaaacagtaacaattattctagctttacattctctgggaagagnaagttgaggaatgctacccaggtaaaacagccaagacatggaaattagaattcactatatctgatggagagatgtagcagtaacccgtgacgcttaatgcaaaatgatgctttgttcttaataaatgaattgttaatcacatttattttgaccattaatcctggagtctcagaatccataagcttcatactggtctcattggcccctctaaacagccaaaatcacatgcacggtcattttaattttgttcactcatcccctctgttcaaatatatatgcaatatcccaacctcattcaacctgttctttagttatatccacactagcayggcacaacatgagtccaaccacgcaacaacttccgtgagtgagcaagccttactttaccttttttttttttttttttttttttgagacggaatctcactctgtcaccgaggctggagtgcagtggcacaatctgggctcacttcaagctccgcctcctgggttcacgccattctcctgcctcagcctccctagcagctggaactacaggcgcccgccaccatgcccggctaatttttttgtattttttggtggagacagggtttcaccgtgttagccaggatggtctcgatctcctgacctcatgatccgtccgcctcggcctcccaaagtgatgggattacaggcatgagctaccgcacctggcccttactttactttttaacaggaaaagaaattctgacttgaagtaattctttataacacttattatgactatcttttgaaatgaatatcaacccttaaagaattcagttattttacacagatatgacaaaataatctttcagcatagaaacaagtgggatcactatgtgtagtgttagaaagaagggaataaaactggacaatggtgctctttttttgtcagtggacaatatttttaaaaagttattsagcaagagatgtaacataatcctgaagaatgggtaaactacttatgccatgaaaaattggtattatacgcttcaacaaatcaaatttgaartaaaaaattctcagagttgttaactttatgcaaggacatgttcagtgtactggttcrtaaggcagatgttgggcatgttttctcactaatcaatactcaatggacaaaagaattaaacaggtcaaatgtgacactgtagaagctatactataatgtaaatggaggatagactgtaactgcaaaacaacttataagcaaactctgcaaaacaaaaaaatgtcaaggagagccaaatcattatagaaatataattaacaagttatgtaatatagatgcttatatttatttaattttttttttgagacagggtctcatgctgtcgcccaagctggagtgcaatggcacaatgacagcttactgcagccttgacctcccaggctcaagtgctcttccacctctcttcttcccgagtagctgggactatggatgtgccaccatatccagttaatttttgtattttttgtagagatggggtctcaccatgtttctcaggctcatctcaaactcctgggctctagtgattctcctatgtcagtctcccaaagtkctgggattataagtgtgaaccaccacacccgatcagatgcttataatttattacaaacaacaaatacatttttaatataagtattatcaatgcaatatttttattttatcccagcatacatatgcaaggaaattagaaataattcaaatttaactgtgtcatgtatttttatttgctaatctggtaaccctaacttactgtgaccaagactcacatggcattcagtccaagcctgattgccccaaccagcatcactgtcagttccaaccacttgcaggcattggagagagtatgagacccagatctctgggcattactactcataataatactgtcagacagtactattttcagaactttcaaatgagaaacagagaatattcagtctttgtctgtttgggttgctataacaaaataccaaagactgagtgatttataaacaacagaaatttatttctcacatctcacagttctggaggctgagaagcccaagatcaaggtaccagcagattcagtatctaaatagggaccattcctcatagacatctgtttccaatggagcctcacatgaaggaagggttgaggaattttctgggatgactatktcaagggcagtattcctattcatgaaggctataccctcatgacctaatccctttccaaaggcctcacttcctaataccrtcacccgggaattagggtttcaacatatgaatgggaggggggacataaacattcattcagtcaattgtacagtgtattttgytaagccattctagtggatacaagattataacattatttgttgtctcaaatgtgcctagccaccacttaaatatcayctacagctgcaaccctccatccctctccataatagtaagaaaaaacaattaagatgaacttataggttctcatgatgaagtactgctcttcaatatttccaagccctagtctataatatcatcttctctctcatttgattcaattcagtaaacattaactgaagcctcccttgttccaggaactatgtgcctgcttcggccttagatctcatgaattacactaattccctgccagatactgtagcctattataagaatggcaagccaatgtctagggtctcactatcttgggtcagctccccaaatgccacctgtctatactccaagcagaacactctctgaattctttcttcatattgctctgccttatgctgtactcacacatcaatccatgcttttcctttaagtgactggcgtaggctgcttgaatttcctgtcaaacccctaggtatatggtattcaaatgccttcttgtccctcaggaagctgctatacctgtccatttcattttgtctaaagacaaactaataatatatgaataattaagtacctggtacaagcctcttcttttccctaaaatagcttacttcactaaactatggctatattttatctaaattgtgaataaaaattttatttcatgttatgcttagaaaattttgtttcaaaaccttgaagttagataagggtaatgttgttttggttttttttctggtttttttatttgcttgttttgttgtatttgagacagggtctcgctctgtcacagaggctggagtagagtggctcaatctcagctccctscaacctacacctcccaggctctcttgatcccctcacctcagcctcccaactagctgggactacagacatgtgccaccacgcccagctaattttttatattttttgtagagatgtggttttgccatgttgcctcagcctcccgaagtgctgagattataggcatgagccactgtgcccagtggtaatgttttcttacatttttaatgaatgagcacagaacctcatctatctcctcaaactaaagtttatcaaaatagttaatattagctataatgcagctacatcatgatcagtatatttactctgtcaatcaagagagtctckgtcacagcctcattatcattctctttcttgcttgtatcctgtctgtttcctaacaggtgggttttgtccagattggaaggatagtaaaaggcagcaagtaaataccaattagtccgtgatataaggaaaagaacaaggacataaaattggaatcggttaactagaattcaggtgggttattcccaaagccacatagtggaaagatcagggttgtgattagaaaaacacagaactacagattaataaatattgttgagctagccagatacagaggaatgggaaagacaacaatggacaacgtaacttaactcagttgaaaaacaagtttcagtgtaagttctgtttcttaataactttttaatctaattaatcaatcattcaataaacaaatcttttgctagtttgctcttcctagaaactagaaatatattatttaaaaaataataaagcattaattattagaaataataaaatcatatcaagcatcttcttggaccattgtggaatgaaattagaagtcaatatcaaaaggaactctggaaactgcacaagtatggcagcacgcagtggctagtgcctataatcccagcactttgggaggccaaggtgggtggatcacctgaggtcaggagttcaagaccagcctggccaacatggtgaaaccccatctctactaaaaaaaatacaaaattagtcaggcatgatggcatgtgcctgtaatcccagctcctgctggggcaggagaatcgtctgaacctgggagacggagggtccagtgagccgagttcgcatcattacactctagcctgggcaaagaaagcgaaactccacctcagaaaaaaaaaaaaactgcacaagtatatggaaactgagcaacttccttctgaattactttcaggtaaacaacaaaattaaggcagaaatcaaaaaattttttgaaacaaatgaaaatagagacagcacataccaaaatctctgggatatagcataagcagagttaaaaggaaagtttatagtggtataaacctacatcaagcagatagaaatatttcaaattaacagcctaactctgcacctaaaagaactagataaacaagaacaaactaatcctaaagctagccraagaaaagcaataactaaaatcagagcagagctaaatgaaattgtgaccaagagtaccatatgaaagatcaacaaaattaaaatttcgttctttgaaaggataaacaaagttgataggccactagctaagttaaccgaagaaaaaaagagacaaaattccaataagygcaatcaaaaatgagaaaggtgacattacattgaataccacagaattaacaaaagatcctcagaaactgctatgaacatctccctgtgcacaaactagaaaactaagaggaaatggatacattcctggaaacatacaacctcccaagactgaaccaggaagaaattaaaatcctgaacagaccaataagaagttatgaaactgaatcagtaataaaaaatctaccaaaccaaaaatagcccagcaccagatggattcacagccaaattctaccagatgaacaaaaatgagctggttccaattttactaaaacttttcaaaaaaattgaggatacctccctgactcattccatgaaaccagtatcatcctgatatgaaaatgtgcaaaggacagaacaacaacaacaaattacaggccaatatctctgatgaacatagatgcaaaaatcctcaacaaaatactagcaaactgaatccagcagcacatcaataagataattcaccatcatcaaatgggtttcatttcagagatgcaaggatggtgcaacctacacaaatcaataaatgtgattcaccatttaaacagaattaaacacaaaatccacataatcatctcaatagatgcagaaaaagcattcaataaaactcaacagcgcttcatgataaacaccctcaacaaactaggcatcaaaggaacatacctcaaaataataagagccatatatgacaaacccacagccaacatcatttctctggtgaggactgcgcctaagaactagaacaaaataaggatgcccactctcaccattcctattcaatgtagtactggaaatcctagccagagaaatcaggcaagagmaagaaataaaatgtatccagaggtaaaagaaaaaaaaagaaagaaaatatatccaaatatgaaagaagaaggtcaaatgacctctgttcactgatgaaatgacactgtacctagaaaaccctgaagattcctcccaaaaactcttagacatgaaaaacaatttcagcaaagtttcaggatacaaaatccatgcacaaaaaattgatttcctttttatacactaacaacactcaagctgagaacaaaatcaaaactcaattttatttataattgccacacaaaaaattaaatacctagtaatatatttaaccaaggagtgaaagacctctacaaggagaactacaaaacactggtgaaagaaactgtagatgacacaaacacatgggaaaatatcccatgctcatggataggaagaatcaatatcattaattaactgtgttgcccaaagcaatatacagattcaatgcaatttctatcaaattaccaatgtcatttttcacagaattagacaaaacaattctaaaactcacgtagaacctaaaaagagcccaaatagccaaagcaatcctaagcaaaaaagaaaacctggaggcatcacattatccaactttatactataaggctagaataatcaaaatagtatggtactgatactaaaatagacacgcagaccaatggaacagaataaagaactcataaataaagtcatacacccacaaccaattgatcttcaataacattgataaaaataaacaagggagaaagcaaaccctattcaataaatggtgctgggaaaactggctagccatatgcagaagaataaaactggatccctacctctcaccatatacaaaaattaactcaagatctattaaaaatttaaatgtactactgaaaactgtgaaaattctagaagaaaacctaggggaaaaactctcttggacatttgcctaggcaaagaatttttgtttagcayctcaaaagtaaatgcaacaaaaacataaatagacaaatagggcataattaaactaaataacttcttcacagccgaagaaacaatcaacagagtaaacagaaaacctacagaatgggagatatttgcaaactatgcatttgataaaggactaatagctagaatctataaggaacttaagcaaatcaataagaaaaaaatttttttcatgagcaaaggacatgaacagacatttcacaaaagaagttatacaagtggccaacaaatacaggaaaaaataatcaacatcactaatcatcagaaaaatacatattcaaaccagaataagataccatctcacatcagtcagaatggctattattaaaaggtcaaaatataagagatgttggtgaggatgcagagaaaagggaacataaattagttcaacccctatggaaaacagatggagatttttcaacgaactaaaaatggaactaccattcaactcagcaatccagttgtatcaaaaagacacttgcactcatatgtatatcactgcgctatttacaatagcaaattcatggaatcaagtgtctgttaacagtcaattggatacagaaaatgtgccacatatacaccatggaaaagaatgaaagccataaaaaagtataaaagcatgtccttcacagaaacattgatggaactgaagaccactgtcctaagtgaaataactcagaagcagaaaatcaaataccacatgttctcacttattaagtgggagctaaacaatgggtatacatggacataaagatgggaaaaacagacactggggactccaaaagggggaaggatgggaaggaatgatggttaaaaaactacctattgggtactatgttcactatgtgggtgatgggttcactagaagccccaaaccccaacaatacacaatatacccacaaaataaacctgcacatgtacccctgaattggtaataaaatattttaaagagaaaaataaaataacaaaaaataataagacactcaggagctataaaaaacaactaatatgaaataaactttttttttttttttttttttttttgagatggagtctcgctctgttgcccaggctggagttcagtggcgcaatcttggctcactgcaagctccgcctcccaggttcacgccattctcctgcctcagcctccggagtagctgggactacaggcccccaccaccacgcccggctaatttttttttgtatttttagtagagacgggttttcaccgtgttagccaggatggtctccatctcctgacctcgtgatccgcccgcctcggcctcccaaagggctgggattacaggcgtgagccaccgcgcccggcggaaataaactttaaggtacgtttttttcaacaaacagagtaccacaagtggtctcaaagtcttctatattcaggtgttaccccttcctttagtagcccaattgtgataatctagcctttatttttcatgaatgcacatagtttatactcctcgcaaaatattgcttaggacttttatattttcctagttgttggttatttttttctccagcctgattgatattccatgcttctctatcatttttctctgaaaatcttataattactttctcatcttatttattaataagttctttacagtccattttgctgcacaaagagtatatacaagtacctttaaaaacatttacaggtcaggcacagtggctcacgcctgcaatcccagcaatttgggaggccgaggcgggcggatcacctgaggtcaggagttcaagagcagcctggccaacatggtgaaaccccgtctctaccaaaaaatacaaaaaattagctgggagtggtggtgggcgcctgtaatcctagctactcgggtggctgaggcaggagaatcgcttgaacccggaagacgagtttgcagtgagccgagatcgcgccattgcactccatcctgggcaacaagaacgaaactccgtgtaaaaaaaaccaaatttacatacattccagggactgtcgtttttaacacactacttggcctgaaaataagataaagtgatgccgtaaagaaaagattttaatacggaatatcactgctgctaatatctgctagacatgctacctcacaaaggcctctcaacgccatttccctcttcagttcctggccagccacygtgttgctgagtcctcttcgtttcctccttttacaagcattggggttaacccagtaaaaatatataggtacataacttcaaagtatttatctttaaaagtatggctcttcccagaagagtgagtctaccctcaaaatggatggcagtttctactcttagaactatagggaaaaaaagtgcatatcctctatcacgccagtgatttagaaatactagaatccagcaccttttcacatgtatttgttatccgcttcaggaataacagatatgtcataagaaaaagatccttgaaacatctttacctatccagtgaaatgtttggtggtaaaagaaaatctctttagacaaaccttcagaacatattatcaatcaatgcgtactgccttgctattatcaaccaaagcatatcgtctccaaaaataataattttgactccaattatttgtcatatttcacatgcatttactggatgccaataccatttttttctaagatagagaagtttctaacttaccaaataatgtttaaagctaaattaacacaacaatcaagtctcatagaactaaaaacatctaattcaccacctgatgcgtaaatatcctccaaaacatccctaacaggctgttatctatctttcttgcacacctctaataatgggaagctcatctgttctgagggaatctagttattactgtcaaaaactgcttatatgaatccaaaatctgttcttttgtgtgtatattttctactttttgtttttagttgtawtctttgaaacaattaccacttgagtttatttttagaactaaaattagaatttcagtctgtattttagacttataattagcaaagatcatttcattcattcattgaacaaatatataagagcctacactcttctaggtaatggtaaacaatgtgaacattggtgtttgagatggaatctgaatccagatctttttttattctaaaagccatcccttattttttgttttctgctactatccagattcttttcaacttggagattacagtaatctatttgctttcacagaatctaaacttttttaattctatagagtctgctaccttttccaaattaatcttcctaattcatggtgttcatcatcaccacaattcaaaaacttaccttggctttccaactaagacatgaacactttgacctgatactaatgtctccccacaaaacaactaccacctaaaattccagattatctcctagggcaatctcattcactctatggtttcaatgcatcatcaataaactggtgaatccaaatccataggcctcatcccagatttctctcctgggcattttatggtagcatcttatctaaatgcagtaagtaaaacacatgtctttcactcaccatgttracttacactacattatcttcctgctactttcctattatgaaaagaaatgttaccccctgttcttttgatgatttccaaaatgcctaaactgaactgcaaagttgtctgagctctagatcctaaataactctttagcstcatatttcacaaaatttcacctctcccaactgttctttatcccatgtgcaaccaaaatggagcttcttttaatttttagaatataccaccttcccccaccacccccctcctctctctctagaaaacaaagagcaaatggagaatttttgagggagaaagaatagcatagcatatgcagagggtagggaactcttccttttcttgcttaattgctattatccttctcccagaatctcctgaagatgtcattcctgacccctagtctgagttaggcaaccctcctgtgtgccctgataacatcctatatctcccttaatacagcacttatcacacattattgcaatcacgtgtttaattatctgtgtctggccaaacagcaagcaccttaagaataagcaccatcttgctcttgttaatcactgtaattacagaattaaggccagtacctggcatatttttaaccactcagaatgcaagtgttatattgttgacttcccttgcaattcctaactgattaatggcaccaccaaatctaaactatcaaaacttataaagttggactcctagacatctttcacatctgttaactaccctccagctattcttagtactatttccacattatgcctccatttgattactgcaaggtactcccagttggcctttctaccttcattttcaacaccatcgctagcacctcagtctattctccataattttgtctgcrttatctttccaaaaaatcaatctgatcatggtaagcctctgtcaaataaaagctgcatgattttgggcccgttacttaagcctcaattttcttaatctgttaataatattttaagntaaaaatgtgcaactaaagaagctaataggggatcaattgaatatccaaaaagaaaaaatttaatcttggcccctactttatacacaaaaatcaaatcaagattgattacagatttagatatgaaaaatggaacaatacatcttttagaataatangtagaagtattcttttagaagaatatatagaagaataaccacaaagaaaagattgtgaattggtctaattatatttaaattaataacttctattcattagatgtcatcattaagaacataaacagaaaggaaaaatattttttaaataaatatttttaacaaaggattcatataaataagatatgaaaaatcatttaaaatccattttaaaaagacaacctagtagaagaatggaccaaaaaaaaagtgaatgtacatttcatcaaataaggatatttgaatatgcaataaatgtatgaaaaatgcttaacttcagggaaataaaaaaataaaataatatgctaccactcccaccacaacagctaaaatgaaaaacagagataataccaagtgtttccaaagatgtaaagcaacttaagttcttacatactgctggtgggagyttaaattggtaccaatactttatagaactggagatgtgtatgaagctaagtatttgcataccctataactcagaattctttctaaactatatattcaatagagtgattatatacaaatttacaccaaagatgcatataagtatgttaataaaagcactaktcataccttatacaaacactagaaaaatataaatgtttatcacaagtagaataatggaatatttagcatggagaatgaagaaggtgcaacttcaagcaatataatattggttaaaggtatacataatacatgatatttgaaacaaataaaatcaatatgcagtattaaaatagtaatatctattaactctgaggagctttgggggtgctttctctgttttccacgatctgagatgtgttccattaaagcattcaacatgctatagcacttataaattgagcattttcaacaaataactagatagagaacccactaaatacagaacccaatgcatttcctaagactttaatagatgtctttcatgattaacagtattactagtgttattattacatgcttacaaagctgaaatttccatggctcattctcaaaaaggaaacagtcaagcaatcaaaataattttcaacctctacttaactttcttaaaaaccatggaaggaatccaaatatttcctaccacagtaacactgataagaattactttttcttttatccactggcatcatatcccccagctgttttggagcatctctccattttccagctttgctttttttttttttcctccctctctcttgctttcatttcatatgataatattcttttgatgtmaatatcttttatcaggtaaaataaaatytctcttccttggaccagcagttcaggggatggtaagttttaaaacaagggaaaaaacagactttaagtattgaggcttatgtcagtgagctaggatatatattgattgtatctcacatttttaattkttttgaagattanaaagatcaataactggaagcttctgctcttttgatagatggattttgagaagagttgaacattaatattcccaaatcaagggttattttttctgtcrcactgtcgctaaactcaaatgtcacctcttctgtgaagcctttactaaaccctccaggaaaaaatcacttctcccacttcagtgtttctatatgcttctttgtgcctcttttataatttgtattatatattgtatactatttattcagagggatgtagttgaaagcacacattttagaaatcaggaagagatggataaaaatcccaactctgtagttcaccaggaacataaaatttaaagacgtaaagtggagtcctcaggaaatagatgttcattatagttctttgttgaatgaatgaaggcatgattgcctttcacacattgaagctaagcaagcttagttaccattactggaataagccttgccaatcattgctgcctctgcatctttgttcatgccattctctctatctaaaatcaaaatctctctaatctatcacaatccaagaccctcctcaaaagcctcctctgccttgaagctcctacttatcattttaactaaattgsatttgtttagcaatctttcataatatttataatatgaagatttattttctatttgtgtgttgtttgtatatcctgctttattgaaaggtcattagaagtagagttactggtctttgtaatctccacaattaacacgttgataatttggatcagtgcaatttgtgtattcaacttttttaaacaggcatttttcttttgaaggttgtgtcttgtatgatgttacagggaatacacacaactagcaataagcccagttgagacagcattctcttcaacagtgtttcaggccaggtgtggtggctcacaactgtaatcccagcactttgggaggccaacacaggcagatcacttgatgtcaggagtttgagcccagcctggccaacatggtgaaaccccatctctactaaaaacacacaaaaggccaggtgyggtggctcacacctgtggtcccagcactttgggaggccgaggcaggtggatcagaaggtcaggagatcgagaccatcctggccaacatggtgaaaccctgtctctactaaaaataaaaaaattagccaggcgtggtggtgggtgcctgtagtcccagctacttgggaggctgaggcagaaaaatcacttgaacctgggagtcagaggttgcagtgagccgagatcacactactgcactccagcctggtgacagagygaaactcagtctcaaacaaacaaacaaaaagcmcacacaaaaaaattagctgggtgtggtggcgtgcacctgtagtcccagctactagggaggctgaggcataagaattgcttgaaaccaggaggcggaggttgcagtaagccaatattgcctactgcattccagcctgggtgacacagtgagactctgtcaattaaaaaaacaatgtgtttcagtgttgtttacctggttttgtctcacctgagtgtaacaaccgcgactataataggtcaggcagagtctatctaaytgaattaaacacagataagaatcccagagctactttcttaaggtcattatttaacaagaagaaatattaatctataaaccagtaattcctacatatgtatctccattcctgacttccctaacatccagattcatatattcaacttcctactacacatttccacttagataattaataagtgtatcaagataatgagttcaatacagaactgttgattctctctatcctcatttggtttcatcttccctacctcaggaaatgtaaaaccacttatacaaatccaatgcaccagaaaattctgtcagtttgactcaaaatttatactgaacctgaatacttcagttgctaccactctagtccaagctactgttatcacatctacactactgaaatggctttcaaagtcatctcctygctttcattcttgttctgctacaagtcattctccagtagcttgggtggtttttttgtttgkttgttttgttttgttttgttttgagacagagtctcgcggtgttgcccgggctagagtgcagtggcgtaaactcggctcactgcaaccttggcctcccaggttcaagcaattctccttgcctcagcctcccgagtagctargattacaggcactcaccaccacaccsggctaattgtttttgtatttttagtagagaccgggtttcactatgttggccaggctggtctcgaactcctgacctcatgatccgccagcctcggcctcccaaagtgctgggatgacagacgtgagccatcacrcccrgccgtgttattttaaaaatgtagacatatgatgtcaggcatttactaaaaaccatcttaatattaccattatatttcgaataaaatccactccttaccatggcctmcaagggtctacataatctgacccaacctatttccgcagtgtcatccatctcctacctccttcccatgcttaccagagtccacatctgttgtcttcttgctgtttcccagacatacccaagcctttgcctttgctgctgcctctacctggcacagtctttcctggtcccccaggtttctctctcatttaactcaagttttggtcaagaacttatcatactttgttttccttcatagcgctcacatttcccaaaattgcrttatatattcattgttttacgagtttattgccacaggaatgtaagctccacaaggrtgaggactgtttcttttcttttttttttttttttttttgagacggagtcttgctctgtcacccaggctggagtgcagtggcacgatctcagctcactgcaacctccgcctcctgggttcaagtgattctcctgcctcagcctcccaagtagctgggactacaggcacgcgccaccatgcccagctaatttttgtatttttagtagagacagggtttcaccatgttggtcaggatggtctcgattttttgaccttgtgatctacccacctcagcctcccaaagtgctgaaattgcaggtgtgagccaccatgcccagctaactttttcttattagttattgttaagtaatgttaaacaaatattatgtactctataaatatttgttgaagaatgagcacacacattgcaggacagccctataacctgtacactttggaatatatatatygcaaaatatatttgtgtgtatatatatgcacacacattctggcattcactrtaagtttctgctttttttctgatttgattactgataggaaccctaagctggtaattaaaggagtattctttatacatttttagtctacttacctttcctccaggtttcactgatctttctckttttwtataagctgcttgttacattttgtatgtgctggacttggctactcctggttttagggctctgatttatttcactttaaaggtaagtttagaatgtcttgcaaaatgctggctacttattactcagtgctctctcactcttgctctctctctccccactgcaataaagctctttttatcccccaaatctaactgcttggactcctstcagtgtacttgcaataattcataggtttttttgttctgtgtcttgcggttggaaatctggcaagctctgaacttctcttaaaattcatttgcttatctattaaatggggacaatgaaaacaaaakgtctgtttttggtgatagggagggtaataatatttactgctgtaaagagtcacatctcatttggagtacaagctgaaaatcagtttctaacttcacactgacatactatgttctgtgttacatcatttgacattctttcgaaaattcagtgcacatttatttactaatgtaataaccgaygaaatgacacaccacacttgcaaaacaagaagttaaaactatcctaccatactgtctagtggcaagatyttcccaggggattcaagcaagacactttaaatatgacatactggtaaaaattcttgacttgtgactacagctatttctgacaaaattgttataaaggttaaactctatataagaaacattttaggccaggcacagtggctcacacctrtaatcccagcactttgagaggcagaggtgggcagattgtttgaggtcaggagttcgagaccagcctggccaacacagcaaaaccccatctctactaaaaatacaaaaaattagccaggcatggtggcgtgcacctgtcgtcccagctactcgggaggctgaggcaggagaatcrcttgaacccgggaggcggaggttgcagtgagctgagwtcgtaccactgcrctccagcctgggtgacagaccaagactctgtctcaaaaaaacagacaaacaaacaaacaaaaaacagtttaaatatcttataattataaaaatagatamataaataaataaataatattcagactttgaaataccaacacaattaggtgattgggtaactctcacagacatgtaaatgagaatagacaaatgtgtcattgaggaagaagctagtttaagttttcttcttttgagaaaatgagcrtatatacaggtatatgaataaaaactttttaaaacaatttcagaaaaatttgagagagaacacatctgcattgaaatttggaataaacttatggattaagagacatgtcaatgaggtgaaatggaatgagtgccatatatttaaggttttttttctaatatgctatctccatactatctgcaaattctttcaactagacttcttatgtaaagcatatgtagccaccctcagaatctttagtacctgtttaaaaacatatatcctgccaattttaacagctaagaggaagggatactcttgtaggaacctgattcaagagagaaattttttgatgctattagtaatatcccccattcgctttaactccagaggccatgaagaggaaattttctgtcagatcttatctgcttttcaattcattaacagttttcttatttttttgacaggagtataagcagagaacaaataattaatttttaattgtagcattttgtgtgacactgattagaaagttcaaatatctaaagttataaaataaacaaaatgacaaaaggagaataatttttttcacgtcatcaccaagaggttatactttattaaagcagtctttgcagggttccctgaaagagatctttccaatattaaaatacatatgtacgcrtttacattgacagaaaacttgtcaagttgaatgtatgatgcaagacagactctartggaggcaagactagtaagtggataaaaagaactgtgtcwtaaatttaaaccttctttaggaaaaaagttttatttaaaaacaaaaactttttaataggttgcttacaactccaacaagggagcaaagcaaaataaaatgtaatggtccctcagaaacgtagttttctatactgaatgcttgtctggatttcagttgctattcctgggggatgggaaggaaagaaaagcatcagaagatttaccaaatttaaactctaagtaataaggagaaagtcattaacgaaattctttcagatgatatgttttcagttaaagttcgtctgtttttagttacttcggagggaactagattccccagggcatgccasactgtataaaccttagcaaaaggaccttagttattcctacagcatttattctgcaggaattaatttcacattcaatatncattgcatcatgaagatacctttgataatgttatttctctgcatctacatgataacagcctatatatcgtatagtatcnctgttcttaaaaccactaagttacattagtattcgcatttctcaggatctattttaatatgtaactttaataaaaactaaatgactgaagctcaacccaaagaaactaaattataacctggatgaaagaaataattttctttctctgtgttactcatattcttacacagatgtgagattaaaagaacaatgattaaattatgcaacactattaattagaggctatctaaactaayagtagctaaattataataatgattccrttgatcaaggctgcagtaagccatgatcatgccactgcactccagccagggcgacagggtgagactctgtctcaaaaaaataaataaaataaaagtgagaggaggcaggacaayatggccaactagaagcctccaccaattgtcttccctgcaggaacaccaaattgcacaactatccacacaataaaaagcacattcataagaaccaaaacagctgcgcaatcatagcacctggttgtaacttcatatcactaaaaraggcaaggaagagggtagaaaatatagccctgaatctctgataacatgcctccttcatgaacccataatgatcatcagatcactagaagctactgtgaacaaygatatgccaataaactgaaaaacctagaagaaactgataaattcctagacatatacaacctaccaagattaaaccataaagaaatccaaaacttcaacagacctataacaagtaatgagactgaagccaaaataataataattttttctttcccagcaatgaaaatcccaggacccaatgtcttcactgctgaattttaccaaacatttaaaraactaatgccaatcctactcaaactattcaaaaaaaagcttccaaactgattctataagcccagtgttaccatgattccagaaccagataaagacacatcaaaaaaaaaaaagaaaaagaaaaagaaaactacaggacaatatccctaatgaacattgatgcaaaaatcctcaacaaaatcctagcaagccaaattcaacaacacattaaaaagttcattatgaccacgtgagatttatcctagggatgcaaagatggttcaacatatgcaaattaatcaatgtgatacatcatatcaacaaaatgaagggcaaaaaccataggataatttcaaatgatgctaaaaaaccattttataaaattcaacatctcttcatgatacmaactctcaaaaactcggtatagaaggaacatacctcaacataacaaaagccatatacaacagacccacagatggtatcttactgaatggaaaaaaactgaaagcctttcctattatatctggaacatgaaaacaatgcccactttcaccactgttatttaacatagtactggaaatcctagctagagcaatcagacaacaggaagaaataaagggcattcaaactggaaatgaaaagtcaaattatccttggagatgatatgattttatatttggaaaaacctaaagactccagcaaaaaactatyaaaactgagaagcaaattcagtaagctgcaggatagaaaatcaacatacaaaaattagtagcatttctatatgccagcagcgaacaagctgaaaaagaaatcgagatagtaatcccatttacaacagctacatataagataaaatacctaggaataaacttaaccaaggaagtgaaagatatctacaatgaaaactataaaatattgataaaagaagttaaagaggacacacaaaaaaatggaaagatattccatgttcatggattggaagaatcaatactattaaaatgttcacactacccaawgcaatctacagattcaatgcaatccttatcaaaatactaatggcattcttcaaaaaatagaaaaaataatcctaaaacttatatggaaccacaaaatacccagaatastcaaagctatcccaagaaaaaagaacaaaactggaggaatcacattacctgacttcaaatcataatacagagctgtagtaaccaaaacagcatggtgctggcataaaaacagacacacagaccratggaacattctagagaacccagaaacaaattcatacatctaaagrgaactcatttccaacaaacgtgccaagaacaacagtggagaaaggacactctcttcaataaatggtgctaggaaaaccggatagccatatgcagaagaatgcacctagaaccctatctctcatcatatacaaaaatcaaatcaaaatggattaaagacttaaatctaagacatcaggctatgaaactactacaagaaaacattggggaaactctccaggacataggatttggcaaacatttcttgagtaataccccacaaccacagacaataaaagcaaatataaacaaatgagatcacatcaagtttaaaagcttctgcactgcagaggaaacaacaacgcaaagcgacaacccacagaatgggagaaaatatttgcaaactacccatctgacaagggattaataaccagatatacaaggagctcaaataactctatagaaaaaaagtctagtaatccaattaaaaattgagcaaaaaatctgactagacatttctcaaaagaagacatacaaatggcaaaggggtatatgaaaaggtgctcaatatcactgatcatcagagacatgcaaatcaaaactacaatatccccttaccccagttaaaatgacttatatctaaaacacaggcaataacaaatgctagcgaggatatggagaaagaggaaccctcatacsatattggtggggatgtaaattagtacaactactttagagaacagtttggaagttcctcaaaaaactaaaaatagagctatcgtgtgatctagcaatcccactgctaggtatataaccaaaagaaaggaaagcagtatattgaagagatatctgcactcccatgtttattgcaactctattcaaaatagccaaaattttgaagcaacctaaatgtccactaaagataaatggataaagaaaatgtggcacatacgcacaatggagtactattgagccataaaaaataatgagatcctgtcatttgcacaacatggatggaawtggaggttattatgttaagtgaagtaagctagacacagaaagacaaaccacatgttctcacttatttgtgggagctaaaaattaaaacaattgaaytcaaggaagtagagagtagaacgatggttaccagaggctgggaagcataaagtgagggagaactaaggatggttgatctgcagaaaaatatagttagatagaataaataaaatctagaatctgatagcacaagaggatgactacaatcaacagtaatttatcgtacttttaaaataactaaaaggatataattggattgtttgcaacacaaagaaaagataaatacttgaggtgayggatacctcatttgccctagtgtgactactacacattgtatgcttgcatcaaaatatctcaagcgccctataaatatatacacttactgtattcataaaaattaataattaaaaaagaaatttaatggtatttttaaaataaaataaaagtgagtgattttaatgtatacttctctctaatgggttaaaaatgtgaaaataaaaaatttaaattctacaatgattaaaagtcatctgaagaagataaaaatatataatatgtaatatccatcgttttatattcaaacaactggggaatatatatttataaaactgactccttgggtcagaaagcaagacttaatacatattgaacaattaatagcactcaaccacattttcttatcacaatgaaatacaatcagaaatcaattaaaaaactcaaaatatattttatatttggaaattttgaaacacatttctaagtaaatcattgattagtaaaaaataacaatggaaattataaaacatttacaactttaggacaacaaaattaccatcaaaattagttgattcagtttaactgtttcgaagaaaatttataggcttaaacataaaaaaagttgaaagtttatgcacttagcatccaattcaagctctagaaaaaaaaataaagaatggaaaaaacacaaagacaaggaattttgaaccagttgttttaaaaattgccaggtccaaacaatttccctagaaaattctaataaatgttcaagagtataaaaaatctctaaatttgttgcagaaaatagaaaaacaggaagatcttctggaaccaatctttcgaagcaagcatgtgaaacaaaaactggacaattaaaaaagggaaaaaatacgccactctactacatagatacaaaaaccttaaataaaatattagcaaatgtaatmcagcaatgtacaaaataataatacctaatgtccaagtaaaatatatatcagggatgcaagaaaatgttaacattagaaaatatgttaatttaatttataacaatatcaattaaaggagaaaaaagcatgtctattttactaaatgcagaaaatttcataaaattcaacatgcatttataatgacaatatgagacattacatactttctaaatagtcagatactaaatkatagcatcataagtattgacaagaayatggagaaatcaagttcaattcattgccagtgaacatatgaattaatattttgaagagcaaataagatcaggtaaagttgatcccacaattccacttacaagtatggggcaaaagaaatgaggaagaaaaagctagtctatgccaccatctagtggccttagaatataatagaagttgtgatttcttcagccgcgcttacaaaggagtcctgaaagtacctatgtaaggatggaccaaaaacttacaaacatatacagtatatatgcagttactgccctcactaactgttgggcccacattggctccacccatcctgcttccttctgaagatttgcatgaacctaaccacgtgacacaaccaagtagaaatatctcagacagagtgcttcctatgtccacctcatataatttttttcaccacccttcaaacaatacctattgtttcatgagtcttaaaaagatactactccaaattgaccagactagattggtaataacttaaaagttggtcaatactaagtattggcaagaatatgatgcaaagtgaagcctcatacacttctatttagggtacaaatttggaaacttagcaaagatgaatatataacccaaaatcaaacaaaggaaacaaatgaacaaaaaagcttttaaaattaacaaaaattacaagaaagatgaatgtatatactgactgacccagaaaacctctccttggtatattctctagagcagtggctcttgatcccaaaggacacccaggcatagaactcaaggggcctagtaacttggatgggaaaaaaactgcatctttatttttatcaacctcaattgaaccttagtagttcctgctgccagacagttttacttatgagttcactaaattgtcaaggaacagtcatcatcttattcaagttatttagccaaaaaaaaaaaaaaaaaaaaaaaaattgagaaacctgcctgatccatttatttttatttcatattcagatgagaacagtacaagcagataaagctttttggcttatttcacttataacatcgatgtggaaataataaataaaatataaaatggaatcttccaataatagcatttggaacaactctcctgcagctaactgtacactctaggaaaaatatgttttaaatttctttttggaggtgataatttcagttgctgcttacctcggagaactgttcttttcacaaagaacaataaaaataatagtagataaagagtgcaatagaaaacttttttaggcaatggattgtttatggcatagattgtggtaatggtttcctgggtgtatgcttatcttcaaactcattaaattgcatacattaaatatgtgtaactttttgttatgtcaattgtatctcaatagaatgttttttaagtccttgcactcatagagctttcattgaaataactgaatatatactcttttttttttttttgaggcagagtctcgttctgtcccccagkctggaatgcagtggcgcgatctcggctcactgcaacctctgccttctgggttcaggcaattctcttgcctcagcctcccaagtagctggaattacaggcacgcaacaccacgcccagctaattttttgtatctttagtagagacggggcttcaccatgttggccaggctggtctcaaactcctgacctcatgatccgcctgcctcagcctcccaaagtgctgggattacaggtgtgagccaccgcacccggcctacatactcttgaagggtgacatttatataaagatatattcatttcttcactagactgacaatatctctaaaacaagaatagtatcttgttaattttgtatccccaataaacacctagactattacaggtaataatataggtaaaaatgtttttttacyttacagggaaaaagaaacttcctgaaatcaagatcttgaaaagatatttgcatgccagtgtcattcagcattgttcacaatagtctaaatatggaaacaacctaaatgtccagcaacagatgttcggataaagaaaacatgtgtacatgtgatataatggaatattattcagcctttaaaaagaaggaaatccacctggccaacatggcaaaaccccgtctctactaaaaacacaaaaattagccaggcgtggtggcaggcgcctgtaaccccagccactctggaggctgaggtgggagaatcacttgaacctgggaggcgaaggttgcagtgagccaagatcacgccattgcactccagcctgggcaacaagagggtgactccatctcaaaaaaaaaaagaagaaggaaatcctgccatatacaataacatggccgaaccttggtaacactatactaagtaaagtaagccagtcactgcaagacaaacactgtaggattacacttatatcaacttatatcaactaccaaaaagaaccaaattcatagaagcagaaaagagaatgatggyttccaggggctaggtggggggcagacagaaatgaagagttactattcaacaaatataaaagtttcaattataaaagattaatatcttctagatatctgttgtacaacatagtgctcatagttaacgatgctgttattgcatgcttaaaaatttgttaagagagtacatctcatattatcatgttaaatgctcttaccacaacaaacacacaaatatatacttacacacatacatacattttcctgaagtggccaaaagcatccagaaactggattggagcagtcgatatttgccagaaaaaatggcatggatgatttacttttgctgattttaagataagagaaggacctagtcagcgtcattttacagggtaactaaaatccaggtagaaaacatcagtcttactggcctgaaggaacaggacagagttcatgaaggtcatggagattgaaaatctggaagataaarccacagaaaataggcagacagaccaacgagagcctcaaatttttgtgtttactatacccaaataccggctgatctctacactatacgtaagtgatgttaagcctaaaagacctgaacaaagatttcaattgctgcccacctcagggaagacaagtttgaaaatggagtcctgctgaattacagtctgctaaaagaatatatcaatattgagtcaaattccactttccaagaataacctgagaaatatttttacttcaacatgcttttctgaaatattgccagtgcctgcctcaagaggtagagtcttttcatctttgtatattcctacaacattgagtggacatcaagtttatttggcatcaaaatttagcaaagggccttatatatatgtgttctccaaatattaaatgaattgtgaatgttcttcragttgaggcttacacaattgcagaggtgcttacaaaaatgtaagtgtggttgagtttaaaaacacaaagacctggaagtaaaacagcagtatctggagccagaaagttgacagaggatgagtggagttggagaagtctcttgggaaaccacggcagcactgtgctgtcctttgatgctgtgagttcacagctttggttattacaccctatgtgtgctttgcctcactaagaaaaaatgtacatcacactcatttttcattttacaaaagggcattatgagaacttctgacagtggaaatgggccttaactcttacggtagagaaagtgaaaataatctctgagcctagtcctccaatattgttattaccctcaaaaacctaaagaaaagtgaaaggttgctgagaatccagcagaaaactatttcatttccacttgttatatgtaggggttttttttcctgttttccattttaaaatattatgaatttgttaaaaatgtctgaaaaattaacatggacaaatatatacaatgtagtatgcacaataaacatcaggtaataaatcaagaaatacagtgtactctcaagcatgtaaacacagtatatgcatagaggtatattaatatttacatctgtaattatgagtgattttctttcctcctttagattttttggaatttctcaaattttctattctgagtatgtattatttgtataatcagggaagtagcaattcaaaaaagaaagaaaattactgcttaataagttaggtatggccaggtgcggtggctcacgtctgtaatcccagcactttaggaggctgaggtgagcrgatcatgaggtcaagagttcaagaccagcctggccaacatagtgaaaccctgtctctactaaaaatacaaaaaattagcctggcatggtggtggacacctgtaatcccagctactcaggaggctgaggcaggagaatcgcttgaacccaggaagcggaggttgcagtgagtagggattgcgccactgcactccagcctgggcgacagtgggagactctgtctcaaaaataataagttaggtataatcagatctttgagatattagccctaatgtatgtaaaagtcacgatcttccaccttatttaaagattcaactttaaatcacttctgggattacagtctctcagaagaaaaccaaggaggatttaaattggctaccagagccactggcaggtcctctggaaatattggggctcagaggaaggaaagtacttatgtgacacattaatttactatyggatataaaattatggctgaaagctttattgtttatctctcccatgccacttttaagagttgtgattgtgttctagagtatggctatagctcaaagagagagagctgagacgtcaactgattgagaaggagcagctacagtgacttcagtatgtggacacaagaagttagcaaaacactgatgaaaaagagkgagactgttttggaagaaactgaaatcccaataagtcatgctatccattgtaagtggagaagatgaggaccctatacagatgtttgaaatgggaacattagggcaaagctgggaagaagtattttcagaaagaaagaggtaaatggatgaagtatacgtcttccagctaagatgcagtacttctccttatcagtagccaaagggtaatatggagtacatggactggggcacagtaggcttatagagattcaagggcactgcactgtgacatagccctaaagacagcgagggcatgaagacagcagggtgaatcaatcccagcactgagcccatggctaactgaaacttccagcaacaaacacatatttttggtaaccaaacagaaacgtggatgaaaaaacccaggataattatctaacctatgcgagagggagagaagaggccttgttctaactagagcactgctgcttattattagctcctttggggctcagaagggctcatttattcggacaagcactggagctctagtaccagggatgttggctattgtgaagaataagttattatataaacagcaggataatctagctggagtaggagataggatacaataaatacttagtgaattcaatttccttctgagggcgcagtctgttttgagagtttctttggttaaaatgagggaatctgggtgagtacatatgctttacaagcaaaatactactctttcttattggtaaacatggggagaagggtgagcacttcagaaacatatttctcaagcagagtttgattttcatctataggtgatatccaatgctgagcatcaatctaaagaccagaccgaccctttggaaagagatgtacaaaaaaacagagagccaggggcactggaactttacccatttttggcagaaatgaaactgaggtaataatcattgctattactcccctaccccttcccaccatgggtatctcctctgccttctctttttactgtgtgatacagttggatgtcttatcatcctacccacactgcccaccttagccacattctaagtggtgagctctagaatcctaatctaagaactgggactgtgttagtgtgtcttctcagagtgaatatatttgtcaagttgatctcttgaagtcagaatattcaatggcattaagtcagtttatgtcataaatcaacagaaagcctttctccaattttctttccaataactattctcacttgatcttgggtattagtgaaaattggaccaaaattcttcaaactctcaccactgtttccttcaaaggagaatttaaaatattatgtatttttataatcagaaaatatacattcttttcaaaaagttagaaaatgaggcaaaatgaagaacagtaataatccctccaagaaccacattccagaaaaaaaaaaaaaactggttaagatttcaatgtaacttctttcagtcacatatatacaaaactgtgatcatttatatgcttatgagacagtcttcttttttttttttttttgagatggagtctcgctctgtcgcccaggctatagtgcagtggcaagatcttggctcactgcaaccaccaccttccgggttcaagcgattcttctgcttcaccctcccaagtagctgggactacaggcacgtgccactatgcctggctaatttttgtatttttagtagagatggggtttcaccatattggccaggctggtctcgaactcctgaccttgtgatccgcctgcctcaacctcccaaagtgctgggattacaggcgtgagccaccgcgcccggccgagacattctttttaacacagtattatatcatggggattttccttttcatttactattctccaagattacaactttcatagttgtttaacatatgagaggatgtattcttatgtgtatattataacctaccaaccccacaaaccagaattccagcacctggaggtaaaaaaaaaaaaaaaaaaaaagcatagcaaccttttaaaccatgattaaacttgaaacataataggacatatggatccaacccatggatatgctattccatttggttggctcattctagtgaaaaattgttgataatagtgctaacactatctttgcaaactttaagaaaaaacactgctacagtttcaccattttgaattatgctgcccaatgatttgagagtaataatctcctttatcatcttaattctcgatcttcctgtatctagattactcagaggtctgaccaagagtgaatgttgtattttaccaaatgcactttagcgtcttgttagaagaccatgtgttgggttttttgcttatttgtttagtatgttgatagattttcaaatattaatttggaattttattaatccatgaaataaattgtatcactttagtatatacagtttggatgtactttaattatggttataccatatacattcataaataagattatctatagttttcgtctatctttsaaagtttgggaaaacaaggctatttttgcttgataaaatgtttctacaaaatgttctataactttttcacattgaaacatattatacagcacagaaattttttcttgaaagtgtgaaataactattgtaagcattctgcatccagtgcaaaatccagtcttgattttgaaagtcaagatctcacaataggatctctattacctaccatagtatacatggcatagtttctgttgaataaatgtagaattctgtaagacagataagcacagttttatgacagtatataaaaagggcatcctcctcacaatagtaggtgagaaagctttcctagaaaaggtaatagataagaacaatccttccagtttaagaagacgccacacacaaatgcataatgatgaaaatgcaagctgggcgcagtggctcaatgcctgtaatcccagcactttgggaggccgaggcgggcggatcacctgaggtcaggagttcgagaccagcctgaccaacatggtgaaaccccaactctactaaaaatacaaaaattagctgggtgtggaggcaggaggctataatctcagctactcgggaggctgaggcaggaaaatcacttgaacccaggaggcagaggttgcagtgggccaagatcacaccattgcactccagcctgggtgacaaagtgagactctgtctcaaaaaaaaaaagaacaaaaaaaaaaaaaaagaaagaaaatgcagtattatggggagactgagcaaaactcatcatggtcagtgcagagcatttgggacatcagtagtggctccagagttagagagaaccagagttgacaatgtgattagaggatgaactagaggactttcgttgaagctgcagagcaagcacatattttcctttaagttgtatttctctattaggatgtcttttgtgaggagactgatggcgatcatggggaaacaaagtcctcctaataattcctccttaacacagtcatgggaggagacatggtatgaattggagaaagatacctaataggttaggataggcctgtgtaatgggttgattcagtgtctttggcgaagttaccgtttccctttctcttgttttgatctaaatcctgaaatatttcactaacacatataagctgaaaagaataaattaaaatttaaaataaattctgaaacatggacttcttcacctgggatcttttctgaatagaaagaaagacagccattcttcttccttcatytttgtatcctcgacatccccacctatagggtaaacacataaagcatacccttagaatgacactgtaatgacagaggcacccgaatgtgtgttctgatctagggaatctaggagtagccaacccagagatttgttctttctctgtgataaacagcctgtcccaaacatgggccgtgcagggaattgggtccctaagcttttggttggatgaagsttgccaggtggaggttgttaaggagaggattaagtgaaaatgccatataaaactgcatgattttacaggtagttgtggtttttctgtccagcccaccacccctggactctctccctgtatgtaattccctaataaaccccatgtctcatttgctgactctgggtctcttggccttttgcacctggtgccgcccctattgagattaataggggtttagcacaacaccatcrcccaagatacaagtggtaagtttagtgttctttctatgctagcacaaatttgtttcttctccacctcttctttccttccactttcctctacttcaaaacagctatgctctatctaattaaaacggctaccgtaactgcccactttgtgggaacaaatccatatgccaatgtagatagagacaggaaaaagaagtgcaagacaaagggaatattttccaacataccaacacattggtatcatctaattttttttaatctcctcccaaatcatggtgtaggtagtactctctaagaggaagacaaaggatatggaaagggaatggagaaactttttcccttcatctccctggagccagtactccrctactccctggagccactactgatgccccaaatggtctgcaaagaccatgctgagtttcttctagtctccccataatastacatttttcatcattatgcaacagggagctaggagggcttgccatctaygactacccagagagtaagcattcatcctgtcttcaaagtctctggatatgaaaaggccaaagcaaaagtgtggttgtagggtcagaataagatcagtaagaaatattctcattccacaaggagagcccagcatagatatagttcttgtggtaatagtgtaacaatgtatgagaaacagccctttatataagacatcttaacacaatacttggacatatcaatgtaatgaatatgaaacgaatggagcacattgagttttcaaagatgtggcactaatgttataaatgggagtagtttctcaaaagactctatgctgcatttagatttgcagagtgagggcaggggctgtggtatttttgatatgttactgataaaggcaaaggtgggctgggcatggtggctcacacctgtaatcccagcactttgggaggctgaggagggtggatcacctgaggtcagggattcaagaccagcctggccaacatggtgaaatcccatctctactaaaaatacaaaaattagctgggygtggtggtatgcgcctgtaatcccaactacttgggaggctgaagcaggagaaccacttgcacctgggaggcggaggttgcagtgagctgagattacaccactgcactccaacctgggcaacagagtgagactctgtctcaaaagaaaaacaaagaaagaaaagaaaaaggcaaaggtgatgaaaaggacttttgtatcattattcttgatcatgctttttttcatagctgtgaaatcgccttctacacatagaaaactgagcagaccaggcagggtggctcatgcctgtaatcctagcagtttgggaggccaaggtgggaggatcacttgaggccaggagttcgacaccagcctggccaatatgatatgaaccccgtctctactaaaaatacaaaaattagccaggtgtagtggagcatgccagtaatctcagctactcgggaggctgaggcaggagaatcgcttgaatgtgggaggtggaggttgcagtgagctgagatcgcgccattgcactccagcccaagcaacagagcaagattccgtcttaaaaaaaaaaaaaaaaaaaaaaaacagcgagagaaaagaaaagaaaactgagcagaccacaatcaaaagctacaggaaaaagtaagtggtccagccttcagagttctccatcacatcacatatgatcagaatcacaagtaaatgatgtttgctgtctcactgtaccccaacagaagatacatttttgtaatagtcttctcttgcgtggaatctgtgtagtaaccactgagagagagtagtgtatggtgggtaaaagggctgattctatagccagatggctagatattgaattctggctttagtatttactatctgtatgaccttgagaaagttacttaaacttttctttgtctctgtttcctactttgtaaaatggcagtaatactacacttaagaagagagaatcccagggcctggaaaaaaagctgtacatgctgggacctagactccttaatctctggaagcttctagaacagtcctccaatgattctcagactcctaacaggtttttgaaagaagtgcaatgaaatatcccactgagaacaaaaatgttcacagtctgtcaagtgtggtttcaaactttaaaccttttacctttaaaaagctaaatctacttttcccttttaagattggtagatctaaatattatactataattcataaaatgcatgtgtataaaaatacatttaatattatatcttgtataaggtaaatataattatattacatatatgcatmcacacacacacacacacatatgccatgttggaaccattaggttctaggcacctaatattttatctaattctaactatactctaagaaataattattgctttttccaagcttactatgaactatctgcaactcagaaaaataaacaacttaccaaagctacatccaggttaaatgatatgtcactggcagtctataaaatcttttaaatagaggccagcttcatcaaaaaaacagctttaagttcaaaatctctttctacatttgaaagcascatgttcctaaactttatttsacacttcccagaataattctggcagtattggtagctttgaatgtgctgctgtgtagtcctaagatatattgggtttctcaatgtctcaattttcataatcaataaaactagtacaatatccatactgttttgcttactgagagtattctaagaatcaaacacaatatcggaagcaaatttgtattgaaaatttgtagatgtacagatttacagattttgatgtatcaaacatttcaatttacctgaatcatgtccttytctatactacccagcaggcaggtgacctagaacacatggagacaagaaattactctgccatgactgaattctttctggtggggctttcccaatatccagagctccagctttttctgttcctgctctgcstcatcatgtacatgataatcctcctgggaaatagcctcctyattatcatcaccatcttggattctcgcctccatactcccatgtatttctttcttggaaacctctcattcttggacatctgttacacatcctcatccattcctccaatgcttattatatttatgtctgagagaaaatccatctccttcattggctgtgctctgcagatggttgtgtcccttggcttgggctccactgagtgtgtcctcctggctgtgatggcctatgaccactatgtggccatctgcaacccactgaggtactccatcatcatgaacggagtgctgtatgtgcaaatggctgcatggtcctggatcataggctgtctgacctccctattgcamacagttctgacaatgatgttgcctttctgtgggaataatgtcattgatcatattacytgtgaaattttggcccttctaaaacttgtttgttcagatatcaycatcaatgtgcttatcatgacagtgacaaatattgtttcactggtgattcttctactgttaattttcatctcctatgtgtttattctctcttccatcctgagaattaattgtgctgagggaagaaagaaagccttctctacctgttcagcgcactygattgtggtcatcttattctacggttcagccctttttatgtacatgaaacccaagtcaaagaacactaatacatctgatgagattattgggctgtcttatggagtggtaagcccaatgttaaatcccatcatctatagcctcaggaataaagakgtcaaagaggctgtaaagaaagtcctgagcagacatctrcatttattgaaaatgtgaaaaaccttgggcatgtgatatcctcaatggggcaagagagcttgtcttttgtatttagatactgcaaaacctactgtcacgagagcttgtgtgtttgcaaaaccaactattagattcccattcttttcaacgtagaattttcatgctcatgtaaccttcttaatagtgccttgtctgctgggtttgtagctgtaagcagttctgcaaactggccctataaaaatattgatgctgtccattaaaatgaatctctctctctcactcagtctctctctctgtctgtctctctttcttctctctcctgccatgtgtgtgtctctctctactcctctgattttgtcctctctctctattctgctactctctctcctctcctccgtatattttctttctcttcctttcttttctgttgtctcctttctcagtcactttgaagtggatatatagttgttgtgcagcatccctgcacaatattgccacccaattgacagatctgcataatatatattaatagaaagatgtatatttttcttttaatgaaccaaagtcccccactctcagtctatgttgtacatggtggggctgacccaaacctctgaaaataaagataagcatggaagaggtcttggcaaaaaaaaaaaaaaaaaagaaagaaagaaagaaagaaagaaagaaagaaagaaagaaagaaagaaagaaagaaaggatgtctaattcctctagtcatagtgattggtatagtgcaggatgtgacccgagccatactaattagactccatcccaggaatgctgcctttgtcagaaagacacactgttttttgaaatggtgtctaaactggtagaatgttaactcagaattcctactggcaaccattgccaatatgtgaggacagcatgagaatgaaagcagagctgagatacagagtgtgcttgatggtgtcactttaactcttgaacgcagctgtagctaaagccagattcaccgttgcagattttatttatgagtcaaattagcattttatgaaaaactaatttgacctggattttaccacatacgacaaaataaatcctaatatattcctttgtcctatcttcctctccatcctcttacattttaaggcaataataataataacaaggtatgtaatctgagaggttccaagttctccagcctgtaggagttccctttctcattaataactaaattacaataatctaacctctattctgcattacttcaggcatttcagtcatctccccaattatttctatggagcatttacgtttctaattttttgttctcatatttttcatcaaattgatttatggacttcttaccatttttctctgtgcttcaatcaatatattggtacttgaaataactgcattttgcttttctacataatgttttttagtttaataaacattgtcatttggtggattatggtagattactgtgttatatataaatacatataagtagtaataagccaaattaaggcagaattcccttaagggtgttgcatatctgattttgtccactctggggaccagaatcataactgtaatagattagacagggctcacttaattcagttatacagagatataattcctagattatatggaactcagaatttgacaaaaacaaaaataactaatctattaatctacaggataaaaatttttaaagcctggtatggtggtgcatgcctgtaatccaagctgctttggaggctgaagtgggaagactgcttgagcccaggagttcgaaaccagcctgggcaacataatgagatcccatctcaaaaaagtgagagagagattttaaaatgttttaaattccttaccatggtataccagacccatataatcttaaccccacctagttttaccacttcatttcctaccacctaacgatattcattagactctcattacattctcatttcactaccttcttgtttctcaaatatgccaaagcctttgcctttattattccttctatctgggacactcctcccctcgatcttccaagggttccctctgtcatttcaaataagtttttgcataaatgtctaatatattcttcttataaaagttgtaacatgtttttttttccacagcatttcactcctttaaaatgctgtatgtatttatcttttctatggatttattgtctattttctacaggaaaagttccttgtaagcaggtacttctccttatctattgctatcttttcccagtgtgtagatcaatgagaggcaaataatagctaatacataggcattggatgtgaaaaagcattctgtaaagcaatattatgtacttactttggagtatattcatacataaatgtatgcttccttctgactaaataactagcaggaaccctaagaccagtagttaaaggactatattctatacattcccagtactatcttctttccacacacttttcaatccaggttctgttgattctcttatatgttgacatgagcttctcattccataatgtctgtgctgaaatcagtcactacatcttgcaggaatttgatttgtctggagaaagtcatttgtcattgcatttgaaaatacaaagacaattttaatatatgctttattaattgatttttgtgaaggtttgtttcagagtgtactgcaaattactgcatacatgttgtccattgctatggaagtacttttgtttcatttttcccttctctttttaaaacgtcagaataaatttctgtctcaaaatttatctaagtgcttgttatcttttttgcagactctatcatagtcaatgttttctattgtgctgttggttgaagagaggatagtaatataattctactgctgtacagagtcccttcttgattaaggtccaggcagtaagtttcctattttacactaacatactacttcntgggaaactccatttggcataccctctgatggaaataattcagtgaaataccaattattaatgtagtaactgcttgaaaaagtagaagatagtattaccagactctaaaaacatttacaaatgtaacatccttgaaagaatatttgatttttgattccaaatatctcttacacataatgttaaaaaggttaaactcgacataacacaaattttgggccaggcgcagtggctcatacctgtaatcccagtactttgggaggccgaggcgggcagaccacgaggtcaggaaattgagaccatcctggctaacacggtgaaaccccgtgtctactaaaaatacaaaaaattagccgggcgtgttgacacaagcctgtagtcccagctactcaggaggctgaggcaggagaatcgcttgaacctgggaggcggaggttgcagtgagccaagatcgtgccaccgcaatccagcctgggcgacaaagcagagttgaaagaaagaaggaaggaaagaaaggaaaggaaaggggaggggaggggaggggaggggaggggaggggaggggaggggaggggagggaaggggagggaagggaaggggggaagaaaagaaagaaagagagagaaaggaaggaaagaaaagaaaaagctcaaatgtctcaaaactataaataattcttaattgggagaaatatactcacaccttaaaaaacaaatcaacagtaccagagacgaagacatttaagtgaaaatttttaaatgtatcaataaggagggctacttttataagggaaaacgcatatactattgtcaagaataaaaacttttttcagactgatcattttagaagaaatttgaaaaagaatatacttgtaaaaaaagacaactgaggccgggtgcaatggctcatgcctgtaatcccagcactttgggaggctgagatgggcggatcacgaggtcaggagtttgagaccagcttggccaacatggtgaaaccccgtctctactaaaaatacaaaaattagcggggcatggtggcacgtgcctgtaatcccagaaacttcggaggctgagacaggagaatcgcttgaacccaggaggcggaggttgcagtgagccgagatcgtgccattgcactccagcctgggtgacagagcaagactccgtctcaaaaaaaaaaaaaactgtagtaattttaggttgtcatgttcagagtgaatagtattatctctagttttattttccccataaactagattctttcaactagagtttttatggaagcataggtaattcccataatgcataaaaatactttaaataatacatgataaatactacataaaatacttttaaaataatgtatatcgtattattttaaaactgaggctaagaataatgggcacccttgtaaaatcctaacttgagagagaaagtaatgctagctttattaatacctctcatcacttatttctagaggctgttgtatggaactcagtcatgggaagaggatcctccttctccatctaacaatctacctgaatggcatcacttgtgtgccttactgtttaaaaagcataaaaatctaaatttacagtattaaaaaaatgacatagggaggagggtaagcttcttttatattacctgtagatctttattaaactggacttcataagtgtttctgatacatgaaatttttcttggcatgccataaatggttttccaaagaaatttaggatgatcacttccagtatggccgtgtaagctcctaactctaatgcatataacagtataatggatatggatatggacaaagtacataaaacaaacattagtcaatgtaaaaagcagacagattcaggatggatttgaaactcagaaaaaggaaaattatgagttgagttggagaagagcaaagatcatctggtggcttgagttggagaagagcaaagatcatctggtggctatcaagcaaaccatccagaggcaaaactccttatctgaagaatttagaagtaattagacttccctattatctaaagcaggcatctggtaccaggcttctttcccccaaattaataaataactagaatttctatacatctcaggaatgcatgcatggcgaaactcattgtgcaaactttgctgacatcaaggcacaaaaatgcctacaaatataatcatttatcatgacctacaggactaataaggtccaaattgtccttaaactcctgctttaaggtccatacatacctctaaagaaaaatccactacagtgtgctcagtcctctcttgctgagtcgcactcagacgcacccagaagagtcgcactcttctgcagagttttctccttctaatgacactttccttttcaaacctatactgttgtcagtaaattcttcttaccacctgtgaaccaaccactttccactgccagggctctaacatctcaccctgcagagttgttcacatttacggcttttagcccaagggcagtcaatgctgcataagataaaactctgatagaaaattgcagtgacaagtgtaaccactttaaaatggcagggaaacctgaaaaagagaaagctagagagaaaaagccatgaactgggcaacatacactctgccctaattctggttgccccaagccctgcatgcatggggaagacttaataagcccagccacaataaagagctgaaataagattcaagacagaacgtctcatttgagtaaaatcaacttgattacctgttaaaacaaaaacatcaacatgtttaagtaacagatgctacagtcttcacaacattacatccaccatgtccagatacaatcccaaataactctatgtccaaaaaaaaaaaccagaaaaatgagtcctaatctaaaatataacagaatcaactgagacaagtttggaatagaaccagattagtaaaagatttaaacaggcacttcaccaaaggagatacacaaataaccaataagctcatgaacacatgaatgttcaacatcagtagtcgctatggaagtgcaaagtaaaccacaagagtttcacat

SEQ ID NO: 10719 - DNA, 109725 bp, Homo sapiens
agaatgtggcaagcaacggcataagcatttgactaagtattgttcttttaatcctgagactagctccaaggagtatcagttatcattgtacccgttttacagatggagaacttataagaaaggtgttaagtaatttacccaaggtcctactcctttttgtagctattattggttaaattaaggtttgaaaccaagtgcatgctaggtaatcccaaaactccaggattggcacaaatagacagggacaaaggaaaataaccaaagacaaccttgcctcctcagatctttatgtgcaagctccaaatcactcaatctagttcatgaatcaaagaatgccatctttgcctttgggcaattgttacattaaatacataagaaagcacccataataatagacaactgggagctggagtcctcttggtgggtttgaatcctcttgctactatttattacccatgcaccctggacatttccctaacctctccatgtctcacaccccccatctgcaaaatgggaacaatgataggactaacccaaaggctcattgtaaagattaaataatttaatacatccaaactgcttcaagagtgcctagatcacagaaaatactcaatcagtgttagccactgttattctttgtggtccacaaaagaaatcttaagaaacctaagagagaaggaaaacaagcaaattatacttcctcacaagtatccaacccagctgtggaaaatcaaagaaagaaattcaatttgcattgatttcaaagctatatattccctctgtgacctgtattaagcccaagatggtttgagccatttgtattcatcacctcagcctgagctcagaccggtaaacatgatcaaaactgcctccgagccctctgttggaaatatacaactccacatcttctaatttagcttgggcaatgctagttttttaaacttttcctctttcccttcaacctccgaagaggcagccttttgaatattttaacaagacagcaccaggtggcttcaactcccctctccctgctgccagcccctgcaaagcccagaagtgcttcagatagaagctgggttccgtgctttcataaacacaatatagctatgcagagattgagctttttgttgggatttggggggtggggggcggggaagggaactacatcatttagcatcaaaaaactctacatagggcatcccagcttactaagcactttgtcttacaccctcttacttggtcttcataccaattttgaaaggtactcaaggtacagatttttatctcagttttataaaacaggaaaccagatgaatcccaagaagaagaggaggagcttcagagaggggacatgcttttctcaaggtaattcacattgtaagcagttgggccaaatagaacccaagactgtgtgctaatatcatatattttccattatgcagccaattagttgatcagtcaatcatttcataggaacattaatcaacctccaagtgctttgggtctgtacaggtgaaaagcacagtccttggcctcaaggagtcctcacagaccagctgggcaaatgaatgagtaaattgatgataacaattaaggtctctaatcatttcataaaagtcacttcaagaatgcctttattgcttacctccaaaatctgtgacaggtcgtatgctattctaaacactatgatatgtaggaatgatattcaaaataattaacaaataacatgacataggcagcagccatcaacagatgctggcaacaaagagaactgctgacaaacagatggaaaggcacagtgtctaccctcaggtgtccatgatctagcagggtaaacaggcaagagaaataaaatgtgcaacatactaaaagttaaaaaatggtggtgtagatgagcatgaaggagaggcccttctctctggatgtgagggtcataaaactttgttagaagaagcactatgaaggaactcttgaaaaaaataataaaggaatttgtcatggcaataagacagggttcttcctagggaagtgaatgtgcaaaggcttggagacttctaaattatttctttaaagattttacttgagagttttgagttgctataatccctgggaattccccacttgctaaccaggaccctgtgtgtcagcggggaaagcgattttcccaaagtcacacagcgagttgatgcagcatcaagacttagacactcaaccaatgctctccactctgctgtgctgaccaggcatgacttcttggttgatggcgcagctaaattgccatagtccatccatcagagaagctctcatatgtcttgccacacactccatatggtctttgaacttgattttgtcctttgttgtcgaaggaaaagcaagaagagttggaaaagaccactcaacaatgatctgcaagcaagttgggaaaccttgactctaacaaaatgcatttaattaaatgactggcccactgtgtgggatcagagatccatcccggctttggaaaagatttctggtaattatggagtcacatgagacttttggactggagttagcacaccagatgagatgaatcccgggaagaggaggaggaaggttgggaacagtgaaggagtatgtaatcagagtaggaagcaggggattccatggggaagtggacactcagcttcctcagcactagtcctggccaaaattccactcattgtctgttctgtctggaagaaaaagtattacatttaacagacctttaaagaaatgagaatgatctcacctgaggcaaaccatgacattcctctggtctctaaaccacagcctccaccagcaactcctgaataagaactgcaaacaagcaacaacaaaatcagtctttggcaggaagctctgtgcaggggtggtgtttacatgcattcattctaccctctcaagtggaaaaaagtgcttatgcttctcagaaggatgcaaccatgagggattagatgccaagaggtatggcctctgccaaacaggaggaaaaatggttcttcatttccataaacttcctctgctgtaatgtctagtgtggcttggttgctcagttctgattgtgacagttttcttcctggaaagcaggcatagtggcttcagacaagtcattcttcctctcagcaccccactttctgatctgtgcgatggaagcattggacacaataatccagtttccttttcaggttctatggttgtaaaaggaagaatttaattataaagcacaacatgtcaaacatttatttgttcctccattacttcattcattctataaacatttactgagcttctatgatacccaaggctctatgccaggtacagaaaaagcaagtgtgatcaccagcctcaggaagcctagcatctaggaggaaaatctagacatgcacatgtgtaattataccatgtagatgcaatggatgtcctaatagagttacaaatgccatagtgcatagaaacatctcttcctagatggatttcttccatttaggaagctccatagtgaagtcagatcagaaatggatgataaatagatgtgagggcatggaggtgaggagcctagggcatcatcctagcatgaacaaagtttgggtattgtagagtacctggtgcatatggacccatctaccagaaacagaggctgcgaacagtacagggatggaaaacacgtcctcgtctgggcactccttactcaaatgccaaaaagcttaagatgccacatagctttttggagaaaatgccttttacaagtagcctctcctaaaaatgcataaatcatctcttctctatgttatcagaatacacttatatgatagttgttaacttaacccataatagtattcttgtttgtcacctctgctagccttttcctgctttgagggccagcctggtcatatttggcttagtttccctgtgattgaccataccacttgtggtagacactaatcaacgattgtagaatcctaaagaactggggagaggagttcgagtttgagacattccccgaaaaagccatatctatctagttttctagcatgcgctcttgtcttatttaaaaactcacatagaattataaatatattgattatatgttctatacaaatatagtttatataccatatgacatatattgtacactattctaatattttaatccctaacccaagagattaactcagtaggaaccactcactgctggttgagacacagcttcatgctactgaaatatcctttggctaaagcacagaatttaaaacttcccaaacaaccaacatttgaatcagccaaaatggatcaaaagttcaaatgagcggttttatgacatgactatttatgggctttcttgctgtctgggagggtcactttagcagagaatcctaaaatactacagccaaagcaaccgtaggatgacctaatcgtgtcttgctttttttttcagatggggaaactgaggcccacagcaacaataataactgtggggatgatatcatttaatattgaaaataagtggataattgagacctccattattagtagttaatttttaaaaatcaaagatctctcctaattagctttatggagcaaataaatatattttccatattcaaatatggctgtgatttctacacaaatggtgttaacaatctaatacagcataaaacattgtttaaatatcatcataccctattcctaaacagtaacgtgtaatagatctctggagcccagtgttgtaatataaacacttcccaggtgtattcccttggtaaagtttcattacttctctaaacgtcagttttcttgtgtaaaaaagagacacttgtgtctatcctacttactggttacaaggatataataaaaatagtgaacaaaaatagtgttcataaagtaccctgcacagcacctgattatagacttaataagggagggctcaatggtagttgcgttttgaattacatttaatgcttcattttacttcactgtcacaaactactatgctctgcggcaggctcagaagtctctaggcacgggtgaagtgctacttctccactcccttaaatgcccctgtatgccctgaggatactcaatgcatgctaaccaccaaacgaacggatgactcagagcttggaggaaatccacggcaggctggaaagcaaaggcgcagcttatggctcaaggattaggttgttacctttttaaattattgcttttctttaaagaaagggctgtgggggacgcctttcagcactaagagaaaacctcagaaatccttccccctggagacccagctgagaagaccacaccaggcacagggcatgaacaatgtcaaaaagctactgccctgcaggacactggggctggaacaaagatgcctcccagcagctgggcaaggctggctcccacacaagaaaagcagggctgatgtgagcgtcccgcacgatccccacctgctgagacctaatcctgggttatctctccgctggcccagagaaacctgaaaccccccaggcttttgaagggctttatctcctctttccaggaactgggctcagtccctgtactcgctccgaggtgccactgagcagctgctgcccagagcccaggcgagccctggtcccatttccagcttgaccaagyacaagaggggagccagggctgcggatcctactccctcttgctccccaggcatccgtctcacaattagaaaacccgtgtggggagcaaagcaaaaatcacatttcactaacagctactcggggtcgggggcgggcaggcgggaattcctactttcgccataaattgtatgcaaatgggttccttccctggccgagagccaggagtgagtgcgtctttcatgagctaaccctgttccgctgggagggctgttcctttaattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaaggtaagtctgttttgccctcatcactagagatccttatgatgtaaggattgcattcctggtaccaaatgagttgtgattttatattataattacaaaacatatggggtttttttttccaccgctggaaaaaaaaggagtgtgtattggttatatcagatgcaccttgacttttctggtcttgtaattttgtttgttttaactttatgaatagtcagacttggaaggaacttttcgtaaagttgttatcttctgctgttctgcagaggaaaagtaaaaattttctcttcaactgctctcctacttctagtctggctgattcacctgtatatatcttttattttgagggttagggcagtagagttttaaggcagactttgctcatagcctgcccctgggatgggttagagggagtttgatagaggagtgcagggagaatataaaagtttatatctaaacagcacttacataaagtttacaaagagttttgtacccattccctcatttggtcctcaaaatattcaccctggaaatgagagctgggggacagaagagaggaggtggctcctgggccagatgaataactgacaggcagctagagagtggtggagaacagctttactggggtgcctagagccagcagcgtcccacatgtctctagaatcacctcctcctcctcacctctcatcacagaaagatctgagcaacaacatcccccaggtatgggaaccctgctgcccctggtgtactttggaaagaacacaggggttcttctcacccatcagtgttgtaagaggaataagagcttaggtttgaagccagaggtgtttggtattctccccaccaccatacatatgaccctgagaaagatacatcacttccttaatcctcagttttcacatctctaaaatggggacaatagcgtctgctgtcgttttgaggagaaaatgaggtatagaaagatcagcaatgactgcttaataactggaagtttggataatcattgtcattgccaaaaactgccatcactctggaagttaaaagaggcattkagccagtcttggattgtttcttgtgtgttgttcctcagcccgcccccagcccccgctttttatctcacccaatctgagggtgtctcactaggctggcaggtctgagacttggctgtattttacaagcaggaggttgtgttggcacaggttggagaaaaggtagtagcccggggctggaagttaatgtcaaattttgattccagaatgtcaggaggttttgagtttaggcatctgcagattctaaagctgacagctatgaagtacgatgctgttggaaactctttggaaaagctttctgtcyggagggagggcaggacagggagcaccacttgaagaatgaatgcctctttttcatgtttttgtagactttttcccccatttttacagagctttcccatatgtgttttagaaaggaaaactactatccatcccagccaggcaagcccaattcaggactgaagaagatttattcagtcctagacaaccaagtgaagagtttctggctttgtgcgcatacaagtcatttgcaggagatgtaagtcagcgtgctttggcccttgcatttcaggaaggtgactgctttgtggggaagaaaaaggtgcacaatatgagtattctctggtttgctcaaacagggtaaattggacaaggattgaaagggatgttgccaagctctacagtcattaaatatttttttcctctatgctttgttttaaaaacctagcttctctattttatcccmcactaacctcctccttccccactctaagaagtgactaacgtttcagccctcaactttgtcattcatataatggagatgacaaactatgtctcacagggctcttgcaacattcaaatgaggtaatatatggcaaacwcttggcatagtaccttccacatattaagggttcaataaatggaaacttttcttagtttctctgtttatcattttacaaggacttgtccaagattaatattctaagatcatgatttttaaacttatttttaatgatgaaaatattcattacatgaatttagggcaaacccccagtatatgacaggtaaatgcagggctgctttggttgaagtggggtcacaaggtctaaaacttacacctttgctcttagcctctgggacattgccacagaatcttcaatgacaaaaagcacatttacaaatcatgaaaccaggctgtgtgcattctggttgccattctgcccttcaacaaggatttttgcccctctgagtcaccatctgtagcagaagtaagagcaagtccacaaatagtgtaatagacaggaatatgaatgagaaataaaagacttaacaaaggctattttaattaattctaatgacaatgatagccaaaatatatgatgagcctactctctaaactgtaggcttttgtgggatcatccacagcatgtctctgaggtatggactatatttgttggacaaagagatggcttcaagaacagggagactgaataactttaccaaggtcctagaactcagagtgatacagccaggtttcacacccaggtccccgtgatcaccaagtcagaggtacattctgccgtgttccttctgaatgcttctctgcttcttgcctgcctttagaaggaaaacacttcctttctgactaaatatgcccctccaggcagactgtggccacccataaatacagcagtagcctgatcatataaccagaatggaatttggaaagagaattcaagctgacagaatgaaaaacatatcccccttaatcctaccctttctaatgctaacaataaattaagagcacatattctctcctctctctctagatttctatagacacctagctgtgctttcttacaagaaaacatatccactggaccaaagcgcagcccccttcatgctgaagccacttcagtttgaaacgtaaaaagtaggttgcaaacatttagttggctcgaaatatatgtccttttgtgatggtaaaacacacaaacacaaagttaatagtgagggctatgtgtcacatatgtaataggagggtttgccaatggtttctcatctcattctcactcagacactacaaattataaattactagctcaattttaaagaaatcgacactcaaggaagttaggtgactcatctgaggtctttccgtaattgaggggcagagctggctttgacccaagctttctaactaataccccactgttctttctgctgtgctatattgccttctgaagtcaggctgtgctgaccaagtttagaaccttaaatggtgtctttcagtgaatgatcaagatggtggagaagcccccagctggcattggtgcctattgattttacagaatagccctgcatgtatcatttttcatggttctcagcaaaggtcagctctcaatggtgcaactctctgcctggaaacaggaaagttcaaatttcagccctggaagagagaagaatgaaactagaggtagcagtcaggtcactcctgctgattttcatctcagaaaagtaggcacacaggtgagccaaacatctggttttaaaagggctgattggtaggtaaagtgaaatcggccttggggccatgaatcccaggacagcttggaaatggttgtaggctccgagccacaaattgagccacaaattcagcggaagcctcagagaggaagattatgattcaaatacctctcactctgagaagattgtagggaatccccttgaatcttatcccgggccagtttgaacaccttcaacatgtgggaaacattagatgaaggctcccttccaaggaggaaaacccccctcaaagtgtgacatgaccagcctcctgcaaaccccaggccataattccattcaatgtaaaagacagagatggtgaacttacctaccttcgggggctatacatgctttgtgacttctctgtaaaggagaaaagtctgcaaaccaacctgattctaatcctggtggccagacatttttcagttatgcccttaagcctaaactcctttccctccaccttgtctcacatttccagcttctcttccactttagaaacaaccctgtcactatcattactctctttggcccttcatcatggaataaaagcaaaatgcccaagtcaaaagcagatcgcgaacggaaaatcccttccatgtgcatttttagtctatctgtgaatggagattttaaaaatatgtatttcatgccacgtcgtctcagaattttgaagtttcctgaagttcataggtccttcatgatatagccatggtaacttaaatagctttgtttggtcctttaaccctcctcaaataccctataccaagagccagagatatatcatgagttctgaacatagatagctttgcttcagaattgaccgttgttcacctctaaccctaaagctggctgctgctaacttcgacaagaatgtgtctgaaatgttctcctaggagaatcctaggggataatcgtaatagctaatatttactgaggactctataggcatcatgccatttagtcaaccatagcttctagtaagtcttatcacccaccctattcaaatatgcacaatgtaaggctgaaaacgtttaagtagcttacccaataccatgcagaaagtacttggtggagttaaaaatcaaacccagttcccagtcctgagaggctagttataaccatttcagtaaggaagtcatgctcagctccctaattctattcatcttctgacaagagagagggctagacacagcaaagctaagaaagacacaaatcttgtctttttggccctggtgttctttgacagactggttaattttgctatctccagcttgctccttcaggcttcacctcttgaaaaaaactgtaattaaatgattagcatgtgacccataatgtaatacgttttctctactagactttaagctacatgagggcaaagcccgatccacatcacatccctgcaaccagcctgagacctgaagcatagacacacataagcaagtgctgcccaagggaagccatgagtgccctgcaggctgcctggaatccccctgctccaggttccaactgagctctgcacgtcccccgctgtctgtgtcataattacccctatgattgccttccctgccacactggactgtacaccactgaggtcaagaatgttagggaggcgggagctttgtctgctggagttcattttccccaaaaacggacccaccatgggcagacgcaccattagcacagtccccaaaggagatgcccaggactgtgggatggtcttgtgaaggtcgatgcacagatattgcagaggaatgctttaacttctaggtaggttactattttcttaaatctccttagggaatacagaattttcaaactaaaagggcttacgggcagcctctaagccagaatcttgcagactggattttaaaaagaatttaaaaagatttgggggctgctgtggagagacagggaggccaagcaggggattcccctcaaccttatttcaatgaaagcccctccacttatctattttgtacactgagcctcctcatgaaattttatttgatgaaagggctctgtgcagaaaaaacagaatgtttttgtaaattgctggcctaggttagcatacctcattttaaagagggtgaaactgagacatagagaagggaaagatctttctaagatcttccgccagttggcaacagggtcaggttggaatcctaggtcttctgactcttgctcttggaagccagggacaatcttaaaagtttcagaattaagacattcttttagaaaagaaaaatgagcagagtcttattctctcaacagccttaactcacacggaccgagccaaggatgactagtatctccgtattcattatctattactgcataccaaattactttaaatcaacactcatttattatctcatggtttctagaggtctaagcacagcttagttggattttctgcctcatggtctctcatgaggttattgtctgtgttggacagggttgatgtctcatctaaaggctgaattgggggatgattagcttccaagcttgttgatgtggttgttggctggactccatttcttgagagatattgaactgagggcctcagttccttcaaagctgttggtccaaggctaccctcagttccttgccacatgggcttctccaacaaggccatttacattaacaaagccaatgagaaagagagttaccgggcatggtcgctcacaccycttaatcccagcactttgggagcccgaggcgggtggatcacttgaggttaggagttcgagaccagcctggccaatatgctgaaaccccgtatctactaaaaatacaaaaaaattagcctggcatggtggtgggcacctgtaatcccagctactcaggaagctgaagcaggagaatcacttgaacttgggagtcgtaggttgcagtgagccaagatcgagccattccactccagcctgtgcaacaagagcgagattccatctcaaaaaaaaaaaaaaaaaaaaaaaaaaagagagagagagagaaagtctataagcaagaggcacatcacaatcctgtgtaacctaatcatggaagggatattccatcaccttagtcatattctgtttgttagaagaaagtcactgggccatcccacactcaaggggaggtaattgcacacgtatgagaatgccgggaggcagtatcaatggggccaccttagagtctgcctgccacagcctccagcactccagtgtcaccaatttctggcaacctcttatcaatgacaagttcactcaacccttcagtaccctcactgatgagtaataaaaaaattgatcgagaccatggtgaaactccgtctctactaaaaatacaaaaaattagctgggtgtggtggcgggcacctgtagtcccagctactcaggaggctgaggcaggagactggcgtgaacctgggaggcggagcttgcagttagccgagatcacaccactgcactccagcctgggcaacacagtgagactctgtctcaaaaaaaaaaaaaaaaaattctggcagccactaaagtggactagtttttatttaacatcctcccatgtatatagtggagccaagtgttttgattagttgttttaactcattggttagccataatttctcttgaatttcaccccagggaggggcctttcacggcaatgattccaaatgtattttattctaaagcaagacagtcagtgtgaccaaaactaaaactcatccattgttcctccctcaatctattcctctcagcagatataatgaatagtaacatcttcgattaattcttttttctttactaaccccacacacaaaatgttgtagtctctactgccttgacaagcaaatctgttcactgcctccccactttcttgatcaccaccccctgccccacctccattacccctgtagttcagatcttagcatctcacagatgggccactgcaacagctttcccactggcccccagcaacccagccttccccttcttcaacctgagacatagaggttaacattcctgggcctcaagatttccaaatgcttttcttctgcctgcaaaaaagtccagatattctgacattcaagattctccatgatcttgcttctggtctctaaacagatcctgtacttcagctgtcattcatactgttcacatcaacccttttattctttttatatccttgtaaatgccattccctcgtgcctagaatatccttttttatgtttttcacctattcatatttttctctcaaaattcagttcaggcaccacttcctccaggtaaattagatgcccttttactgtcatctcattctacctatgtttctttttttaaatctatcatctcctttatcatcctggaatggcctgtctgcccctcttgacaatatagttcctaaaagaaaaaattgtatctggtttatctgaaacctagcacaactggaataaagttaatctttagcaattaataggagtccttgctgtgtcccagatttggacatcctcttccttagcagtttgctcagaaagcccagagcttgaagttgttttcacgcttcacccactggcttgcaagtatgcagtgtgatgacacaacatgtgataggaggaaaccatcccagccctaggacaggaaactgtctcaggacacagacctcaaggaatgtgtttgctttcagaggtggccttcaggataaaaacacaaattgctttggatttggaaaaaccagtaccaaggacagaggagtcctgtctggggatttgaggctgagtcacaagagatagctgaaaatctggaggttataacaaagattagtcaacaactaataggaggaaagaacaggctcaagggtgggatggagacaaagagctctctatcttaggacatggagaagctcacagcccacaagaagaaatgaataatggttaagagtatgactttggcataagaatcctctgggtttgagaggtatttgcttgctatgtgatcttggccaagttacttagcttctttaagctaatttcttcttatccatattaaaagcaaagtagtagcacctagtttaaagtttattgtgatgattaaatgatgtagttcatgaacactgcttagcacagaaactggcattcaatataaatgttttgttgttgtcattgttttgttacctgttgatcaaatagttcttgatgataagatcccactagagaagcagttcccaaaagtgtgtcatgtggaaaagcattctcatgggaatcacctaaaaaagggttttgtggccaaatgagtttgggaaacacttggtactcttctgttcttggaaatgcacagctcatatgtccattcaatacatagttttagggctggtgatacaatagaaagcaatacagtcaagatccttttattcatggtgtttacattatggtggcatatcttagtttgtacaagctgctacaacaaaataccataaactgagtgacttacaaacaacagaaattactttctcacagttctggaggctgggaagtccaagatcaagatggcaccttatatgtcctcacatggcagaagacataaggcagctctatggggtctcttttaataagggcacaaattctatttatgaagcctctgccctcatgatctaagtacctcccaaagactctgccaactaatattgtcacactggtgattatgttccaatgtgtggattttgagggaacacaaacattcagaccatagcagggggaaggcagacaataaaaaggaatcacataaacttatagcacaatttcaggtagtgatatttgctaagaagaaagacaaaacaaggtaagggcataaacaatgactggtggtgagaggagtgctcttttagatggggtgagaggtgaatgtgccattgtgcagatgtctgaatgaaatgagagaaggagctctgtaggcaatggctaggagtttgaatttcattctgagtgtggttagaagccaatggatggttcagggaagtagagtgcatcatctgagatatcttgctgtaattaatctgttcaactttcgttagcccagtatctccaaacatacctgaccataggacatctacctaaaaacatcttgcaacgtagtctgggaaattcttcactggagcacaaggcttcatagattttaaagggactgcaaatttgctcttgttcatctagatctgcactaaaaatccaaacatactgcttgggacaaaataggcatgcccaggaaggaaaacctagctctagaggtagagacaagcaggatgtcatcctaattagcagctctttttggcaaagacaatcaatgagcacagccaggcctcagcagattctggaagcccatttgatgccaacggaaactcgccaatatctacccaaggctaataagtgtttgcaaacagtacaccttggcttaartattctccaaaaaggaagtacataaaacttgagatccagccagaggttctgggagaaaaacagaggtcaaatattttggtgcttacatgtgcacagccaccaaagagctgctgaaggtctaggaaatggaaagtgagttcatccacttgaatgctgatctctttctttatggagcagtaaaaatttaagtttttaccttatctgaactaagaaaattcctttaggagtcagcccagtgtagctcaatgtagttgaaagcagacattttagaaccacaaataaatcaggattcaaaagctrgctctgcctcttaagccagtcatggaaactccctgagtctcaaattaattttcaaataagcataataatacctaactcaccaggttgtcatgacaaatgacaagataaatgatagcatgaataaaaagcatttagtgtaagatttggcataaaaatgtatataataggcactcaacaaaatgttagtttccttattgttcaattcaatctgtatttagtttcataatagaagctgtcatttattgcataactactatattccagcagaggttagcaaaccatagggtggcagcctatttttgtaaataaagttttattggaacacagccatgctcatttgtttgtgtattatctatagctgctgcctctacaatagcagagttgaatagttgtgactgaaatcatctaactgcaaagctttacatattttctatttggtcatttaaggaaatgtttactgatcccttccagtcaaccttactaaatttttatacttactttccagtcaccttaacctaacaaggtggatattatcatacttgtgtatatagagattgaagcagaaaaaaaaaatcatctagtaagttcccctccaaaaacataatgccaaactctatacctaaaagaagttcagaataatgattaaaagttattcatttgtatgattcatcttcatttgcctctgccttcctctgactagtatttctctctggctaatttcttgaatttcctgccatatgctgaattaaatgatcctatttagaaggaattttccctcctttccttacttatacaaataagttgtttgttcatagaagtccatgctttcaaaactgaaagtggtaatttccagcccctctgaaacgctctctgatcttgactgatttcttggaaaccacacgttttttagatagtacatagtgtgaagcccagttttccagaaatgatagatttttagctcccccatctgctacttctcactgtatcttcctctcacttattaaccttctcttcaggtcagactcaaggagagcaggcttttctccaggggctttaaagatttgcctaagacacagatattatagtccacctggcctatgccctcccctcaagttcacaacagtaaataaaatagttatgtaaaccccaattcccaaacaccatcctaccttgttccattttgcaaatccaacaactctattcatattaatgatattgtgtttctctctgatagttagtagataaatattaattctttaacttgaacaatgaatcttacttcaaaggtaacttgatatagcagaaagagcatagactttggaattataagactgttcttaattctgattcaaataattgctgactaggccacttacttaaccttcttaagccttcagttctcttaccagtaaaatacaaacaatgctccctaattcccagagttggtaacatgattaaacagcatttgtaaagtgccacgcacagtataaatattgacctacttgcttcactcttagtttaaattgctcaagatcctctaacatagagcttcacattttatcccagagaggtcatagttaggtatatctctacttccttctaatacaggargaaatgaaaggagtaagggtctaggatttgttctctatcagttcttcccccatcgtgtgccatccaacctaatcctgtgactcacttcaaacagaataatcaagtagatttgggaaacactctataaactgtccccttcttcgagatttccaacgagcatgaacctattaaacaccctggaaaaacctgaagtaaagaaagttgtgtaatttgtttggcttaaaatcatatttggtttaaaataacattttccaaacgtgtttaattaggaaatctttttccctcagattagtacctatcaacgtgttgtagattacactttagaaaatgctgtttaaagttacacagctaagttaaagcmaagttaagggggttagacatatctctatttttcagatttttctgcagtttttcctgtcctgcctgtagatcataaagatatttcattaccagtagtttctctggaccccgaccttagttatgcaaaccaccctttaacataattaaaacaagtgaatcagttcacctgatttaaatttctgttccccgtttctagctatgtgatcttgagctgtgtgagcctcagttttctcctccataaactgtgaaaaataaagacaactacctcagaagtcttggggaggattcaatgagataatccacagaagacacaaaaagcagtgtctggcacagacgacatatgcaatcaatgttcattattattatagcatttagatggtcccattttgggaaagggaaaatagacaatgaaagtatgtttgctttgcctgaggtcacacaaattaattacgggagtagtcttagttttccctgagagtctggtttcctgcttccagtcctagagacgtatttttgtttcatgagtcatattctatcaaaatgtatgagactttattgaacttgatttaaacaggattttgtaattgtcaatggctccatctggctccttctgatgcaaatcccactcaagcaggattccattcatttgaatattagcacattggatcgggaaagatttccaaagctgtctagttttgctatgccaaatatttggtgtacacgtcaacactctccactcctgtacccatggtggatattgctaatccatcacagcaccttttcccgaaagcctaatcatagccacagaatctttctcaaggcagttccaggtagctatgtcagctctttgagttgaaacataattgatcccaaaccaattctacttcttaaccagtgcttgaaccacctctacactattactcttttattttttaatatgcccaatgtcatggagctctctcataaagggagacaggaaaaggaaagaagaggagaagatatactaacatatgtgtaacgtttattattaatatgtcaggcacttatagctttgttgtcccattcactgcctcaaacaaccctggagagattttatagttgaataagccacaattcagaaggtataggacgttgtccaaggctccccagcagataagtagaaattggtcttaagtcttcctgactctaaaggcaatgcccctgtctctcccatcacaatgccttcttaaaatttttcagggtctttcgggactaaatttctgactttgggtggctgataacagtttcacaaaggcaaccatctcacagacccctattcagaagttctcttatttagggttgtgttgtaagtctgtctgtaatcggttcttcctagataaatctcttccatttcttaaccttggctcaagactttgagaactcactattcaatgcttctgaaagagccaactagatttcttaaaattctggatgaagaccaaaatagaagaggtcattgttccattgggaaatgaattcaaatttatttttgaaayaattttccagaattttacaggaatctatattgttgccacttgtccagaaccactttttattttcttttctgtctaggcaagaaatagaagagagaaagcaagtgctctgcagttttatttcaaaaattgaaaccagaccacaccagggcagtttgtggtctgaatgtatcaatggatctagtcatatttcatctgagcatttcttaggtatactaaaccacaaatatgaatctcattattgtgtctggatggaaatattttatggattaagatttgtggatttaatttggttggtaatggaacttctgttcaaggggcaggagggaggaagtcgtgaggcaccaccaatgcttaagccaaactatggaaagaaacactatttggagggtttgtacttaatgttggccagttgacttgggtctaaagtgaaattcaaaattaagttcaacaaaaatattgtgaaattagcaatggaccacagatcactggaaccaaagggatcttagaattggaaaccatacacagttgctcattttacaagagaaactgagacctcaagagtggatgcgacttgcccaaggtcacacaatgacccygytggtcagacctgcttggcagaagaggagctcagagcttctcctccagatcttccatttattgcacttcctgttatatggcctcataagaggccaagtatctgggaacttaaaaaaaagtaatgaaggtaaaaatttaaaatgagaaagggagacctatatttaacaacagtacaacaaaatgacaaatactgcaatgaaattgaaagggttactaactaataacccaggatgcttccttcacaccaaaaccaaattttcatgctgagtgcatcttaggcctggccaattccaccttctgccaaaggagtttacttgatcatagagaaatcttgtctcaaagtagaaagtactgagctcttaaaagcccttgggttgatgtctagaatctcatgggaargagctaggtctgtctttgtcacttttgtaccttctgcacttagtgtggtgtttggaacgtagtaaatactcactgaataactgaatgaattaaaacgaactaattacagaactgaggctgtgacaaattccttgatacatcttactgtagaacagattacaggagagctaattacattagggccatcaggaaagtaagagtatttgttcattcattaattccacaatataagaacctgctatgtgtaagttcaaaccaagaaatacattcagcttcatttcatttaatataaacatattgtgcatttactatgttctagataaagtgttttgtgttgtgcattcagagatgaatgtctcagatatatccctgccctcatagagcttatagtctacatacaatctaactgcacatatgcaaaccaactgtttatagactaatataaatacaatctagaattagctaatttcctaagagaaggagttatgcatgcataataaagccattccaaatctttttttaaatgataaatcaaataatatcatatcaattccccagacaattcagaagagagaaagataaatttaggccaaagttacctgataaacctttcaatagtagatttctttaagcagcatcttgaaggactgatagatttattcatgcagagatggcaaaaaggcttctagaagccttcaaggcatctggaaccctcgctgaatgatcactgagaaatggaagcatcccaaaygtatctgtcagcttgcttcatctccacagcagccacaggctgtctggcatcttaatggtctacttctagaggattgatagtattctgctttgagccaggtgttgggaagttatatagtcagaggttggggctggtcttgactcatagctcctttgcttggccctccagcacaaaaggctgtataaaatcatggttcagagccctgactttggactcagatgggatttggttcaaatcctgactccataacttaataatgtctgaacttgcacaagccatgtaaagactctatgcctcagttttttcagctgcaaaatgagggtacaaatactatctcataattgtatgtgaatttgaaattggaaatgtaaaatgctaactaagcacaggctctggcaaaatcaacacttaataaattatagttaatgatatctgtattacttatgatggtgatgatgatgatgtcaacttcctgattattattattatgtcaacttcttaatgatcttccaaggccttttcaaccamtatttggtgattgtaattctttccttttctaggaagccccccatgaacttcccagtgcaaagtggcacataattatctcattcaggctggcattaataccagaccttgcttgtgtatgatattctagtttctgagatctctaggaacaaaaaatagctccttacttggcctattttccaaagtacccagcacattgggaggtccatactaagtaaatagcatttcgctcttgaaagaatgttaacatttatactcttgctattggcttgggagagtgcaccatgttcccaacctgcagtggcacttaagaatatcacaaatactaaatcaactgtacatggagttaaaatcaattgcggccaggtgcagtggctcacgcctgtaaccctagcattttgggaggcagaggtgggcagatcacctgaggtcaggagttcgagaccagcctggtcaacatgatgaaaycctgtctctactaaaaatacaaaaagttagctgagcgtggtggtgggcacctgtaatcacagctactcaggaggctgagacaagagaatcgcttgaacctggaaggtagaagttgcaatgagctgagatcgcaccactgcactccagcctgggcaacagagcgagacttcatctcaaaaaataaataaattgtattttgtgactctttgggaggaaattatgagctttgcgattatacagaacatgtttatcttctttggtgttgtatcgtttatacttaactcagggcttggcacgtatgtactgaaaaagtagatagttggatgaattgatggatagatagacagaaaagtaaaaaactcatcagggccaagaagtctagaaatactttaacacaaatgctctccaggatcccaccactgatatttctctctggagatcattacaatgacctcagactaagaattactgaaagactttcatatgcatttttaaaggtttttttcccccagctttattgaggtataattgacaaattaaaattaaaattttatacatttaaggtatacaacgtgataatttaatatatgtatacattgtgatatgattactagattcaagctaattaacacatccatcgctttacatagttacctctgtgtgtcaatgataaagacacttaaggtctactactatcttagcaaatttgaagtatacaatgcattattattaactgtagtcaccatgccgtacatatgcactcctttttgaaggcctcccaatggtctagaggaagagatagatcttaatcgaattccttgacccaaaggcaaaatctctggattttaatatcagctttaggagttaattagtaaagtcaccactgattagctagtgactctgggtgtttcaattcagttattctcttaaataactaggtattatggcaaataagtttcatgtgatatactacctctatttatatactacttaattggctgcctgaagtgatgatttagaatgattcttaagtggggctcctcagaattgtgttgttatcgattagctgtgtctgccccatgcactagaatgaagtgttttgtgccacagacttgccatgcctataccaaatgatcttctacagttgcttctaagtcctgctcaagcatgattttgaycctataatttgatgtctgtctgtgtctttggaaagtactgagaagctgggccaaatgtttcccgttaggaacacagtcttgaaagactaaaccacaggcagtctattcagtagaaagccctggctcagcagcatggacagccatcccaacagcagcactgcccctgaggaaccttggccagggtcctgacctcccagaaaagagccccacaccaggctaattcatttgcttttcttgctactgagttagaagagataggataacaggaaaaccagggctgtagccacagcctccwyattttcctaaaaattttagagtgtccctgctacttgacaaattgaaatactaagatttatacatttccatggaaaaagcaacagtgggaaagagagggcttcccagatttgtcttatagatctcatccttcagagactagccttctgttagaaatgctgtctccaagcacaagacagaataatcatataataccaatacacaccagttgctaaggtctccatccttttaagtatttgttactgagtgttttgcctgtattatctcatttttctcactttcagttgaaagaactttattgtgcagttgatattagtgttaccattttacagatgtgaaaattaaggcccagacaggcaatgttacacaaccaaaacagctactggatggaaccctttggatttgctactacccaactatttctgacctaaaagagtggtgattccatgtggttcaaattaatagcaagtggcagagtaaagatctaacagtgtttgactgatgtagagcagatatcctcaaacattgcacagatgtttcttggatatttgtccatgttagtatttatcattcttcacaacaagtatctgtttacatgtctgctttctatacctgactgtgagctcattaagggcaagacctatccatcattggcttctgaaacaccccacsaccactaggctatcccatagcccgttyttacacttgttcaacacatctctgttgaatgcaagaataaatcatttagaaattaattctcagtcctcttggataatcactggctcccccagcatcttaactgggcaccagctaagccactgtgctgcctaaatggacaaccacttctcagttctggaattcttcaaacacctagggttaggagggtcttcgctttggcagttagagttttytcaattcttttatgacacaggttgcaccggactcactcaactatggagatcagatgtcctcaggaaaaaaaaaaaaaaaaaaaaaaaatacacacttaaggctgtttcctggctcctctctcttcctgacacattccaaaaaggaatttatggatgttgggaaggacaaagggtgaggaatttctaggacatttaagaacgcccatgtaagcaactctatgcttgacaggccatgcacaataaaactctttggcctgtaagcgagaagaaaaatttggtgtaagctgcctcatgggttgccaaaatgatgtggaaacaaattcatctgcatttctaaacaataggaattctccttgtcctcccaaacctagaatatttcatgtatgtgcttaagtcaacaagataaatatattccatgagctactaaaaatgaaatcataagtaactaattctgaaatatgattctagccagttggaagtttcatctttatctaaaaatgaagttgtttattctccagctgtgaccagggaaaaaatcagattgttgatttcttcgtctagcaatgatctttgtcctgcagtgaggtgcccaaaaataactgttagcctattccctgctgcttccaaaaggttagctaccaaacagctctactagtaaaagagaaaaaaagaaggatttgacagcaagccaagaggcagcttaatgtgtaaaattatgagctaaaaagccattacgactggcatgacactggccttggtttcccaacctggtaaataaatttttatctcacagtaatgctctgaataaaagtctataatgccaaaatctgaagaaatrattcaacactgataacatttaacaccaaggcaattgaaataagattaaagcttaacatttaacccttcttccaccccacactccccacaaaagctttcaggaccattgtttttatcttcttattttttgtagcgggctggggccataaatgtaccaggtatttggagaatggrggactaaatattaaagcctatattctacccagccttctcaacagatgactaactgtgagcagttaggcacctagccttacagaggtgccatattgcttactgagttaagtaccagctcttcatattgatcttttatatccttcccaatatggcttctgccaataccatgtagtctctacctttctgctttcctatgcattattttataccctagtagaacaagacctctccatattccctgcatgctacaccaccttggcatgtatctggcacccacaaggagatgccactattattacagctatcttcttaattctcctcaccacccatgcattccaacttctttgccttttctcatggtgtttcttttttctagggtgctgtaggcttcaatttgaacccacctactggagttgtatccaaccatttttcagaatcttgcccatctttcaagtacatctcaaataccacttttttgagatgtctttcttgggaccttcaatggatatgagttggccaatctcttttgttacttgttataatcatgaatgtatctccctgattcccccatcccttctggatacaaggttttctttctgatctattctctattggatcagtgttgttattaccgctgctgctatcattagctaccacatattaagcacaccttaatgtgtgccaggcactgtgccagtagcttaacatatgtcttctcatttcatcccactctcctgcaacactatgagatagacatatgtatctccagggagaggaggcggggaaattgaggttcagaggagaaagggaatggccatagggagcagctgctaaagtgatagaactggattcgaacacaggtttattttacaccaaagaccagactctttcccccacacgcaactgcttcattaatggaaatgtttagatggctgaaggatatggactgagtgccctcaaaactctggagcacagcagtgcaggacagcagagaaacgggagtcatgagttgtctttgacaagctcctccagcttctaaggagaggctgaagcagacagaaagagacattagacttggccagagtggttcctggagcaacttggttttagtttaacgtggggagaagattcttacgagactctaaggtgtgcagagggaggaagaaaaaaatatttcttaacccaaggacaaggctgggggaaaagatgctgatctgacacagggtagttatctcttcagatctgcaaaggacaatagcattgaggattgcttctcacttgtacctggatatgttcaaacatgtaaggtatggaaactacaatgcacatacatgcttgctatagttaagtgagttagttgctaaaaagaagccattttttctccctaatccccgggctcttgtgtctgaggtactcacccattttcattagtcaagaaacttaacaacattgaaactttcttatagactcttcttgatcgctttgagtctcagtttcctcattttgtaccatgcgcttagtaaaaacaagcaatcctctaaaccagtactgctcaataaaacttctttggatgatagagatgttcttcatctgcactgtctcatattgtaaccacaagccccatgggctcttaagtacttgaaatgtgagtgatacaactgagcaatgagatttttaattgtatttaattttcattaattttaataatcacatgcggaatatgggacagagcacttcgaattcaagaccaatgaattcgaagtgttttatctctttttaaattttctatctcacggggaagtttttattgtggattttatgttcaccagattaactagcttttgagacattgacagggatggagatacacagaaaatctcacaaaaacaatttcataagtcacaggtatttgtttgactctaaaaattaattttaataaagaaagcaaagtctgacacaagtgtgtcttgttttgcgttagatacataagctgaggyggagcaaaaagcagcacaacatgcttagcttggaaatagatttgtcctggatatgggaccccaaaaatctgcgttttgtgccaatgcaaagactatgtctcttcctgattcccttctttgcaatcattgacttaccagatccttaaatatcaccatcaaagatatacacacacttacatatataatatgatatgtaataatatattatctttcattgtattataatatgtaatattatgttacatcacatattataatattatatgtaatataattggagcaactattatattatatatggagatatatatatacatatatatatacatatatatatacatatatatacatatatatatacatatatatatacacataccacgacatgcatattttctgggatcactgagagaggaaaagttctcactttgctgtagaactcttgtctttgcttaaaaacagacatatgccaaagtaggggtttcaaaggttaggagaaagaaaatcctagaaaagaaaaacattcattaaagtccatatttttcattacaaatgtttccttttattaagctcttactgctaccaaagactgtttgccatttctttcgcayacattatctcatgcacttttcacaatgatcctatgaggactcccttaacacatttattgatgacagtactctggcttatggtcacagataataaccttgcacaaggaacaggaagtgatcaaacagtgattcaaacctaagacaatttgcctataaaacttgtgcccttcaatgccattctatttacattctggtgctttggaacctgctacattctcaaagaagacctttctattgggtaccaattccaactagaaaagtctttctcctgttgtgctgaaatttgtcttctcataaccaaccctccctccctgcatcatccccagcacataaacgcacasacacacacacacacacacacacacacacacacacacacacacacacacacaggcacttgttctgtccttaggggctacaagaggcaagccagtgcctgctttgccaggatttctacatggtaaccctgacccactcaaccttggttttctcaactacaaaataaacctgcccaggtctgtagtccttcctcctacaagatattttccagaccttttattgctgatcaattttcwataaagattagaatctgtgttttctaaagagtctytgtagaataagttgctcattctgaaattataaaagtcctactatcagaacatgattcttcatgtctgacctaaatacctycaactgcaatctcaagtaagtttccctgggttcatccacaaaggagacttaaaacagccagttgtctgcatgagaatattttacattcttaaaggtcattatttgcttcctattttttccctctctcatataaatatttctagttctagtaaatttacctcctcacccaccagtgatttctgcagctcctctttgatctagatccaagttgctgctgagtttaggactgtattcaactaggcggtcaagctcaggcttaagtaaaaggaggctattgacatggactcttgttaggttttgttccccaggagcgcaacaaaataggaactactgtttaatgagtgcctactacgagcttgacaccatgctgggtactttatgtacaggtctctaatccttaattttctctggaaaggttttgactcctttgttatatatgaggtcatggtttagagaggataagtagcttgtcaaagttrcagggctagtgagtgacatttgaacccaggtatgcctaattccaaagcctaaccattttctacaacactgaaaatataatggatttttcccaaagtacaaaaacacccactgccctcagaccaccatgagccaataggaaatacacaatgctcaagaataacatactctttcccccaacgatgcaacmtttggtggtaccagtktacgtctcttaaacacacagtgagaaatcctcactctactcacactctggtcattattaccctaaactcattgccttggagtctcaatcagcaactataatggctttttagatggaaatttaagtcatttagcaacacacagaaaagtgttggggagaagtccaaaaacatttcaaacttggcccatggccctttctaaaaaaaaaaaaaaaaagctaagaattgatggaaaaggggtaggaaagtagaactttgtgaaggtgaagagagttagagcagccattctagtagactatgcagccaataaatatttgtccagtaaacacataagatggccaaattggtttgaaaggagagaacatgccaagtctccttttttataataatcttcattcagtggccttacctacattacagacccacacattgttagttaagaagctaatttcaatgagaaagcatgctcaaaagagggttgggtattttttgtttctttgtttttgttgttgttgttgtttttgttttgttttgtttttgcagatattacagggacagttggtaaagtgtcaataagaatataattagaatgtggtaggtatgtggataggaccttcttagttaaattcactagtgctttctcagtccttaggcccctgatcagtcatatagaatgcttcccagttcaattttccttgccacaattcctctctaagttttgcaaaggctttctgtcatgaggaaggagatggtcagttgggatcatgttgatgcattctatcattaggataaaatctttccagaaaaaaagttagaaaccttcttataggctgaataatccaagcaccaccactaattgacataaataactaacttacagtgtgcgagtataagaatatcatgggcatagggaaatgtcaatttgtaaatgacatgctaaaaaccaaatagcagccaggcacggtggctcatgcctgtaatcctagcactttgggaagttgaggcaagtggattgcctgagctcaggagttcgggaccagcctggggaacatggtgaaactccaactctactaaaaaaaaaaaaaaaatacaaaaaatcagccaggcatggcagtgtgcacctgaaatcccagctacttgggaggctgaggcaggaggatcacttgaacctgggaggcggaagttgcagagagtcgagatcatgccattgcactccagcctggacaacagagtgagactctgtctcaaaaataaataaataaataaaatagctcttcaattatcatttgaattttactcgggtgcatctcctaattaaagaaaaccatgaatgacttcatatcgtgtatagatcattctcacatgcctccatagcattgttttagtaaatattataactgccatttcttcctgtctttatttagtttctcaactgcctctaacaagtccccttttctctgctacctgattgctcatacaggtgaatagctctaagagagatgaataagataacttggcaaagtgagaattgcttcatggtagcatattctcctccatattctgttcccatctaattcttctcactatttaaggctcagcttaaattttaccctccctttcccataagctatgccccacctttctcttgaccattcctttttattttcaaaccccataggcagttatacactataccacaaaacaaatcctatacattctttcttgctttgctccttaagtactggatggatgattccattttcttcttaattctattgttaagtcccctgatggtatgtatacacttggtcttatatttatttctaccaccctcagacctctgtaaaaatgctataagtacttgctgattggagaagacatcagaggctcttagacatcctttctgagctgtgagcctcagtttagacaactggttcaagaatattctgtcaggctcttctaaaaactggacttttgaaggttttggaaataaatcaaggagcagggaaactgaggtgcagaggagtagactgaatgctatactgacagtcatataactagtaagaagctcggctgggattaaaactgtttgcctcctagagtcctttattttaacctctgcctctcatgacagaagagaaccagcagatggtgtggaaatcagttttgaaaatcaataagaggcaagagttactgaacatctaccgggaccagggcctttataacactataataattcactcagaagacatagtaaatactgaaggaattaatgaatacacaaataacttctacatcattcttttaaccctgtcattagcaactatgatcttcactatacagaaagtgaaataaggcaaagaaaaattacataacgtatccaagggaccagagctacagccaagatacaaacctatgtctattttatttcaatattttacctttttctctctatttttctgtctccttaaatttacagaagttgaatagtgagtgaaatcattccttcaagtgacaaagttcttttagagaccattgtatgttatttcaagggtatataatgaaaaattatcaggagagcttcaaatacagggatataaaatcaaaattcacttggaattgtagatattcaatatattcaatagtagatactcataatttttttgttcatctttgcttgtagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctsaagaaagtcatccggcacaagcgacagagtggggtgaacgccaccctgccagaagagaaccagccagtggtgtttaaccacgtttacaacatcaagctgccagtgggatcccagtgttcrgtggatctggagtcagccagtggggagaaagacctggcaccgccttcagagcccagcgaaagctttcaggagcacacagtrgatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggtatgagctggtggcccgcccagtcccacactgtgcaaacatggagaaatgaagagcatagcagcatccatcacttgcttccaaagtgggctcactagaaaactagcttcccagagtgttcattacaaagagattttatgttcaaataagtgtggagactgcagccatctctctcctgcttggaggagtcacggcgacaactgcttctcagaggaattttcaggcttctgataagtcctgctttgaaaaaccctattttaccttaattataagtttctaaaacgtatttgaccatgaaatctacccactttctaccccraaacctatgagtacgccatgaaatttctaccccagagagcactctctgataggtactgctgtggccccatcacctcattttacaaatagagaaactgaggcctggaaagaggatgggattcctgaaggtcctccaataaggagtagagttcctcacatttcagtattcttacaaatgcacagtgctgcctgtgatagtgctgagttataagaattagaaaaaagttccaatttaatagcaattacaatgattacaatcatataagctccctctgtgtaacaggcactgttgtattatctcatttaatcctcccaacagccctttaaggtaaagattagatgaggggaagataagtcctcttctacagatcaaagaaatgaatctcaaggggattaacccactggcacaagatggcacaaagagcaataagagatagggtctttggctaggcgcagtggttcacgcctgtaatcccagcactttgggaggctaaggcgggcggatcacctgaagttaggagttcaagaccagcctggccaacatggtgaaaccccatctctactaaaaatacaaaattagcagggtgtggtggtgcatgcctgtaatcccagctactcaggaggctgaggcaggagaatcacttgaaaccgaggggcagaggttgcagtgagctgagatcatgccattgcactccagcctgagtgacaagagcaaaacaccatccgaaaaaaaaagagatagagagagagagagagagagagrtagggattttgcatgtgcctgtgtgtctccagagctcatactctcccatggatgccctgtttccacatgcatcctatttcaaggarttttgctgctttggaattatgtctttatctccaataactaaagttgataaagctacatgagtttcaacaacttcaaatcagagctgaaaatctgtttctgccactcagaaaaaaattaccaaaatgttcttcaacaattatttcaagagtaaacctaaccaccctaagtgaaatagtcttacggctctgcaggacaggctctaggtttctaaggcaatttttaaaaacattttctttaggcataagttagtttatcttccacttctgtcaactccctggaaaaatgcagatgagaatacacagtaggagtaatgctaagtagtcagttaaaatgattgtttagagcagtgctgtctaatgaaaatatgactcacacatgtaatcttaaattttctagtagtcatgttaaagaaaggagaaagaaacaagtaaacataattttagtcatctcttatttaattcaacagagccaaaatattggtttttcagcctgaaatcaatatcaaaattattaatggatacttctcagtctattattttatactatttggaatctgatgtgtattttacacttacagaacatctcaatttagactagccacgtttcaatgcctaataaccacatgtggccaagggccaccatactagatagtacatacttagactctcactttacaaatcagctttttttaaaaaattctttcttcctgctgtcaagaatgagataaaatatattaatacaagctgtttctacgtacagagactacagagtgaatatactctagtgcagagaatatagaactgggttttgtttcttctccttaagctccatggagatcagaccaatgacttctgcaaactgagctaaggcaatatttaggcctcaaggggctcgagtaatgtcaaccttgaccccacattctttaagttgacctccacttagccttcaggatagaaagaaataaaagataaaggcactatacttttctggggacagagccaaactgaaaggtgtccttatagaattagaaagccattagctacctcattttagttgcggaaaattagaatgttttggttatataaacccacataccaacttgagccaamcttccacaaaaaactttggaaaataaaacagaaaaaaataacaaggacacaagagtgagctcttaaggggtttacttaactcggatataccccagggaagtgggctattggcccaacttcacgtataagaaaactaagctccagatagtctaaatcccttgccaaatgtggcatagatattgaatcaaaaagtcagaattacattcagttcaacaactatttcttgggcatcttttatgtgcctggccttgatgaggcactaaagaaataataacatagtggccagtcgtggtggctcacacctgtaatcccagcactttgggaggccaaggcaggcagatcacgaggtcaggatattgagaccatcctggctaacatggtgaaaccccatctctacaaaaaatgcaaaaaaaattagccgggcatggtggcgggcgcctggagtcccagctactcaggaggctgaggcaggagaatggcatgaacccaggaggcggagcttgcagtgagccaagatggcgccgctgcactccagcctgggcgacagagcaagactctgtctcaaaaaaaaaaaaaarraaaaagaaaagaaagaaatagtaacatagccccagcctaatgcatttcacaaggcagtgactcataatcatcataggaatagtaagacttcttgaaaatgtgacaaaaactatgaatccgctccccaggggtggaaatacacacacacacacacacactatgcataatcacacactgttttggcatacaagcctataatttcagggaattcaggttatgaattcctacctggtataacasgatgtgagtctcatctgatttcacacactacaacaaatggttctcaagccagatgsagcctgagggtgcaaccgtccttcmgctgaatttgaatctgggtgccctgggtagatacagaaaaatgtggctgcttaagcctggctgagaacttctgtttcttttgttgcaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtraatggagtctgcatctgtttcgaaggctacgccggggctgactgcagccgtgaaatctgcccagtgccctgcagtgaggagcacrgcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccrgggtcgctgtgtgaatgggcagtgcrtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacartgcrtctcgggccgctgcatctgcaacgagggctacagcggagaagactgctcagagggtgagtgccagggcgcagaccagcatataawggccatgatggagtggactcctagtatgggttggaaaactacgtttatatatataaacattcatgcacactgattctttgtacgtattaatatatccatttaaacacacacccataatgactttttaagggggccctgtcattccgttgttacaaggtgacctatttaagggctgaagggctcagagaggttatataattgtcccagggacacacagctgacacatcacagagctggtattcragtctgcctaactcatctacatagagtttaaaataaagttggagaggccagaacacatctagtgttcaagatgaggtagataaagggatactctctcttttgctaaatatcaactttatttcctactctccactgacatcaaaccaacagtaaacaaaatctctgtatttggatggatgtaaaaattcagctaaattgaatacgcagtgagattacataaaaacaactgtttcaaatgcatacttggctaaagacsaaatgcctattatctacaagattgacctgtcttttcattgtcttttgtaactggttttgtttttttgattgttttgtttttttaatcctaaagactgcaagctcctatccttaaaagggcactatttctagcagttagtatgggacctggtacatattaagtgcttagtaaaccctggttaagtgaaaacacaggagagaaaattaatgctcatatttaatgagtgtcttctttgtactcctctcatctacccatattatcattgtcataatggagaattttttcctttactaaagttattggtatctaaacataaataaatggctttgtgttcaatgtggcgcaagcagggaagcctggttggaaagaacaccaggctggcagggaggagatacaagttctaaacttgatgaggtgagcaagcttggtcaagtcgttctgtcttactcacctctataaaataagaaagttggaccagatatgcccaaaataccctcccagtgctagggacacgtaactcaaagttcagagcagggagtgaggctcagactgcactttcccatgccaacagcctgcatctgagctaagacccaggaagcacagaaagttggagaggccagaaacaccmaaggscacactgctgacctgggactccagcctgaaggaaatggactaaggaacagccaccacaggtcttaagatggatcacagcagggggtscctgatgccatctgcattttagaggcaacagaagatcttcagacctctgtggctgacagtggaaaagacaggtcaaacaaacctagagagattttagaggacacactgttgacaccagatgtcctttcttattcctgccagtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccrggagctggarcctggtgtggagtactttatccgtgtatttgccatcctggagaacaagaagagcattcctgtcagcgccagggtggccacgtgtgagtgagcagaactcttttgggcagcctcacctgaygtcagcccacccagtgtataaccctccctcgccacggcccctacaatcctatagttgttctttacagttataccaaataagagcctagaattaagtccatagaatcacttattaaagaaatccctcattttccatcaaatctttctccttgctctcctatatacttcctgccagagaaaatcattacaagtaacatttagcaagtgtttactgtgtatcagactttgttgtaagcagtctacatattagtataagagtcctcatttggccgggcatggtggctcatgcccgtaatcctagcactttgggaggccaaagtaggtggatcacctggggtcacgagttcaagaccagcctggccagcatggcraaaccctgtctctactaaaaatacaaaaattagtcgggcctggtggtgcatgcctgtaatcccggctactcaggaggctgaggcagagaatagcttgaaaccaggaggcagagtttgtagtgagctgagatcatgccactgtactccagcctgggtgacagaktgagactctgtctcaagaaaaaaaaaaaaaaaaaagagtcctcattatatgagttagtatatgtatgaaataggagctattgttaaccccattttacagatgaggaaactgagactgcatggttaagcatcttatcccaagtcatgcagctaacaaggagtagaggcaaaactttaaccctggcagtcctggcaggtttatgttctaaaccactctattacttttcagtggagatcactgactatttttctttaagtggaaacattctggtttatgagtttagcatcagtataattaccttcatatctaaaaagcaagctctggctagaaattgacccttttttccttaataataacattggctgccatttattcaacttgttctgcatgccacgaaccaggcccagcagtctacacactggagtggagtatatcactcactcctcaatgcattcccaagaagtagayatatttaccttctttttccaagtgaagaaactcaggcttagagcaytgtgtgcaattgctcaagttcacattgatagtagagcttagattctaaccccaagtctgtctgattccamagcctgcgttcattttagatttaaacatatgaaattgccaaaattaatcataccatttttcctaatattaatttttatacagcctcatagagacctcatcccagaagaagctttaaaaggacacctgctctggttgtcagcccctgactgttgcagacatccagtctggtttagtggaatcgtggccgcgttgcccaatcacacacctgccctatccttacgttctatttatgttgttacttacagacttacctgcacctgaaggcctgaaattcaagtccatcaaggagacatctgtggaagtggagtgggatcctctagrcattgcttttgaaacctgggagatcatcttccggaatatggtaaggagtacaaaagagcagatccatttgatctcaargatttgaaagatgaccaaagggttctgaagacttctgtatcaactaattttccttagtttttggtggaggacaaggctctcattagcatcatttgtgtttgcatctatattttaagggatgttggtttttccctgattttaataagtaagtgtagcacttasggctgacaccctagacaaatagaagttgtcacctcaaggttccaattgtccatcatcaccttagaaatctctactcagaggcaaagaagagaagaaacagtctctccctcaaaataaaggtacatctcagatttgagcaacccttctctccaggcccaaaagtacatgtgaagcagggaacttgttctctgaatttaagcccaggctctgccaccaaccagctgtgtgactatccaacaatcaccctactcctctgatgctggcctcagtctacccaaggagggattgagcttgtgccttcagaattcctttggctctcacattctgtcatttgacttgcatgacaaaggggtaaaagtttacgaatgggagaaacaaactagagaaatgtctttatcatctctgtatcctcagtagcttacatactgatctgatgcatagtaagtgcctaatgaatcgatgaaagaataacagaggaatgaatgaatgcagagtgaatgaatcacataaattaagagactggcacctcccytaactcttaccaagctgcctctatctctcagaataaagaagatgagggagagatcaccaaaagcctgaggaggccagagacctcttaccggcaaactggtctagctcctgggcaagagtatgagatatctctgcacatagtgaaaaacaatacccggggccctggcctgaagmgggtgaccaccacacgtgagtatcacctttaatacttatagaatgrtaaggctgattgtacctcatagcacctcctggttgagaaagtgccttctcatatagcatctacatcatttaacttttgctgcatttttaaaaatccagatacagtggtttaaaataacaattctttgcatgttggtgatttgggtttgggctcagctgagcagcttatctgttcttgactgcactcctmatgtatctgtgtgcttaaggggtggattggcctaggatggcctcagccaggatggtgtctttctgtttcgcagagcctctcattctccaggatgctggtcctgttcacacagctattgaacaggttcaaaattggcattagatcacttctatcaaagcacatcccacggccagtttatatttaaggaatagagaaacagatccatctcttgatgaaaggagtttcaaaatctcctttcaaaggggtgtgactacctgaagataattaagcccattgctaacaatctaattagcatcatgtcactagtttaatattagcacccagttgtaggacagaggaagggaaaatattaatgttaaggcttaaagaagctaaatcactttaacatcccatagttaacaccatcaggggcataactttaagccagggtaagttttataactttaaccccatttccactaacattgactaggctctggtttatgtagaatgttgattccatctcttcaatgggaacctaaataaaatttcattcaatactaatgatgtcagaagttcttgggagtagaataggatttagcagtactagatcatttggtgagaaaaagacctgaatttggagttgctccaccaggaaacatttttttttttttttctgtcacccaggctggagtgcagtggaacgatctcagttcactgcaayctctgcctcccaggttcaagtgattctcctgccttagtctcccaagtagctgggattacaggctcccaccaccacatctggctaatttttttgtattttagtagagatggggtttcagcatgttggccaggctggtttccaactcctgacctcaagtgatccacccgcctcggcctcctaaagtgctaggattacaggcrtgagccaccgtgcacagctgcaattttttaaaaagaaaaaaatgcataattttgcacttccatataggaaaacctctttattttcttcaagataacatatgcgccaactctttaagtaatcgactcttcttggcagggggttgttggaaaaattaaatcagttgctaatgacaagaaagaacatcttgcatttaaatatttgcacattttgcctagctcagagccaattcaaaggattttctctttcataagcaagtgttttccatcatcctgacaccacctctctgtggtaggtagaaaagcaggtaccaacaggaaaaaaaaatcattagatcaccagaaagacaaagaaaagacaaagcaaatgcttagttgctatggaggaggtgcactgaactttttttttcactgctcttttgtttatctaaatttgggaattgtctgctttatttcttcttattttagaacaaacattccaacatttgaagttgcataatcataaatttcaacatagggggacaaatatttacctgttcattttgtatttttagtagagacaggatttcaccatgttggccaggctggttttgaactcctgatctcaagtgatccacccgccycggcctcctaaggtgctggcattacaggcatgagccgccacggccggccacaatttaccacatatacctgaaacctttaaacctttaaccttttttccagatgtaaagggccttaaacttctagttcagaacacatttggctccttctgtctggcatctatataaaggtggtattatacttacttttgaggtcaatatgtttgagaggtgttgtcatgtaaagggggaaaaggatgggctttggattcaatcagttctgagtttgaattccatctttaccattcaccatcaccttggaaaaatctatttctttaagctccagatccaacagctgaaaaatgggtttatagtattctccttgtggggtcrtcataagactcaagacataaataacaaagcaccatgtttgcacctgataaatacagagcattgttagtttctgctattcaagggtcccaaatctagggggatatcagtgtccttgacggaaacccaacttctttaatgcaaggggtactaaggaaggtagtaggtacggtttgggtgcttgctagcacctataagaacacagagcaggcagcttctgtccatttttgcgacatcattttcattgtgcattttacatcatctgtgagctgggactgatgtgtcaacacctagacttcaaaaacagactctgcagttttctcacaatctgctgtaaattattgttccttttcattccctgtataaagccaacttcctgtcacttgttattgtttactgaaccaatgctgaaaacacatttaaaaaaaaaaaaaggagaagaagaagaaagaaagattcaaagattcactgaatacccagaatatgcctgtctctgctgggaatttaaaagactcactctctcartcaatgaataaccctacctaaattgactcaaactgtacagaaatctgttatgaaacaatgagacacgtatgatattagaatgctcttcaaggacagtggcagccacagggagggaatatgtgtttacctgactgaagccgggttaaaaaaaggcttctcattaggagacaacatttaagtgggattttgaaggatgcataggagatttttagagggaagtatgatcttagaaagaagaaatgagagaacagcatgtacagagaccaggcggtgcccaacagcataatgtgcttccagagctctgagcatctatcagagtacaacaccagagtaggtggggcagaaaaagtcaagatgagcctgcaaaaacaggcaaggcttgaaatagcaatgactttcttgcgtgaattctttctatcaaaaataagtttccatacactgtcaagacagtctattgcctcacttttctgcttggtaattctgatggaaaagtyttcaggaaacatccaggaagttttgcctaattaaaaatttaaagagactaagttcatcttttcaaataaagtatccccaaagcawgtttcctcaacttatgagaacagtaataataataataataacaaaagaacaacctttttttttttcatgtgacatccatgggccagtctctgtgstagatgctttgcaagctttatctctcttaagatttgaaaaaaacaaaaacaaaaaacactagaggtagctgctgttatccctacttatagcttatcaaaccaaaaactaaggttcagaaaggcaaagtaaagtcaagcagttagtataagtattcacccacaggtctggagagttacaaagtcctctctctgctaagcctcaggcaatggccctaacctctgaagcctctctgtcctctgcccatcataggcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggaygagaaccagtactccatcgggaacctgaagcctgacactgagtacgaggtgtccctcrtctcccgcagaggtgacatgkcaagcaacccagccaaagagaccttcacaacaggtaaaaggcctccccctgttaacagatatagtaaaggaaagattgaaagatttccatcccactccatgttggggtatcttccaggctcattttacagtacgaaaaatgaaaggggtatttctactcctgtaaattttaaaatattgtagcaatttattaactaatttttcaaaaaaaattccaaataaccttccaaagcacttttgggggtgggggacatatgtagaagatgctggtctgatattctcagacaaaagttctggttaaaataaagttcaaataaatatttttaaagtaaaatatggtatatggaaaacatatatgacaaatgagcctcctaacactttagcctacggcattattttaaaagttcaaaagtgtcaatttttcattcagtaaatatttttcagagctcagtaagtactttgtgagttattagaaatatgatgaggaggccgggcgtggtggctcacgcctgtaatcccagcacttggcaggctgatgcaggcagatcatgaggtcaagagatggagaccatcctggccaacatggcaaaaccctgtctctactaaaagtacaaaaattggggtcaggcgcagtggctsacgcctgtaatcccagcactttgggaggccaaggcgggcgratcacgaggtcaggagattgagaccatyctggctaacacagtgaaaccccgtctctactaaaaatacaaaaaaaattagccaggcgtggtggcgggtgcctgtagtcccagctacaggctgaggcaggagaatggcatgaacccaggaggtggagcttgcagtgagccgagatcgcaccactgcattccaacctgggtgaagagcgagactccgtctcaaaaaaataaataaataactgggcgtggtggtgtgctcctgcaatcccaggtactcgggaggctgaggcaggagaatcacttgaacctgggaagcaggggttgcagtgagccgagatcgcaccaacacactccagcctggtgacagagcgagactcttgtctcaaaaaaataaaataaagaatgaaatatgatgagaaaatgcaaaagaccagtttttacactcatgagcttatttttaagtctttgcattgtttctttaaccacaaagtctgagaaaaacacaaatgactaaagtgtcgcactcatccataatagggaaaggtgccaaatctgtagcacttgtttagatttgcacatccactatggggacagatgagtgtgctgagaattttgtaatttctctccagttccaggcacgtttcatatgtcagcttgagctgtcaaagactcctgctctcttgtgactgatatgttcaatacaaatgttccttctctcaaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtgagctctgcatctctgcaagcctgagccagccagccctagagsgcccttaaaggatgggcacctgctcccacatgtccccatttgcaaccctcagaaataagtccaatttcctgaaatactgcttattggattgcagtgagttcttttgtaaaacattccgaaaatttgttgtagcctccagagaccaactcaaagccatttttatcatcctctgaaagtctctctgatttcaggatgaatctcaacttgcacattctctccttaggtctgaggccgggaactgaatatgggattggagtttctgctgtgaaggaagacaaggagagcaatccagcgaccatcaacgcagccacaggtggggcacacctggaattcccatcccactgagctgstgctgggcagatgagacagagtcaatgtggccaaaacctatttaaagagaaaaagtagaagcctggaggaaaaagggccctgtagtaccatctagccccaatgttgaaattcaaaaggaacataagtacggtccatctgtatgatgccaacatcatcccctgtatggaaaaggggactggagattttgtgtttgttgttgttgttgttgttgagatggagtatcgctctgccaccaggctggagtgtagtggcatgatctcagctcactgcaacctccgcctccagggttcaagagattctcctgcctcagcctcccgagtagctgggactacaggtgcataccaccacgcccagctaatttttgtatttttagtagaaatggggtttcaccatgttggccaggatggtctcaatctcttgacctcatgatccgcccacctcggcctcccaaagtgctgggattacaggtgtgagtcactatgtccagccgggattttttaaagaaaaattggaaccaggctttgtaagaaattcatgaacatgtgtaagttggtaatcagttgcatcttttaaataaaccattatctagtccaaacacaactgtggggttttctctgagaaaacacctaacttttatacccctgtcaagcagattataagtaacaggattgtagtttaagtccaggccctgcacttacctgttgtatcctgtagccgcagcttgtaggtgaggatgctgaggggctacctgatttgaggtcattgattctttcctcaagatttttttttccatttttctgggaagtttgcactgcaaaaagaaaactcctcctctgcctctcccccagcccccagcttacctccccacaggcactatgaggaagaaggaggctagtgtgtaaagaggagatggatcatcattgagcttccacattatgcgggatgcaaggccggacatttacatgccaattctttttttttaatcttttgattttgagataattgtagattcacatgcaaytgtgagaaagcatacagacagatcccctgtgcccatcacccaggttcccccaagggtagcgtcttgcataaatgtagactaatataacaactgagaaattgacattggcgtaatctgtccactctatttatatttcaccagttttgcatacactcattcgtatgtgtgtgtatatacttagttctatgcaattttatcacacatgtagatttgtgaatgcaccactagagtcaagatacagaacagtcttactacaagaatcccacatgctaccctttgcagccacagccacctccctccctttgcccctctgcctaaccctgggcattcatttatctgttcttcatctctatgattttgccatttcaaggaatgctgcataaatgggatcctacacatattagtccatttgagttactgtaacaagaataagaataccttagaccaagtaacttataaacagaagaaatttatttctcacagttctgaaggctgcgaagtccaagatcaagatgccagcagatttggtgtctgatgaaggcctgctttctggctgacagcaggccatctttttactgtgtcctcacaggacagaaggggcaaggtctcttttataagggcaccactcccattcatgaggcctcccaaaggtccctagatccaaatgtcttcacattggggattaggtttcaacataagaactttagagaggcacagacattcagtgcatagcaatacagcatgtaacattttgaaactggctttttttccttcagcataattctctcgagattcatctaaattgcttcttttatcaatagttggttccttttaactgctttaaatctgagyagcattttatggaatggatattccatgacattattttcaatcttctcagactccgatggggtcatgtgggtgatgtataattagacctattttacaaaagtaaaaagagagacccagagatgtgactctcctgtggtccctcagctcctctgtggcagacctaggattccagcccagatgcagttgactttcagccccagaagcagccctgycttgcagcctgaagagcattcatctctctgttctcctcccagagttggacacgcccaaggaccttcaggtttctgaaactgcagagaccagcctgaccctgctctggaagacaccgttggccaaatttgaccgctaccgcctcarttacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacrtgtgaaggcatccactggtgagtctgccctgagcttcctccaaactctaggttgattctgaggttagcagatctcctcagccagggtgtcctcacatgagaaagccaaatgcaaaagcaagccactttctccatctctgaagcccctgaacaccactttgaaagggctgcttactcgtcttttctacctcctgtcaactgatacagcaaatttcccccactgggaaataggggttttaaaatatttcttcctaggagaactttaaacatcagggtttgtgtttgcatttacctatgatttttgttttcttttcttaactgtgcatcacagcatcttttcaattgtttcttgtttatttccttcttttagcctaataattaatttacttttcattttacttcatttaaagatgaccaagatgttggtaataatattttttttgttgttgttattttctacaaactgtttttattccaggtcttttgctttctgccaaggttacccctgaagagtggcacacggccctttgagacttccatggtgccctctcattttctcttttctcttagtcattaagacattaacctagtttgtctatgacgacagcttaatcctgacattgcggcccatgcaacttgtgtccaytctggcccatgcaacctgttcactgaacctgcggccatgcttactcggtggctaaactgaagagacaaccaggtttttaaaatatttcttcctttatgaaaaataagcctattcaattttggccaccaaatattcgaaatgtataggtggaaaatgttacttttccagggtttggcaagtaatagtctttacttccaatttaattagtaagcatgtattgagtacctactgcatacattgtaccgtactgatatttgaggaaaagtagttcccaaagtcagcattgttatgtggactcatttgtgcctgctcatagtgcttgyggaagactagatactcagaatgctagacagaactcgagaaaaagagtgatccaaggaaatcaggagagctggcaaaggtgttatggcaagrgatgttattccagttgaagcttgatatgcaagaaaagggttagaagtgtggacatatttggaaatggcttgaagagtctttctcacaatatcttcagtctcaaatcacagtcacttacttaagatagaagttggttttctttcttataaaatgaatctggagctgggaggtacagggataacttagtagtttcaaattgtcaggcacccaggctgcttctttcttttccaccatttttagtccttggcttccattctcaaagtcatctcagtgtcacaacatggctgctgtaatacagccattccatctgtgttctaggcagcataagggaggaagaaccaaaactyccaaagaggagcaccttctgggtgagtctttctggaaaccccaccaatcacttctccccatagttcattggccactcctagctgtaagggaggcagggaaaggtagtcttctgtctgaacatgttacttccacataaaattgaggtcatttgtaagagagaaatttggcagacaatgagcagtccctgccagagtctgaaatgagtttacgtggtcaattctgttgactctgcattgactgcttcccacccaactataagatgtttataaaggatgctctgaaagaatagtttaattaaaaaataaggtggggggcggggatagaaccaagaagaaataaatctatagtagagatttaaatttcagctttataaacatgagcttgttataaagtgtcaaggggcaacaaatgaatcagaaatrcccaaaaratgaaatccctctcttttctttctctttctctctctttcttccctcttccctcactcctgctcttcttcctcctcctccttcctctgccccyctcccttagctttcccttgagtttgataaatgctgtatctaagagagattcctattgcccctcaatcattccaccttctggtgatggccacattgcctccttcctccagtgagaaarcctcacacckgcgcagtcactgaagaagttttatctccctaagatcctgaggtgtggggcttctccactagagaaaggaggtaatgtggctataaccaggagatttactagctagaattattctgtttctgaatgagagccccatrttggcattccaaagcctcagcagttgcatttccccaccacgcctccttaatgccatttcaaagatatcatgtttcrtatttaaagacattcttcagtgtgggaaaaatgtgcaaagttctttttattggttcttctccactgtccacagactatttcccccatccctttctccacaggaaaaaatatayatgtttcatttaaggtgaagcagacgyttctttccctccttgaattctaacttttaaagccttctgcattcactcagtcaataaaatactatcaccatgctctgtgctaagttctggggttactagagcaaagaagacgggtatttaattccaaggaactcactgtgtagcgaacaaacagacactgagataacattctgctcactacgatcgagggtacagagggtgcagccagtgctcaggagacactggatctaacttcagagaatcaggaaaggcttacaatgggaagacgcttttggacagagacataagaggcaaacatagatgtgttaaatggaatagctaaagaagtagaagcccaggcacctgaccttggtaagcatagaggaagaaagaaaacaggaaaagygagagctcttgggtgaaggagccatgtggctataagtcctgaaatgttgcagagttttaggttcaaccatcagaagcaagaaccttccagctctgtatcactggattcttaatagcagaagcctgccaggmgccactcaatgtctgtggggcttacagagaaaaatgaagaatcagtggccctgaagaatttttcctggggaattccagggttttactgatggattgggccataatgtaagtctttttcttgatgtggcaccatactaaaaatatgcataacctggccacctatcacacctctcgcccaaagacccagccatgggttacagggccctacagaatctggcacggccagcccatcctctgacctcagtcctgccactcattcccttgctcacttcaccatggcctcttgggccttcacactgttccttaagcttgctgagcctgctcccaccctcgggctttggagtgtgctgctcccagtccctggataccactcttttcccagcacttcacagagcgtgctccctcatttcactcagcagctcagatatgacccagaacagagggcttctctgactaccagcctaaaaaggcacccccatcctgatctaccccttcaagctgctctaggtttccttgtgaaacttatctgccttgatattatgcaagtattggtttactgtaatatctatggcctgcctccccatcagtgagcagaatataaggactgactccatcatccactgctgaatcccagtgccctgaaggcagacaagtatgtggtatgagcttcatgagtgtttagggaccctggctacttcagagtcagcatttccatagaatcttctgattcttcccttccacctctgcattaacaccccaattctttccttaaggcataagggaaatcattcccttggaaagtcttcaattccgcttaatctggatagaaaaggaaggaaggaaggaaagaaggaaggaagggaggaaggaagggagggagggagggaggaagggaggaaggaaggaaggaaggaaggaagggagggagggagggagggagggagggagggagggagggaggaagggaggaaggaaggaaggaaggaagggagggagggagggagggagggagggagggagggaggaagggagggagggagggagggagggaggaagggagggagggagggagggagagagggagggagggagggaggaagggaaggaaagaagggaggagggaagaacgaaaggtaccgtgtctgttggcatttaaaaaaattagtgtgtaccaggcatcattccctctcctcctctcccattccctcccttctctttccctctcctccactctattctcctcccctctccttcctctcttctcccctcttctctctcctctcctctctctcccttttctctctgcttttgtactcttataaacccaactaaaccctgcttaaggtcaaagccatgaatttgctgcatgccataagagacaggaggcaggggtgataggcagaaacataaagccagcaaagcatattttcatagcaacataagccttgacagtgacaacccagtagctctcaggaattttggaagaagaaaggtggaattttgtttttagccacagctaccagtaatacagaacattctgctcttatttgctattttgattttctcacagaccaaactgaaatttattcaaatatttattcatccagcaaatatttatttcatacctactgtgggtcaggcgatgccggtgtatagaagagaaagaaacagcttctcttctcaagaaatggtgcacgttgctataagagagagaaccaaaacccaaattataacactgtagcttatctgttttagagggatttgtgggaggctgcaggagcatacagacaggtacccatcacagacctaagcaaagggaatgaaaagcattggagaaggctttttggaagaagtgatgtttggttgagttctgaaaaagaaaaggggctgggcaagtggagaaagagtaatgacatttccagcaaagggaatagcatctgaaaagctgaaaagcatgagaaactttaccttagtgaactgcaagctatacagtcctgctatatgatagagtgggaaaacagtagggtaggaggctagagacatcatcaggggcatctgcaaaggggcttggttcttggcagttacaaagaaatcaccgaatgttttaaggcagccaaggcttctcatttcaattgtcttatctctgagagatgagagtaaagcgactgaagataccctttggggttgtcaggcttggatgtgaccatgcccctgctgtgggagaatcactctttctcccctaagtggacgctgaagtgagttcctcatcaagccagcacttggtaatcactatctagaagatggtaacaatctacagatttttaagttggcactgtcagaaattcctccagaccagctgctcaacccaccaggagcacagcaatgggtttcaaaattctgatttcccaggcccactgacattgttcaagggtagattccagtgcacagctgtaagaagaagacaacagccttttgataaagaaatgccaagaaattcagtgtggaatctataatggaaacacttggcttctagggcagtaagtccacagtatgtcatttgcagttgaaatgtggagccagcatttatgtgaagcctcttggtcctcatctcaactattgtccactgtattttttattcataatattcccccttctttcataattctgaccccctctctctttaatttagctactgattttatttgtggaagttgtaccttttactcacttggctagcatttatttaataaagggatctggatggggcacacgtagcatccactactgacatggccacagtactgcctctctgagttataaaccaatgctctttcttgatttgcctaccaaaaaaaaaaaatagtagagaaatagccaaaagtgttagcagaagtaccaacaccatcactattactatttactgaacaacatgacattatgtaaaaaaaaaatcactctatcaactatatgaacagatgaaacaggatgtggggacaattagatgaaagtatcagtggcatactaaatatccgattcaaagagataagatgattctcattaggaagagacattttccaacgtgcatcttttctctccatccatcttttgccacagcttaatgggcaatccacaatctcattcccccaccccccgtaaggtaactttcccaatatctctttcaagggggcatttaaaatttattttatagaaaaaaatgttttatgtaacaattagacataaggattaaaagatagacacccgtagaaaaaagacagtaacttaattcacacgaaggggtacgttgtcaatgacagattagttcctgacaggtggacagcagagaaacaaaaacaggaaagtgggataagaaggagagctaagaagacatagggttgatttaattttcacttagctctgtttttgtcctatatctctttctgtatcaggactgctgaaatatttgagaaggacatgctcttgagtttagttgtgcttaaatcccaatgtcaagggtataatcactatatccagggaactgtttctggcctcacaaggcccagcaggattaaaggtagttgacacctcctttcttttcctaaatctagatacatcacttgcagtttggggtcctccctttctcataaagaccatgtttaggtggttaagaactgctttggagcctctggtgtaagctttaggatatgagtcggggttaaagaggagtctgtattcaagatcaagtattgcaaacattttctgtaaagggccagatggtaaatattttagactttataggccagagagtttccattacaattattcaactgcacattttgtaacacaaaagcagccatcaacaatatataagtgaacaagcatggctatgctccaataaaactttatctgtggcaccagaattggaattttatatgacttgcatgcaccatgaaataatattcttctttggatttatttcccgaccatgtaaaaaagtaagaaaaactgttgttagcttgctgactaccaaaataagcagctggccagwtgtgggcctcgggtaacagtttgcggacctctgttctcgatcaaacaaaatttgaaggagtgtatgctctgacaatatgaaacaagcaggaagaatgttccccagaacttagaaatgtctgagttaaatcaattccagaaaagaaatgttttctcctctgaaaggatatcctcaatcaaattccaagctaagattttcaacttagtagcctgctctaatggacacataaggctcatttgaaattagcagcaatgtgaagtataaatagaaaaaaacagtttgttcttttaaatgatttaaagtcagtttctactctctagtttacaggatccatttccagagaaatactttccttcctaaactatgcaaagtccacttaagctcagccctgggcaaattatctcccttaagtcaggttgagaccagtgagtttttacggaatttcgtgcattcgcgagatgaatgaacagggtgcattcagttttacttgagcttcataagatctgcttctcccaggacctctttcttttttctattaaggaacagtttttcaaagccttatcaccttccttagctcagccttaataatactgtgtcaatgtgtctctgatctttactaatatgatctatgtaaatgatttgaacgctagaaactgatgaaatcccaatataaactatacaacagacctcccataggatattgaggcagcacaaaaaagaagaggctttttttttttttttttttttttgagatggagtctcgttctgtcacccaggctagagtgcaatgactcaatcttggctcactgcaacctcaacctccagggctcaagcgattctcctaactcagcctcccaagtagctgggattacaggctcacgccaccacacccagctaatttctgtattttttgtagacacggggtttcgccatgttgtccaggctggtcttgaactgctgacctcatatgatctgcccaccttggcctctcaaaaaagaagggtatctaagaagagccaattgtctcaaaatacagaaggtcggacagctcaaaccaagacccccagaataactgagggccaccccattatgatgcaagacatgttccaaaatgaaaactgaagctcagagcatcgctaacatagacatatagttttctaaatctgcaggacactgatcaataggaaaataccatttccaagagaaaaacccaaatatgcatgaaggcaaaagaaattttttgtttgtttgttttgagacagagtctcactctatccyccagactggagtgcaatggcgccatctcagctcactgcaacctccaccttctgtgttcaagcgattctcctgcctcagcctcctgagtagctgggattacaggtgcccaccaacacgcctggctaatttttgtatttttagtagagacagggtttcaccatgttggccaggctggtctcgaacccctgacctcaaatgatccacccaccttggcctcccaaagcgctgggattacaggctcgagccaccatgcccggccacaaaagaaatatgacattgttgtcctgctggtgttttaatagggacagcaccagtaggggatgcagtgaacaaagcctggcacttggactgcaatggcctatagatgtggcattgggtttgccattcccaggttctcagaagcaaaactttctgaggaatagtttaactgaccccatctctgtcattattcagaacaagcccctgagctggaaaacctcaccgtgactgaggttggctgggatggcctcagactcaactggaccgcagctgaccaggcctatgagcactttatcattcaggtgcaggaggccaacaaggtggaggcagctcrgaacctcaccgtgcctggcagmcttcgggctgtggacataccgggcctcaaggctgctacgccttatacagtctccatctatggggtgatccagggctatagaacaccagtgctctctgctgaggcctccacaggtatctctttcctttctatttatagcttctgtttttcccagcaggaaactgcccatgaataatcagacacgactagctttggaatggacttgttctgccactacttatgtctatggggtctaattgtgacacgaggccatcacgctacagaaccccaaggcaacttttaatacttcactccacatgaatgacacccttgggagttgtacagagctcaacctgcaggactaaacacacagctcccatgcagagggcctttagctccataaacagcctccctcctgttaaaggacgttaaggcactatatatgaaagggaaagaaaatcacaaaattctctcatctactgagggttaaggcaattctttaagatttaaaaaacaaacaaaaacaaatattttcctgcactttcctctctttgctccatttctaaaatttaaagagttgcatgatgcatgtttatctaaagaaagtcacattttttcagtaatattattattcagcttattcttgtgttaaagattccctggatcttgttgtgtgatttgatcactaaactagttctttgtccttctccaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacaggtattctagacgaattcactaattcacttcctcccctttgtctctgctcgggaggaatcaaagcactttcttgctttaaactgggatcagctcctaccacattggggaaataccagtgaatcatctctgcttcttcctaaatgtcacatcccttatttggctaagtcctagttgtagcccagttccatggaaaattccacctactcctcctttaaaaaagtgagaggtggcttttctttcaaagtaagtttcagtcacaatatctaaaaagttggaaagcccaacctgtaaatgaagaaaaaatagctctgagctcatgagctcattttaagaacaccaaaggactccccatagccctatttgtatgtcaagaatagaaattgtgaacaattcctaaaactacttttcattcccaaaagctgaatagaaaaaccctggctttagtgccaacagtttgagtgtgctcaacacctgctgtaaatcatgcatctataatcaacactaaccagacaactcatcccaaccttagccaaaatgccatctcacctgaatcccagcgtgcaattgcctttttaagtaactcagcaactctgtgtccttatgcagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacaggtatatgaccctcctcccagactggagacatgataggagccagcatgtcattgaaatagagaaaattcacccgtgtggcagaatcctaccccaatgttgttgacagacagcgtgaatctctaactcaggaaggtctgtgttggaattccacctcactagctaaatattcttgggactatatgtgtatgtatatatatagatacacatatatacacacacacaaatatatacttatatatatagtgtgtgtgtgtatatatatatatgtgtgtgtgtatatatagatatatacttttttttttttttttgagtcagggtctcattcttttgcccaggctagaatgcaatggtgtgaccatggctcactgcagcctcgaactcctagactcaagtgattctcctgcctcagcctctacagtagctggaaccacaggtgtgagccaccacactcagctaagttttttgtattttttgtagagatggagtttcaccattttgcccagcctggtctcaaactcccgggctcaagccatcttctcaccttggcctcccaaagtgctgggattacaggcatgagccagcgtgccctacctctattcttgggtatatttctttacatccctgagcctcctttttgtatctttaaatcagcaatgaaccctacttcaggaaactgtcgtgagcaataaataagttaatgaatgtcagtgcttagtaaagcgcccatcacgtagtaaatactgaatagcaaatagctaaatttatcatacagcaacagagtcatgatttttaaaatagcacaaacgttagggctgtggcacaaaaataagatcagaactttctagaaaaaccttattactagcctcagagccaccaactaacacccaactgataggcagatctctacataataacctttagaaatgatgcagttagcttctgctgaaactatctaggactctctcctcaacagatacaaaaagcagggacatttccaagaaaggacagccacctttgacttcaatgcttttcattcaatttgggaaggaaaaacaattcctctcaattttccaccaaaaatgagctgctccatctgttataaaaaactgtgctgtacatgagrtttctagaaatagcttcaaaaagggctatgggaaaaagggccaactttttggtgatagggtttctgtgctgagccctaagcccatgccccactctacatatgctgccttttgataatgcaatccaaatcactcaattcaaaacaattgttttccttgctcttatataacagrtaaacttggtggttgctagaaactacataaaattccaaaartaagggggccaggttttattcctgtgttgcctggaatatcttcagatcaaacaagagcaaaaagggcctttgagacaggtgtggyctgtgtgcaagatgctcatatcttcctctgtagtccgcaaacttttgtttttagcagtacaactccttttgcaaatgaaatcttccaaggaaccctactatttgacagataagtgaacagctgttcttggtgtgcctggaagtaagagggggatacctccacccatgttctcaacacagttcttctagaaaagccccagatctatgtggaacacagtttgaaaataacccctcttaaaagcaagaggttgctcagaggttgctcagactctcacagggcattgaatccttggatacccaagagcaagtatctatatctttcaactatttttggttgaaatccctgcagatattctcctccctaacttctaacccatggccacttcagccttcaaaacagtggctgagagactgcatttaaccctcagaagcatcccacaaaacaatgggtttttccatatcctaaatccaaactttctaaatcaccaataacaactacgttaaatttcctttctacattgtagaagcagtaatagtgggttctgttctgcaccatttactgagaaaaatctcctttcttttaattaaaagtaggcacactcatttcacacaaacagctttgctctgtgatacagccattcttcctttagacataaagtacgagcagaaaaaggtggaagaagaaacaagctgagaacccagtacacaacttttgatccctgaaagctgatagaagaccaaagaaaaaacatcatacttgttcacacctgagacagcatacactttatcaacccaggcaggtagccagtggctagtgatgagataatctttctaattataaataatgaaataaagcagggatttctccctgacatgagtaagaaattccaagggaaaacacttgaacaatgatttctttattaagctgacacttattgggcactcgccatgtatcaggtatgatactaagaagttgataaatattaccatttaatcatcacgcaatcccatgaaacagtaccatcaactccatttaaaggtaaagagagggtggctcagagagaagctgagtgacatgcccaagattatgcagctagcaaatgctagtattgggattctaatcaaggactacttgcctccaaattctgcacttgtaaccattgctgtatctcttaccctaacccacaatcctacttttccatgtgaatttcacctgctagcaatgcatgctcccggtgggttgtgcattggtgcagatgtctttgccatctcaaggataaaccatgtagatatttccctttctggccattttcaactcctgaagacaactgtggccagggaaccacagttcaaattgcaaatgctcagagaccaagaattaaaaaaaaaaattatctttcccctttctctctttcctagagttgggctgtgggatgtttggtttcctcatttttggtttatagaactgacaaatacttttctgtccttcttcagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacrttgcctggcagcctcagggctgtggacatcccgggcctcgaggctgccacgccttatagagtctccatctatggggtgatccggggctatagaacaccagtactctctgctgaggcctccacaggtacttcctctccctgtcaatgctttctccccaaggttctttgcttccttttcaagagatcatgcgcggagtcagcatctcgccataactgaatccttttcatgtgcctttcagtggccggctgtgcatgctcagagacctccctgtgggctatgactttgtcctcatgcctttgccatgtggatggtgaatgatgcaggtgttgccctttctgatctccagccccccagcctttcatactttacctggctgattctacatcktttttgaatgatgaatttttgtttcaggaatcagcctgatggttttaattcacttctccagtgcttggagataactaaaagcttccctccctatatatgagttctggtggaacacagattatttactkctgagagtcttttgctagttggaaatggtgcttttctatctctaaatccctcaaggatatgggtagtgtggttcttgcatgtaagaaatgtttctttaaaatgcacccagtataataagagaactgaattaccctcctccgggcagttctctcagatactgagtcattgttagaacatcaaattagcaaatagctagaccagaaggaaaaaaaaagaaattacacaattatgactggagactgtaccaaagagaaagccattcattagcacaagtacacacagcagcttttggaacaaggaatgtcctgggctatgaatgtcaaagaactgataccctttttgctcttttaatcaagagtttctctctggagtgttggcctttggatggcaaactcccagccccagacccaggagggtgcattatagtttactcgtcactctacccctgttacaagacttcagtgtttcccgggggcctgccaaagtcagcagccttcctctgacacagttttccgttgctcatctttattatgtgcctccatgggtttgaagctcggtagagactatcgcttcattttgcatatgactgcycccctttttaaataattattgcaactaaactttaatgcatacctgtacatcccagttgaatctagcaagagcatagctctgcattttaacctcagtcatttcactaattttcactgagataaagaaacataaagcacaggcaaccactgccaggacggtgaccctgaaatgcctagaatttgcagccgaggctactctgaaggcacccggacctcctttttctgagacccataaaccatcccttcccagaaggcaaagtaatcacccaccacttctgatcttttctgcagatcttgtggcttgggtgtcctcagtatttttatgtgtgtgtgtttttcttcttaacaatagcaacattcttgccactgatgaattggcctatgggcaggaagttccataatcccatctgatctgtatctcaacaaatctattagaaggatctcagagaccaggagccttctttcttgctaaagagasagtactagcttttcaaaccctgctcctacctgccctctgcatgttttattcttatggttggggaaagcactggcaggaccatcttcaagacaaaatgttatttcttcgctgaaagggatggcctaaactgccttgccttggcttagccctcttggttggcaatgcaatactagcctttttggcccacatagcagcagttaagagaggacaagctattttaacagaatatgagaatggctggctggtccttctctaaagtatgaaaaaaataccaagaattacactgagaaattggtaattaccattaagtcacaaaatcagaagcctcaagttaccaccttgggaaggtaatggcatcagaattatttagccctcatttgaatagatgggagctccttcaaagtaaagaatgtctgtggaaggcatccaagtaatcttggtttccttaatgcaattcaagagactggaagttgccaggactcatatcttttgaccagtggccagcaaccctgaggtagggctcccagaggcaagtgtggttaagatgcaacagttcctgataagatcattcagcacatcttcttggccagggcctgattatatgtggcaactgcatgtagagaaatctaattgccataccttcctttttctaatttcttttaacaaaactgctttttctctccctttggcactaattggtaacattgcttccttccatcatagccctgaattatcagatctctctacccagcaatggttctattaacaacctcaatcttaaaacacagccaaatawctcaaatttatttttttcttctcccctaccccttccttttacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacracaggtacatgtgcattctcccatttctaacgcactctctccacagwcttctttgcagggtgaagcctctccttctcctctcccattgatgtacaagccacagggcactaactcttccatggtgctaggctggggtgctgtttaacataactcttttccaacagcagcccaaataatgcattgccataaagacatgtgcctgatttatcactgaccaggatgtttacagcataaaatgtagttcagtctaatttgccatatggaatctagagaaaagaattctaacctctcataactaaaaagctatataactagacctgttcttgactttgaaagatgtctgcctcagtcaaagaggtcttgtaaattttattttgtattatcttagtgtctttgtcttcctagtctcttggacctcgcaatacccaaatatcccagtgatttaataatcatgttgatggtgttgggtatttttttccaactgggaaagtaaagggaaacagcaaagattacttatcagatgagtgcaggaggcagccatgccattcagaccaccccagttccaacaccacctctagaagatcagaacatgctgtcttgccctcagaatagtgaatgataaatggcaaaaataaaagtagaatagttgtgttcaaacaagggacttagtttaaaaaacaaaagaataaactgctctcactttaaatttgtggtgtctgtgagatgtgcactaagtcagatgctctttgccatgcagtaaaagacaaccctatgtgaatttagaaaggggagcccccctttctaatgctacattcaaagtagcattcttagcacaatttagacagtgccttctctggagaggtaaatgaagaaatcacaaactagaaaaaaagaaacaatatctacagaacaaacacaggagaaatgaagaaatcacaaactagaaaaaaaaatattgtctacagaacaaacacaggataatttttccttatagtttacaaaaaggggactcatggtctgggaaatccaagaaaagggttgacatcgtagcatcaaaattgcctgtcatttaggtcacccatggttgagagagggtctgtcctcattctacatgaggctacaaattgtcgtcagggtgatccatggataaggcagagagagccaacattatccagttgctatctcagccaggttcaagtataaaaaaacttagaggagaaaattaggcaaacatatatgtttgtttctcatggctcaaaccgattttcaacaagggacaaattattttaccattaacaaagggtaaagtctaaaactttatggatttagtcttatgtgttttgattttgactctacaatggtgttttaaattgacacactttcttttttcttttttttcttgctttagtagccaaacctcttcttagccacctcactgtctcaaacatgacctggggcagtgtgtccatctcgtgggaagctcaggagtctgcctttgatagctttcttatagaagttagtaattccgatcacccccatgagaccatggtgctgtctgtgcctggggtgtctcgcagctctgtcatcaccaacctcaaagcttcttctaattacactgcccaccttcatgggctgattggcgggcagcgtgctcagaccctgatggtccaagcaaccacaggtatttcctattatggcttcttcactcttcattgaatttcctctgaatagctttccaaaaatcacccgctayccacttttcaccctcctagttgctcccaatccttctcaaatttgatagagccatccaaatcaaagctttaaagctttaaaataactctcaccccaaattaaagaatttcagtgtcaaacctctttttcctaaatatccattcacatctggagttgttctgtttgtttgtataaagttaacctgacttgctttggttgaatttctaaatcatcttttcatctgatcttgaataatctttttcaatcccacccattatcatctgcctgtggtcgttctamtcaaagtttgcctatgtcatgttcaaagaggtatgtgcatgccatttctggtgmcttggtcagaaagatctacactctytttctctctagcaggattttaaaaaataaaggtgccctgagcatgctgagaatagactctgaatcacaacccaagaattgcatgagaggacccagtagtcttatcttgttctcgtgatttttgtctgaagactactcttttttgacatgtactttgtcaagcacattttgtcacccactgatagctgtcacaaagtctcaggctcttctttcaagccatcatcttgtccaaatcttggtgcatgtggtgaatattcagagcattaaattttgaaaatgtttctttttcctggaagcagctascatgtccatgagtcatttcagaaggtttaaagtggtgggagaaaaatgcccctcattttgcatggaacattgaccataccctaactaccactatctttctctgttttttcttgcatctcatttctcagcttggttgcaccctttgagaggcagctggaggtaaagctgacctcaagaacctgagtcttattctgcatggtgaatctgttggcattgatagtctgtctggtagcatgagaagaatcccagcatgcatccttaatttgggagattgtttctacagcaaaatatagggaaataacagagttccacttggaacattttaatcttttgtgtggttgagggaatttgtcaaagctatagctgcaaatgattgcattgttaccttctgaaactaattgataaggaggatatcccatgtcaatgctaatggctatattctgcttctgaaccaaatcctttttgttcttagagattttatgacatcgaattatgctgtataattgtgccattaaagtttatccaaatgagccccttctttcctccaaactttggagctgaagcaaaataactcccaagtccttggaagaaatattgtgcctcttcccaaccctaaatcctgatcttaatatctgaatcctccagtactgttgcctctctctaaaatacagtctgggccgcacttactttaaaattagttttatttgataaatgagcatttaggaggccagccccataaacatctagccatatagaccccttaacattaaatgagttgctctcaaaactgaatgtctagactttaacagaaaagagatacttaacctcagggaaaccatctatctgtccaaattatccaataattgagtttcctaagcagaaaattcaatgcctaacttcaagtttttctttcacctttgcattcactgggaattttgaatggaagccatcttcacctttacggtattaaatggtaaaatatagattttcctacaatgcatattaagtactgtaaaaatttctcttgtatgggtattagcctttaatttgtgcaaacagtagatactaaaaaagaatactaaatgaggaaactccaaagaagcattttctaaaacatgttcaatggaacaccagctccttgagatgttcaaaggatattcctcagatagggtatacattgatcaataagtttatgaaatttgggccaaacaaaattaaacaggtttactgacagaaccagcctgtcagagcctttaaaatgcaaacccaccttgtgaatctctatggtaagacataatattcggtgtttaccatgcatacttaatcataaagctgtcttttcttggaacatcttacagggcttgtgtccccagtacaaactttagaaaatgtagccttaatacccttcacrttactccaatctaccactctaatggcttgtctactcttcttcatacatgactagcaaatggtggtgtttatgctttaaaagaacacagatctaaaaaatraaataaaaataaagaacacaaatatacacctgcagagaaagcaatatattttctatcatcatattcaatgcaggtgtagacacagcctaacatactgtctcttctgtatgtatttggagatattgatgctttcatgttctatggctacattctggaaaaatccactgcttcctctaataatgtctctctctttctctctgcccatattccttctttagaaccaaagccacagttgggcaygctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattacaggtactcartcagaggttctcacttgtctaacacagagagaaaaggagataagtcatcttaaaggaaaattcaacaaaaatacaatcttcactgcaaatgtgtactctcttatttttaattgacaaatagtaattgtatatatttatggagaatagtgtgttgttttgatatacatatacattgtggattgattgaatcaacctaattaacatatcaatcacctcaccttatttatttatttatttatttatttatttatttattgtgctgtgagaacatttaaaatctactcttttaggaattttgaagtattcaatatgttattattaactatggccagtcaccatgctgtgcagtagatcactaaaacttattccttctgtctaactgaactttgtactccttgaccaacatctcccctttcttcatctccccaaccccagtcaccggtaaccaccagtcttctctgtgcttctatgtgttcagctttcttagattacacaaatgagatcacgcagtatttgtctttctgtgcctcgattatttcactctgtacaatgtcttctgggttcatccgtgttgttgaaaatgacagaattttcctcttttttaaggctataaagtattccattatatatatatgtgtatatatatatatatgtatatatacacacatatggaatgtatatatttatatataaatatgatctatctatctatacaccacattttctttatccattcatccattgacagacacaggttacaatacattactcatgatagccaagataatatatgtaaacttctaagtaaagagaaagcagatactattataaaggagaggactttcacagctgctcttaggaagtggagagaacgttctcaagagttgtataaagcttttagggttttttgtgcccagttttattggctgttttatccctagtttagagattctgcctaaaaagtgactcctaagttagtaaaggcctaagatcgaaatcctgttcataaatcatgctaggtaacrcagttcatatatgtgmcaaaagtataaccatctttttctttaaaaaataattattcttaaaactgacaacacagatgcagctagatgcagctaatttgaaattcctgtctcctttttttcttytgattaaaaaaaaaatgcatttaccagtactgtcagaaaaaaaaaaaaaagaaaaaaaagaaaaaagaaaaatcacctagaaaagagacgctgaaccttctccactaatcctccttatccctcaggattgccatcactgattggggttggctttgggtatggaaagaacgtagaacttggagtcggaagacctggttgtatatctcagcttaggcacctagcagatgtatgacctaggataagtcattaacttctctggtttttttagatgtgatmggggttggaagattgatgaaggttcaacctcagatggcagataaatttcaagtttaattaagccctacccattcactcaacttgacttcttgaacatttgccaatgttcaatttggcaaatgctgccaaatggtgrcagcaaaaacttcaatggcaaaggctgcacatggtgtcagtttactaaattctagcccaaaaagcctcagaaaatatttagaagtctctttcttttcattagtgataattttcagaagayggactttgccatctgattttcacattaaaccaggtctctcccagggtctaaattgccatcactaagacatgtcaattagtacaattaaatatttaattataggcagcatggtgtcctggaagagtgaggattttgagatcaagcttttgtggtttctaaacctctcccacagctttttagctacataattttagcaagttcttaacttgtttgaaccctaatttccttatgcatggagagaggataccacaggcacttctgggagccttgtctcatagattaaatagagttggtgaaatttaactgcctagcatccagtaggaattttatacatgctaggttctttctgctgtctcccaacattattaggaaagtggctttcttaaaaataaccaataaggctagatagaacaatagacctatgcaatcatgaactccctctcktttttaagagaactttggatgtgttttaatgtaagattaaaaaatgagtattttttcctatccagttacctaatgtgaattaaatcattcagatgagtcytcaaatgcagaacrtggtaatttcttaagggactgagacaaggaggaacgagatgagattctcactcctcaggaggggagaaatggccacagatcccatcaggccattgcttgtagcggcttgcaggacctcccacataacagaagaaaaggaagctgagagacccagtcttgggaatcctagatccagttacagcattgtctcagctaatccatgatgtgaaaagattgcgttttaaaagaagcatattaaaaaagaaaaaaacaaaacaggagggactcttaaataacaagcccttgattgcctaattagcctgaatgccctcactttcattggaattcactgctttgatggtgtggaggtgcaaagaggccagctatcaaagagagaygccacttatctaaacaaaatccaggaacagaattcgagacccttgtctctcagaygaagattgtttgcccagtataagagatttcatcctcgcttttgatagaattatgattcttgggaaatctttacgtggaaaaaactgcctcagaataaacaccaagtgtttcaaaataactacaggaagtccaagccacagcaaaatttaaatctctatttacaaaatgaaggtattcattcccttattcattcagtcaccaaacacttctttttaaaacatttttctttatgwctcatggattagaccctaggcattagtgaattaatgcaagagcatttatctctttgtaagtttccatttagctgtaatggaaaagaagtgtctaaactagatgcagctaatttgaaattcctgtctcctttttttcttctgattaaaaaaaaaaatgcatttaccagtactgtcagaaaaaaaaaaagaaaaaagaaaaaacacctagaaaagagacgctgaaccttctccactaatcctccttatccctcaggattgccatcactgattggggttggctttgggtatggaaagaacatagaacttggagtcggargacctgattgtatctcagcttaggcacctagcagatgtatgacctaggataagtcattaacctctctggtttttttagatgtgatcggggttggaaggcaggtagcaatatctaccttactgtatcattttgaagactaactaggataacaatgtgaagccttgtcagttggcaagtatcaatggaaacttagccaacataagctcactccttttggatatcccaatgtgtgaaaaggccctttagcacctgagaaatcagaatgcctgggacatacatgtttggtgaacgaatgaaggagagatggtgacagaatttactaagacccagatgtgttcttgttttctaactttatccaggaaaataaacagcaaaagatttagcaaatcttatcatttcttagtgggttataaccatgagctattaattttgacacaaaaaaaaacttacctcctccctttatttcagcttgtgaggatatstcactaattgacttcattaatttgattcaaactgtgcactagaagtgggatagaaacacatgaagtataccggaaagaaattatactcgaaaaaaaaaaaaagagctgaaggcagtgggaagtagacaacgggatccaaactcaacaaaatgcaacctatttgtataaagaactacatggcctttggagtcaaacctgactaaaatcttcgctctatctcttcttacaagcttgtaactttagctaagtcaatcaacttctttgaaactcagtttgctcacgtgtgaaattagaataatacctacctcatgggctattaagagaattgcacaagataacactatctggcacccaataagttcttactgaattttcattttctaagcatataacacaaattgaatgatggacttgggtatctattggtgttcttggaaacgtgtgctatcctgacagagtcagtgctgctaacctgagttattttcactcctcccttctttcagaggccctgccccttctggaaaacctaaccatttccgacattaatccctacgggttcacagtttcctggatggcatcggagaatgcctttgacagctttctagtaacggtggtggattctgggaagctgytggacccccaggaattcacactttcaggaacccagaggaagctggagcttagaggcctcataactggcattggctatgaggttatggtctctggcttcacccaagggcatcaaaccaagcccttgagggctgagattgttacaggtatttcaaatcaagtgagccatttgttcctcttcctggtccccttctgtgtaatctgtctaccggatcgccatgactttaacatctttgttcacattccctacttaatccataaatgtagtctactgtttcaccttctccccacactccctcttgtcatatgtacttaatgaacactccccactcccaccccagaaatgagaaggtcgaaatatttctgctttgtattcaaaatcctttagaccttgtcttgtccatagctcttgtgtgcttacctcatatcatcgtcccttgtgatcaacctggctggtccccagctacatttcagccttctcaaaagaaatataccaatgagtatatttccaaaacgtatttaaaacytttgccatctcaaaatctcaaccatgatcttaacaaacttacccagtgggctcgtcattggaaaaccaaatgtgaacttattttatcggtaatcactaatatcagagagactctgcaacacrgactaaatccataattttctcaagactaatgattcctacagaaattaacaacggaatagtcaaacatctgtgtttcccaaagtctttctagagattactagctccacagaatgttcaaaggtcctactcggtgaggaaattccacgttcaaataagtttggaaagactgagttaaacaaagttaaagaggatctttaactgcacggcttttcagaacaccctaacgtgcatcatctccaagaagtacttatccaggcagtattttccaaacttatttgacaaaggatactttttaaggaagaggatcaaacaggaatagttcactgtgagcacactttgggaaactcagctctaaatctacattgacattgagttttgtctagttaaggcaatgcaagatgaaaccctgggtccacagtatgtagcacaaaaggttccaacctcagttctaccatctgaacatttatctaatagttaataaaataacaagaaagaatgcaaaaaaaaaaaaaaaaagtcaagggtaggagccttctttagtgaaacagcactaagaacaaagcaaaaagaccataacattttaaaagccattttgggcaggctcaaggagaatgtaatcagcagtatcatcatgagcagctctacagatcattaatgctggtttatttgtcttttcaaaaagaaaagaaaaaggtcttgcaggggatgggcactcagccactggaagacagagagcaaatgtaaacaatttactggctttgaacttatttaataatatgtgggacgggccaatgctgagtccagatgtggatttactgaattgcttttagacaaaactcacatatgcaaacatatgcttgacttgtattgaatgtgtctactccatctttcccctctcctgactctactggacttgttaatgttgaatgattttatttttggtatctcaggacacttctatctctgaaagccggggcatcactacatattgatacccctactggagagaagattgcacggactggtaaatgatgttgtytttcctccttctcccaccattttctctccctctagaagcmgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacwtaacaggtctcagagaggctactgaatacgaaattgaactctatggaataagcaaaggaaggcratcccagacagtcagtgctatagcaacaacaggtactgtaaataaacaggagagaacagagaaaagtcatgactcaggggtcttcttctcacagggctgagtaatcacaggagctttggatgcaggcaggctggcgctctgatcctgactctttcaattacagactgtgttaccttggacaatttggctaagtccttatgcaaaaaaagtatgatgccatttacttaataggrttgtgaggattaaatgagataattcatataaagcccatagcggaaggcctggcaggtagcaagggcccagcaaatgagagctattcacgttgccattaatgcatcatcatcgttacaattatcatctttttttttttacgttccaaagattcttccttctatctattatctcatcatatctcatctcatcatatcatatctcatcattttatccagagatacacttccttgttctttggccaaatgttcgagctataccaagtagggagataatggagaagcagcacgtctatctatacacattaatatttataaaatgctacatgtgaataatcagtacggtgatcagcaaggataaaggagagagstggcaagattaacatgctactgtttatgaagctctctaactttgatactcataacaactctgaaaggcacctagagtgtccttggagtttaattacctttttccataggagctgtttcaaggagaaaaaaaaaaaagatggttaataatatgactcttaggcccagagtgatggctcacacctgtaatcccagcatttcaggaggctgagacaggaggatcacttgagtccaggagtttgagaccagcctaggcaacatagtaagaccctacctgtacaaaaaaaaaaaaaaaaaaaaatcaaaaacttagccaggtgtggtgcctcatgcccgtagtaccagctactctgcaggctgaggcaggaagatctcttgagcccaggaggttaaggctgtggtgagctgtgttcgtgccactgcattcccacctggacgacagagcaagactctgtctcaaataatgataataataacagtagtaataatatgactctttgtaataataataatactaagatgaacatgactttttaaagagaaaaggaaaaacctccaacaagtcaagtaaattatttcatgaaactgagggagatgcagagacatagcattcgctggagatggctgcttcaaagggaaccaggggacagaaccacaaaatcaccaggagagataaaagggacctgagagatgatgtagctcaacctcttctgtttgtgcatgaagactctgaggaccagaatggtgaaatgatttttctatgatcatagagctagatttggagtaaagcccaatgaccagcttattctaatactatttaaaatgagcagtctggatgagagaaaaccaatgcatatagctacttgccatctctgacaggcataggcatgacatttgccaaaacctctcctttttgtctaaagatagatattttatattgttaagttttcaggacctaataagtggcaagaaatcacccatgtaaaaataataatcagtatttgtaggcttggagaaaatgctagaatccaggcagcaacctagtaagagggaaaaaycctgtttcttattaacagggacaccctatcctgggatgcaggtctcagtctcctcctccctgtggctgcccataaaacgactccagatcagaggcagagccttgattttgatcttggtttataaacagtgttcttcgaagtttacttcttctgatcattgatttgttttgctgatcttttttttctagaagccctgcagttctaaagcaaaaaagagaatgaataatcatgaattgaattttttttaagaacaacaaaaaaaaaaggcaaggcagaccctgctcttttggaaagccctctctttgattttcttctctagagcctagtagcttatagccaaagagaggtgcccatgcgcgtgcgtgcttgtgtgtgtgtgtgtgtgtgtgtgtgtgtgtgkctacatgcctgtgctccaggaccaggagaagacaggaaagggggctcttgagcacagaagatgcctaatttctatcttcacctcatcaagtttataaatttccccttttgttttttttttttaatcctttctcctctcctctcttcctccctcataccrttgtaaactcttctctgtaatgtcctatccctcttcctcctgagaaggccctgctgtagctcctcctctcactcacaaggtacctctccatagcacaagctgccagccctgggtgcccagggcagtagaaagggcagtgggagacagtgttgcctggtggttaagccaacaaccatgggacagtgtccttggagtttcatcatggctctacctcaattccttcatctggaaaatagaatttaactcaaaggtcagccacgaggtttacataagatcatgaatgtcaagtatttagcagaatttctttacccacagtaaccatattagctattaatgtgtttggccataagatacacctactaaaatgtacctacaccaatgaggttttcagtcaaagcaatagtgcgagtacaccaggttggcagagggaagtcctcagtgcctgagtttatacacctcactgttttttgtttgtttgtttgtttgtttgttttttcccagttagactcatctcgatctttcctaggggacaccttaaagtctagtatggcccatggaggaaagagggacattggaaagaaaataaagagagggcaatcatatttactgaattctcactgcatgccagatgctgtgctgggagtttcacatttgttatctctgctaatcctcaaaacatcccygtgggtgggtaccacttttccctctggacagatggagaaactgaggttcacagaagtgaagrgacctgcccaaggtcacccagcctctcagtggtatttggacaatgaagctctttcaggctccagagacccatgtggtttctgaaactttccatgggcagggcaaaaacccaggcagccacagagtctgggggtggctaccaggccacagaagaaagctgtaggaggagatgtcttagatgagagaaaaatgcagaaagaggaagraaaaaaaacccttgctgaatttctgtgggtttcagcatgtaataatccctgtgggttggagaggggaaaagatgaggaagtgagttccctagagcctgaaaattgtttcctgaattctctgggtaggcatggttagctgaagagggcaaaaatcgcagccaaaaaatacacagagaaaagccaaaggaaactgggttttgaggggaggtattttgggaggcagaaactccccctgggcatggcttttctcacaggtagacccagtgtccactgggtgtttgctttggtgatgagcctgaggttgttctcttggctttggacctccttccagttctaggaatgggtttgcccaggtcagtgtttgtgtgaacgttatttccaggattccaggctgtgcttggctctgctgcctactcctgggacccagaaagatcacatcacaagaatgttcatggaagccttggtttggttctctgtaaaatggctataatcacatctttttgggggcttctacaggaggattaagccttataaattgcaaagaactgtacagttgtcaagtcttagtattatttaataaaaggaactagaaagcaaagatttaagaaaatgttaaaaatcaaaaatgaacgggggtcacattccaatctgggaaaccattctcccacgattccttggaagtcagctatggtcctatcactccccttgaattagaccaaatgacttttctacaaccctgggccctgtacctgaaatgaaacaattggtcctagcaagtcacaacttaaccacagatcaccacattctccatcctaaaggcttggctcagacacaaattctaggcactgagttttcctaaataaggaattcaggaagaaccattgatgaacargacagttaactgtttctgggcttctcttgtgctttcttcttgacagccatgggctccccaaaggaagtcattttctcagacatcactgaaaattcggctactgtcagctggagrgcacccacrgcccaagtggagagcttccgrattacctatgtgcccattacaggaggtaggagactcggaaaggggagagagaggaggagtgttgtgggtttggatggattcatgaaaaagaccctgataattttcatcctctaacatcatgakcaaagaaaatgaattctttatttgtgagaccatctggagagaagagaactcatttgtaaagtgctatgaggttcttagaagaaactttcttgtgaagggtcacttgaacaagaccttttttaaccttgaaattataaaattctatgagaaatagatctctagtattgtttgcacacaatggcaaaagattctaaatatattggcatttctctccctgcgcacactcatctgaaaagctagtcttggatatatgtgaagttttacctttgggtaccaaatctgtctgtctcagcaaatgatggcaagctgtgccttagaaaatttgtgagttctaactcaaagcgcatgggctataatagagaccacaaggaggaagcccagtcaaatctgcctaaagacactctggcaggtagtaagctacctgttgctgaaagtgtataaagagaggatggttaataacctcttcacaggaatgctgttttgtctctataggaagtctgaccagctgatgtgcaagytcttcactagcccccaaattctaagaaatacaatttctgtgtttattaataaacactgcagcacaaacttgactataatcaactttcttttcttaagtagaatttcctctagtaagggagtctataatcctaagccaagacaatgggtgcaatagatctgacatacattacatagtaagcttcccatattgtttgtggggaaaaataataagataaaatttgcacaacgtgccagctctctactgaacggaaacttgccatttttagtacgttgtgacttcatgtttcccccccccctcctggctttgtttttggcatctgcaccaatagaaaaagcatacaaaaagtaagccttcttcccttatgccagagggtaggagcaaatgagaagtcaagaaagtggtgtttgatgaagatatagtttcatttctaaatcagatacactctttttgggggcaacagtgaataagtgtcagtgaggttcattattcctcatcttgsttttactgtgttccaggtacaccctccatggtaactgtggacggaaccaagactcagaccaggctggtgaaactcatacctggcgtggagtaccttgtcagcatcatcrccatgaagggctttgaggaaagtgaacctgtctcagggtcattcaccacaggtgagttggtggggttgtgtgtgtgtgtgtgtgtgtgttactatttttcagaggtcacttgtgcatcctatgccatttctcaccttcagccttgtagctcatgactcagcagctggaaaaaaaggggggttttatttatgagatcctagtggaaagtgaactggatttagagtgccagaggcctctcttctggcccatcccagcctctggtgagctgggtgaccttaaccttgttgggcctccatttcctggactattgtgaaagaaaaagtccaagtttgggagtcatacttacctgaatttaaatccaaattctaccaactacatgagctatcagtccattttactagggtccactttccttctctgtaaaacagacacaattctgcttccctcacagggtatggtaaggatcacatgaagctgtgtttgtaaagcatcctgaaatacaattgttcatgttagcccaccatcaccttcacctccccgcctattgcctggaacccttgtgagtgtccctcaaagcaggtgtttcacatgagcatgtgatggtgacagctacaaaacagctcctctctatttggtggctcttgcattccaggcactgttactaaacccttcacatttaatccccacagctattatcatccccattttacagaggagacaactgagacaaatgaaataccttggccaagcccacataattagtaaatgctggaaccaaatttgaacataggtcggtctgactccaaactctctatccttctaaaataaagagttcctttcctagtgtaacctgatttgtacagtacactgtaaagaggggaaaataatgaattgcattgaaggagaatgaagtggaaaatttctcttcagacagccatgtctcaaaacaatttatcctttgatatgtgagcaattatccagtccaactcattaagggatacaaagaatagacctcataggaaattttaaaaatatcctcatagcctgaaagagttgacaacacacaattaaaatatcccatctgaacccagagtcccgtccaccctgcctcacaggcccttatttccccaaagaaatctttcatcagtggattctccacggcaacagatggcaaaagctgaacgtagttcctcccaatgccccattgtcatcaccagttaaaggagattctgtccatgcacagtgaagcaggaaggaactcagagtggacaatgtgggctccccagttgccctgccacatcctggctctcagaccagtcatttcatccctcaaggctcaggtgcctctctgtgaaatgagctgaggatagcttccctccaccctcgccagggctgctggcatgggcacaattgagtagtaagtgcaaaagcaagaggaaatggtcagattcatgctggcttctgagaaagtgatgttgggtagtaggagaggtcagttaaaagaggccagggataaatatcctttgaatatccatcctttctcagaacaagtcatttgaaaaccatacttaagacttcaaatacctttaatagagatcttaataacaactgcaagtattgagagctttccctagtacatcttacacatcacacattgcttagctagtctttattaactaaacagtcaccctttggcagctgaagaaagtgaagtttggagaagggaaatgaattttcccagggcacagaggcaccaggcagagaagccatggtagaacccgggaccaccggcctccagagcctggctttatgttctctgcaagccatctaaggagaaataccactcaaagctcagaaaaggctcggggccaggtgcggtgactcacgcctgtaatcccagcactttgggaggccaaggaaggtggatcacctgaggtcaggtgttcaagaccagcctagccaacatggtgaaaaaacccatctctactgaaaatacaaaagttagctgggcttggtggtgcacacctgcaatcccagctacttgggaggctgaggcaggatcattgcttgaacccgggaggcagaggttgcagtgagctgagatcgtgccactgcactccagcatgggcgacagagtgacagtctgtctcaaaaaaaagaaaagaaaaaagcaaagaaaagaaaagagaaaagaaaagaaaaggctcgggcagtcttaactatgcaagtcccctctgtgtaagttctttctctggggaaagtaatataaacaataataattcttgtcatgtgttcagccttgttcagtttacacagctcctttccacccataatataatggaaaaatcaaaataacactgaagatgaaaccagccagaattactatccctattttacacatgaggatatagaggcccaaagtaactgagccagcaagggagggagtcattactcaaagccaggtcaggctggctccaggcttaggtctctgaaccattccatgcagctgacactgtcctaacatcaggactccataagcagtgtggacagcagagcagctagagtctgatgtcccacccaatgacttccctcctgtccaccatctttctttgcagctctggatggcccatctggcctggtgacagccaacatcactgactcagaagccttggccaggtggcagccagccattgccactgtggacagttatgtcatctcctacacaggcgagaaaggtaaggttttgtccaagtctctcctcactctaaggagtgtctttcctgctgtaaactcttcccattcgctcttctccctgccacatttggtacaggatgataaaaatgcatgggtaggttgaaaaggccagtaatgttcatgtggctcccaactgaaacctcaagggagtctggtaggtcatttaaaataaaaataaaaatacatctccagcctctacatgttttcctggcccattcctcctctcctgttagtatctctgcctaccagtgtgagacaccccgtttaggaaacagttgtcatcttttacaaagaagaaaaccagaatctaaaatcttaaccagaccgcttcaggccatactgagcagtctcaacttttcagagaccacaaaagaagctagttttagcagatttaattaaaaagtctgaaattttaagccaggtacagtggcttacatctgtaatccagcactttgggaggccaaggcaggtggatcacttgagaccaggagtttgagaccagcctggccaacatggtgaaacctcgtctcttctaaaaatacaaaaattagctgggcatagtggtgcatgcctgtagtcccagctactcggcaggctgaggcaggagagctgcttgaacctgggaggcggaggctgcagtgagccgagatcgcaccactgcactccagcctgggtgagagagggaggctctgtctcaaaaaaataaaaataaaaaataaataaataaataaaacagaaatgttttcttgtttggcaaccatcagtgctaatgtacccagttgacagattaaacacttgtttagagcaccagcaaactacagctgccagaaagtaaaatcaaatataagtaagagactggagaaagagagagtgcttttcaatgaacccctccattttgtaatgagctactctagaaataattgtgtaatttcaatttccaggtataggtaagtttcatattttatggtttggtattgttttgctctcagtgacaatatgagcaggcaccagcgtctgtgcctggagcctctgaaaattttcattcagttatggtaaccaactaagagaggtctttttgaggacagagcacaggtaggggtggggaactgatggggaggagggatgttgggtttattctttttactctttaattcttaaatagtccctgtgagcaaactcttctgagtcaggaaagatggtgttgcacctaaaatgaatcaggtatagttcatgggaaccatggagattgtagattcagggcaaacaaggggcttggttcagaagagggggtggtgctcacaaatgatgaggtaagttgaccaacttgtccccgcttgcctggtactgtctcagttttagcaccagaagttccacacctaggaaatcccgcagtccctggcaaaccaggrtggttggtcacctgtgaataggaaataaacacatgcccccaagcaatgtgatcagtattgctttccaccactggacatgacccagcaggcctgagagatagtggccaggctctggtgcagctactgctgtccagtttttgtgacccctcagcctaatgacttgatgacacttagtaaattataaaagggcatgtgaaaaagtgacaaagagaggagagcatgcatcaggacaaattaagcatgggcagcaggcttggggatgtcccctccgaccrtcctctacctcggtctcagtggcaaagcgattccagccagtaccatgtgggaaaaaaatctcctgacccccagttccccttccttctgatttggggcctggaaaaattaagtctccatatgagaaatcctttacgtatgaggtgagtgctcaagagagagaaagagagcgtgagtcatttcagaaatcagacctgcttttccgcagggtcactgaaagtttcgatgttcgaaggaggtgtgtatgtggtttgccaagcccactcatggctcagacagtgagaggtgactgccttggtatgtgtatttcatgtttagtgccagaaattacacgcacggtgtccgggaacacagtggagtatgctctgaccgacctcgagcctgccacggaatacacactgagaatctttgcagagaaagggccccagaagagctcaaccatcactgccaagttcacaacaggtacaaagacactgagagctggaagctctcccttctggggtgcccacccacagcctgcatcttaaacaggaaccgctagccagttcttctttcttaagtcagggccttgcaatgtgattacatcagcatcacttaaattcaccagtgcccactcagtcaaggcctgaagaaacacactatttccttttgaactgaaatgaccttggtctccccacggggaaggaaaagattttaagaggagggctttgtaagtggaaaaacagttcccactggccctaaacctagtatttaatgatccacgttccaggcaggaaaatatttttgaagaggcatattttttaggcaatttttcctagatgtttgttaggtttctatacattgagagctttttacaaactatagcaagcagggaaacagaggaaccatcctctctgtcagggtgagtattgatattagcattcatccatcctcttacttagaaacaaggggcttgataatgatgttcacagctgtatacttctctctaaatccaaccaaggccagttagaaacatccagcccttaggatgagataaaccatagagaatttgtctttggagatcatctggctcaaccaccttatttatacagaggaagttcttgccaaaggtcacgtagttcagtggtagggaaaggacttgaacccagtcttcttgatacccagcccgaatwtctgccctacatttgctgatcttatccgatattaatcatcctgtcttctccagacctcgattctccaagrgacttgactgctactgaggttcagtcggaaactgccctccttacctggcgacccccccgggcatcagtcacmggttacctgctggtctatgaatcagtggatggcacagtcaaggtattttaagtatataacaactcctcaatgctagttgaagcatttgcatgatcttcaaagtatggaagaattacctgatgctgtttttytaccccagtgcatctggggagctgaaaaaaaaaaattagtagagactggatggcatgccagaccttctgaatcatactctccagcctctttcattttaaccagactccagttctgataggcagccaagatcaagaaccactgcttacaagacttgaggacattttaggagctggaatcttgatcctttaatattttgttgaacaaaggccaaaaggtttctctgcatgtttgccatatgtattatctcacagatggtatctttatattatatattgtaatatgtttcaccgtgttcttatgatatcaactgttaataccatttttatccagtgtttatattatttatattcgctacccaagaattttctttcttttaccttttaatttgaaataactttagatcttcaracaagcgaaggagatttcctaaactttaccttccaaacttgttattgaatttttcattttggttatctcactttatatttccaagatcttttgcttgttctccacacattgatctttttctggcattttgtttgtgcttcctatatcatcatctctttatctctaagaatatgttgctggtattttattctatatcctgcacagtgtttgttacaagtttctttgttttgctgctgttgttgagtttggtttggtttgggtttctgtctttcatgttggagacatccacccaatgtctgttgatcatggtctgtctttttgtatttgaactaggaatgaaagagctaatagggagttagctcaggcagggcttgtcaactttgtggctccctgcagaatgattgggcaagtacccacagttttcttgggggacccccaaataacagtgccataaaacctggcctctcactgtgtacaaactttcatcttattatgtttccagtgtagcacctcggcctccttgaaggctgagcctggtggatttgaatccggacttcctctctggctcaacctttccagagagtaaacctcagcctaccatctgaatgggaaagggcagtcatttagactgttggagggaatgaggagatcttagagtctgtttcttacaaaaaagcttctaaacaaaccaaacctttgttcaaccacactccacattggcctttaaagacatctctgcttttgtacacattcctttactgaacttgctggactctgtgacttgcaccaagcagcctctgactagctctgcccatgctccttagttaacctcagccttcttcattcattcccctccatggtctctctaccactcactttctatctaccaagtttctggcacacctgttgctgtctcctctcccattcccctcatcttcatggatttataccttacattctcttgctctctttttagtgggttttagaagcaagtagagatgagtggctgtatccaatctgtcatatttaaccagaactggacacattgctaataactatcatgccccttcctggaattgatataacaatgaactatctcactgtgtgagctgaagcaaatcctttatcttctctgggtgtcagtgttcccatctgtaaaatgaatgccttggacttatccatctttaaggtcttctccttgtcaggcattctaggattctgtgtttacctgaatcatgagtctcattttgatctagagtaccctaattgcctagaaaatggctttgcacagaagcctagagaactgacaggtaattgtattcctaagtaattcaatgaacccagctttatccctgacagttgatctttcccccagggactagaactggggggctgcaaaaaggcctctgggtattaaatgagcactcatcccagtttacttttctgcatgtccattcaccagctttacatgtcttagaaaaaaaatcaacctggtataggagaaaagagtcctggacagggtgttgggaaacccgcatgcaagatcatcctctgcctccaacaatttatggaatgagagcaagtcttttagcttctctgaaactcaattctcccattgaagaaaacaggataaggtaccttcccagttcccaggatgcaggagaaccttccaggggcttctgcactgatgcatgactkcccaaactaagctggctgtttgcaggttgtagagaagatcgttgtgcttggtttactaggagtgtaggttgaattccaatcccagacactaaggtcatttgctgaaaagaattggaagctagcaagagggtgtggaaagaggatttcctgcaaactgaaaccaatgacctcctctgtacagcagcacagagaccagccacagactacaagtgtagttagagttggtcaacatctgtctgtcatggatatctctgttctagaagagagacatgtgaggtcagcttaagttttaatcctaccatgcctatggggctattataatcatctcctaactcaagagatccccaaactgactgcacattcaaatcacttgggaagtttcttaaatatagccaggcccaacttctggctctgatgattccatcagtctgagatgaggcccaggcatcatattgttttaaagcttctgagagtgataaagagctatatttagggaccactgacctaactgacctcaaagtcccttaccctgtgtgattcatcttgctaccagattaagcttcttaaagcacagcttggtttatgtcattggcatgtccaaacatctttcaaggctccccatttcttgtgatgataaacttcaagttccaaagcttagcatttataccttacagggctcctcactccgtttaatgataaactttaagtttcaaagcttgtcatttaaaggcccttcataatctagtaacattttccactgttctaacacctgaagctaagtatggttgaggtcgcttattgcctccttatattatttcattttatgttttaaatctgctttattcaaagtttactgatttaaatattaatctcatccaaaaaaaaacccccttcacagaaacatagaataatatttgaccaaatatctgggccccatggctcagccaatttaacacataaaattaaccattacaatcccattctcccaatatagtttggcagggccttgggcaggtggtagccttagccctggagtctacagcagtgctctcatccttaccagatgcggtctctccctccttatattattttaacttgctctgcaccttctggcccaaggacctttgcttgtgytgtactctccccatctctgatatctcagcagtgcacatggagcctggtagagagtgggtactcaatgaattcttgtccagtaagtaagtgaatggatgggtaaatgaacttataaatagaatgacttcttatctataccctgagaatttctgtgaccaaaagccattatactttttcttctgctcttaggaagtcattgtgggtccagataccacctcctacagcctggcagacctgagcccatccacccactacacagccaagatccaggcactcaatgggcccctgaggagcaatatgatccagaccatcttcaccacaagtaaggaggcccagggtgccatccagccttgagatctaactttgactgaatcaacccttgacttcccctttgacttctactttaaaattttcaaacaaacctctgaaaagaatcgattcactgctactacttggaagcctgaggaaagcaaatgtgggagattatgagcatcccggtgaaaggaaaggaggaagcccatctggattcagtccccatttctatcacctgctaggtgtgccttaagaatgctacttccatcctataatctttagcttcttcgtctatacagggagattaataataaatcctctgtcaccaggaccttgcaagtgttcatgaggtattgcatttgaactcctagcccagtatgtggcccatataattgtgtggtccttttattgtcagagttcaacatgagctgaaagtctctttctttctccttcatcatgccagtgtttacaaaacctgtccacattcaaaatcacaaatgatcttcccaccaagctggtatggtgagccctatgcccaaagttctagtggggaagcagacactttcagagactaaatgacctgttcaagactatcttgtgagttacagtcagagttgggctcagatattccatgcccagggagcctccccctgcacctgtcacaaagtatcttctgcagatagcaaacctgcaagttgttccattgataagtaagagtggcatccattcctgaggaccagaggagctggcctttggagagccctgcctttgaaaattcacgggacagtcattctgcacacatctgctgaagaaagtgcttcccctttgccagatcttatgccagatgctaactatgaatgtatcctaaagatgctcttatactagggctgtgaaataaataagaaaacagctcatgatacaacctcagatgaatgtcctcagatcagaaaaaagaactgctatgatcatcagctctaagacccatctactaggcatagttccaagattgcccatttctatgagtttttaattgtttgcatcacattattgcacctggaaattccccaggcattctagtccatagagttaagctaagaattaagctccagctcagtcctcctgcactgagagcatcaccatttctccttattccacagttggactcctgtaccccttccccaaggactgctcccaagcaatgctgaatggagacacgacctctggcctctacaccatttatctraatggtgataaggctsaggcgctggaagtcttctgtgacatgacctctgatgggggtggatggattgtgagtaccaccagggactgcagagccctcaggcctaggggaagagggagagggcaaagcaggggaggagaagagggtgatctcctcctratgcactctgacacccmcatgtgtgaggccttgcaagatagtgcctgtcacacagaggcactcaggaattctctcttaaacaaaagaatgggaaacacgctggctactttttgaaacggggagataagtttcttgtagtttatctcatccaatcctcatcaaacaactstgtgatgtataaatgacagttgatcattgaacccattgcttacattaattagcactgactaagcatttattatctaccaggcactgtgctaagagtttaagatgaattattccgaccccattaccataggagctgggtagtgtatttttgaattaataaactctatttttttagaacagttttaggttcatggcacaattaagtgaacagaagttttcatatacaccccacacccacccacacaacctccccattatcaatatcctgcaccagaatggtgcatttgttacaatcaatgaacctacattgacacatcattatcacccaaaactgggtggtatttttaatccctgtttttcaggtgagaacaccaagacttaaggaggggcaggtgaccacccaaagttacatagcaaattagggatggacagaatggagcctgatgctctctccacagtgccacactccttcctctcacaacgatgccctctttcctgcaatagcttaagtacacccagattcatcgatatgtttataggtgttcctgagacgcaaaaacggacgygagaacttctaccaaaactggaaggcatatgctgctggatttggggaccgcagagaagaattctggcttggtaatgcagccctgcatgtttrtatctaaaatgcctgattctgccctccttgtcacttttcctaacccacagggacctatgggagagaaagagatgaggaagaagaactacttctggtggcagacacagaatgtcaaattcttaatgaaaaagactatcatttaaatgctctgaatcatcaaaatgtaaaccaaaaagtatctgagacagatctcaatcaatttagaggtttacttagccaacgttaaggacacgcccagaaaaaaagaacacaaagccacaggaacagcctgtggtccatgccttttttttttttttttttttccagagataatattaagagttttagtgtttaaagggggaaagccacaggaacaacctgtggtccatgactttctttttttttttttttttttttttttttttcagagataatgttgagagctttagtatttaaaggggaaaagtgggctggagggatatggtcacattactgaatccacatgttgcaagataaaaaaaagaaaaaagcagaatgacaaaaaagagaatggtcaattttgtattcatctcacactcagtaaatcggcactttacataagataaagtgaagatagaataactatctgtggagatatctggccttttatctgtagcatctgcttagggacaaaaggagaggcagtttctcccatgactcggctktcagtttattttttttcctattggcagagttaaattggggtcccaagattttattttcctttcacaaaaagtaaaatctgattaaggaagaaccaaaactcagcccttatgtgttaacctagccttaagtcattctctggaccagtcatagaatcctcctcactgatatcattgatatcttccctcctgtgccccaggttgtgctccaggtgctaagatgggtttcttagagccataatatttaacccccatagcacccctacaaagtactcaattgccaccgggtgggcaaggtgtcaggtgtcagaagtggttgactagtgggttggtaagacgaatttactaacaacagtataggtttgaaaaaggaacgtttattagaaagaaagaatgctgcaaaaggacttacagcccctgcagtggatttttccttaggggtatttatggaccttaaggcaggagcttaaggataatttggaccctattagccatgtagaacatgatacrtgattacatttgtagacattttggtgccttaatgtcagcaagggttgcaaaatgagttttgatatgcatgtattccagagatgtatagaagttccagttacctataaatttttgggaaataaacctggaaccagatgcttgcttgagatatacggaagcctaattacctttaaatccctcagttaaggggtttttgtctccgagtcctacttgatggtcaccaggtgatttttgctctcctcaccacctcgcatggataaaatcacagcctcaaaaagactgagtggtttgcccataggagtctaaccaatgaacagttgagctgaaatttggaatctcctaagtcaacactacaatcctatcacccatccattcatccatgcaatccacactttccaaccacctaactgcagagaacattgttctatgcaccactgcctaccccagaaaatgtttatcatattataataaacatttatctatattattcattgcccttcatttgtaaggcactttacaaaattttatttgtttgtttgtttgtttgtttagacagagtttcactctgtcgccgaggctggaatgcagtggtgtgatctcagctcactgcaacctctgcctcctgggttcaagcaattcgcctgcctcagccccccaggtagcygagattacaggcaccctccaccatgccctcctaatttttgtatattcagtagagacagggtttcaccatgttggccaggctggtctcgaactcctgacctcagatgatccgcccaccttggcctcccaaagtgtggggattatgggcgtgagccvccgtgcctggcctgtaaggcactttagagtttaaaaagtactttcaccaccttatctccttggatcttcactaatgcactgggaggttggaagtggggcaaaaatgtcaacccgattttacctgagcctagtattactccagcaagcacaagactgagcttcaagcacaggcctgtgtgatatggcccttttttttttttctttttgctttctgagatggagtcttgctctgtcacccaggctggaatgcagtggcacaatctcagctctctgcaacttctgcctctcgggttcaagcgattctcctgcctcagcctcccaagtagctgggactacaggcacccaccaccacacccagctaatttttgtatttttagtagagacagggtttcgccatgttggccaggctgataacgaactcctgacctcaagtgattcccaccacccccacccccaccccctcccaccccatctctgcctcccaaagtgctgagattacaggcatgagccactgggcccagttggccctgtcttaagtgtacccagttgccgcttttacagagtgaaatagaaatgagggcctcagtcacctgtgcttcttagcaacccttgcctgtcatccacagggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtacagtagtggctgcacgtagagcctacaaagccatggagaccttcttgacatttacagtttatttctctaactttcattccttcctcattaatccagcaatttattaaatcaacaaatatttaagtacctactgagtgccaatccagaaaaactayaattcaaaagtgttgggtagatatttgggtcctgaaacattgagtatgttgggaatcagggcaatcaggattgatttctaatgaccatctttcaaaaaaagtgtgtctttcttacccagttttagatatcagttgtagactgattaaaaaaaaaattccccaaaggccttaatattcatccaatccagcacttctcaatttactctgggtgtatggacccactggcgatcttgtgaatctccagatgctgacacaggttgtctgggatggggctgagattctgcatcttctccaagttccctggtgatgccaatatagctggtgttgctggtctgtggaccacagcttgagtagcaaaccatccactccatcacctagctgcttgaatctcttccaagacatccctgccatgtggtcatctagtctcagcctgcatcctcataaatagaaggtctcacctctcaagtggcccctgcattccttgtctggctcataaccttcattccagtcttgaagatttcttggacttgaagtggttttgtgtggtttcctggctccacataagaggagaaataaataaggaaacaacatgtattaaggccctactaggtaccatcctcttttgtagatattccacctgcattcatcttatttattcctcataaaaccattttatgaagacgttgtttttatacagaggaggaaagaagttcagaagagctcagtgatttgtccaaggtaaaacagcttgtagaaggtggatgcaatcctggctgcagaaaactgcatccgacaatgttctcggtgacaaagaagggtcaggactgagagtgtggaccacccccatgcaacccatgcccactttgggtggctttctgttatgtttgtgagagcagaagagatagaagcttggcacgtttccagcctccctgagccctgaaagaaaacatccataaggtgaaaagtctccagataaaaggttgccaaagccaggctgagcctaaggaggcacaaagctcttttgagatggcagtttagtgataataaagagagacacccaggggcaaacattgctttagttcttgaatccctcaaagaatgttggcattttattacctggaaatgaatacctctttggttgagatggcttcaggcaagaagaagaatgttacagggcaagcaaattcattaagcagcaggaatgtggcctctgttcctctctctttgtgcttccattgaggaatgagccataatatttccctttactgagataacgtttgtaaggctgcattttcttgtgtgatttggctgcacccaggccttctgcaggagagcatcctgtttcattaatatctacgtgccgtcctcatgctctgggtagcatcatcagttaaaaaggtatctgggttcctttgacaacttgctccaaattatgacggtagaatgcctcagagtcttgaaatgtttgtgcacagcacttgkctggattgggagtgaggagacccacaaagcaatggtactgaaatgcttcaaaaattcaatatattaaattacaaattagatttccaaatagtagtacatgttaatgggcttcttgtctaagaatcacggaacatggtctgatgaatactttaaaaagtaactatgtgatacagagactatttagggacatctaatgtctgaagggcttaattatgactaataaatatttgtatgtgggagaaaagcatgccattattaaatgcatacttctcaccttactctctgaggtctttatagaaagggaatgcagaaaagtcataaaaataacaatcatagtaagtatttgtatgccatgccacctgtttagcatacacctttattgtcacaatggcactactcagtatatagaatcaaagtgctggttccattgtatagatgagaaaactgaggttcaacaagatgcttgacttgtgcaaggtcacagctaaaaagtgaaaagatgggattcgaagctagactctccaaagccagccacagccctcttcccaccacattatgctgcttctgtcggaaataagtactggggtgacactcatgtcccattcagttccgcattcaatgctgactctgggatcaatgttcaaggccagtcccacacccagaayctttcaattgtcacctctggttctgccctttactgtccaggagggaaatttcagctgagatttctcaggtccatattttctgtctctcccaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcaggtgagtggaccgtgagggcccagagcaggccaagcttgggaagctggagggggctaatggaagtacaatttaactccctatcctagcagagactaggaggcaggaaccttacttgtatgacaacatgtttttcccraggcagtgagcaatctcaaggacactgcaggccaggtaaaatagaaacagcacaggttaacccttgacagtcccaaggacaaacactggtcaaatggattccaaaaacagaacgctttactcagacaaaatctctgtctgaaccccaaaagtaaagcagataaaagtggaggccatttaggtgaagcagggttgatgacacagaacccctggcctggggcatctttggaatcccaagaacaccttaaaatgaagtccacagactttaaatctcctccttttgtgaagaaaccaaggcccagaaaaagctgactttcctgaggtcacagagtgaagttggcagcagagccagctctccccacttccagcccctggcattttccctgcaccacacacacctctagcacttctacaatcacagaaacagatttttttcgatcccttttagaaataggcgaacggatcaaattcagtaatctcccttactctgagccttgcctacactggcacattcctgaaaagtgtaaagctgtgtgggactagccacttaatcataaccaaacccctgcccaggtccctccacagaagttagtcaccatccctgggaggagggctggatcttcccttggggccacaccacgctgatccctggaccacaaggatgcttatgaggtctgctcactggaatcccaaggactttataaaaatgcaaagggccaaattccactttatgataaccccagggattctgattcaatgatctcaggcaagacacagcatctcatttttttttttttttttgcatatttgcatttttgttgttgtggggtcaggggggaggcagttgatagactccacaagcgattcctgacatgcagcaggtgttgggacctgttgcttttcaatattagtcactttgatacacatgtttatgccctaattaactgctagcaaatgacacctgcgaccttaagtgtagaccttaccttacataatttctggcacttttcaaagcactgttaccttctgtatctcaagggtttatcatttttaccctgtgcaggaattaagatgtggtttttcatgcctgttttacagaggaggcaagagtcacaggacatttcttgacagcagtcctgtgttgtttccatcttattgtgttatttcatcaatatttccattctgagcattattttatcatctttattgccttgtctcaaaaatactcgtataatacaaagttcttctgggaaaagaaaaaaaaaaccaacaagctacatgttagaaagcaagcctctctttcatccttccattcaattatggaagaagaaagagatgacatggaaaggagccacaggaggggagccccagctccagctctgctcctcctgctgtgtggcctctgcaaagtcactctccctctctggctttagtgcccaccacagtacaagaaggcgtggcttccaaccctgaactatcagaggaaagaaccagggcaaaggcaggcagcatgtgcaccaagctgttggactaccatactcactgtaactgagtaattacaagcggatttgcccatgaaatgaatgagccattcttaaacctcacatccctgtaagactcagaaactgcccatgtcagtgaatgccaaacaattagaagcaaataaagtgtctctatttttttcccatctcactagccattracttccccacagtggggcaaggggccatgtggggtttcatggattgactctaccatctgcagacttcgctgaagagtcaaagttgaaacctggaagccaagacacagatacagttttttcttgtagaaagctttggccaaaatttcaaggatatttccccctacttgagactagggaagtaatatttaccaagcacctacgacgtgcccagctctgtgatagctcctttacaaactcatttaatcttcatctcatctttcaaggctaacattatcagatcttaagaaagaaaaaaaaatagtaaaaccgaggctcagaagatattgagaacttaagactatttatctctcaagtaagaacactgatatttaaccctatatgtcaaattgtaaaactgtgttttgttgagctgttcgttctgctattccatamcaaacccctatcaaaatactccataggaatctcgtgaattacagacacacacacacacaccatgtatgtagctattcaattctagaacttctaataatgacctgaactccttcagaacctattcctaaggacggcagatttcatcagccaccattttgcctcaagaggaaagaccaaagctccatgcaaactcaggcgactcttgactcaggtgaaaaactgggtcagattcagccagttcctttgaaagtttccacaacccagaccaayagagagataggcaagaggcagctgtgatataccaaatggtcaaattgaaacagaactcatttagtttgaatgactaaatagcaatgatcagtgaacacctcgcctaacagtaaccaacctggaggccttctctctctctctctctctctctttttttttttaacagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaacccaggtcttctggctccaatgttcctgctctttcccggtcccttaatgaaaatctctccttctttggggaaatgtgtgctgtggcaagagagtgaaggttgcagaatgggatatgggggcagttcaactggatgcttcctcaggcttctacaatcctgaactctgaaaactaggaagaatgtctattaggaatatcgccttctcctctacactgcagtccccaaaaagggagcaagcccatattcctccagcctcagactgaacacatctagtgatggggaacccattgcctggatggcaggtctgttagtcctcagcaaatatagtgagtcagaactgctcaacgcataacatttctctttttaaacaagggtatatggggggagagtaattcccagttcattctcttagggattttcagaaaattgacttatttaataaaataagtcaagtttgggctgataggcctcattcaaatggaatgtgatggctctggagcaaggatcagaggaatttatggttccagccatatcctttgttgctgagtttatcttgctttaataaatgctgtcatgttagatacacaatgtgctgttccagatcataagaacggttgcatgcaattcagccatagcaacgctctcctggctatataaatccaaacaaacgggctccctgtagcaaccaggcctcgagttggaggcttacctctccactggctgctgacttgtgagtctctaaacccaagtcctatctcctctccagaactgtagatgtacttaattaagcttgaaggtattccccacaagccacacaagaatcaaatttggattggtgaagaagccacatcaaacaggagtcagtaataacccaaatggggacagggcaggcaaccgggtctgaggccatggcattcaaagaccacagtctctagtgtgagctaatcatttctcaaacgtgtccttcagcctctggctctgtggcttgtttcaggaaacctcttccatcttgaaagttctcttaaaattccacttcaccctcaagacctgggccctacccctgcccccatgaaacagtcaaaatatctctattgggaagtaatttccagggtgttcgaccttccctttgttccttctctcatctgctccccttctccctgctctgtgtacttcaaggccaccctattttcattgcatcaatgactcccagcttccaggtggatgtcaaaatgggaaaagccagcaggacattgaagggaagagactatgagtgggggtgggtcagggcacttgttgcccagctccatctatacagcatcacagtgggctgtcagcatccacataagagagccgtagccactgtcaactgactgtctccatgcaactctctcttcaggtttagaaaagtgctctctcacttgccccttctagcctaggagcagtcatggcaccctagctgctgctagacttggggacctgtgctaggctctgtggctctcctccaccccctctcctttaactctcctcagggaccccggcaggctcgcccacccctgggagcactgagtgccactgttacagctgcctgctggccttatccattatgatttctacttcctgcccctcttcctatagtgattattggtcatttaatggcttcccagcatccaaagtcctttccagttttaggaaatttgagaaccttgcctcctaccaaggaagccacagaggaaaatactctttcctcctccccttgatagccagggcatgggcacgtaacttgggctttgccaattagatgcccacagagggacttctaacctttagcaatgaatgcaaaacatagagtgtaggagactggctcccccacagaatctagcactgaggccatctatccgtgggatctgtggcccagcaccacgcagggtatagccatatctctctctaatggtgacagttgtttccagcagtgacaaaggcagactggctgatgattcctgctacctggcctcctttggttcctgataattttctgtgcctgcttcttcaaactttctgtcagttttatgagcttcctgatatccttccagaaaattccttttctgcttaggtagtcctagattatttcaggtccttgaagccagataccttggctaatactttcctccctaaaccatgagcctgtgacatttattgaccctcttgtagtcccagcactgtgtttgacactttaaatatccaaagtatcctaagcatcatagtcacctgtgagacaaatcgaactattccatgtcatgtagaaaactaggcctcagaggggtcaggtggcttctcgcagccatgccactggggtcagaccaagattcacagccaggctgcctgattccaaaatccaagttcttttcagtgaagatatcttattcctttcaacaagccacactaactggaaaacagaacttcattcttttcacaaatgcttgtggagcacctcccgtgtggatttgtcagtgaaaaaaagaggaaaatatccctgtggtcatagcgtttatattctaacaaaacacaatgaatgatgaatgtaataaatgatcaaattaaatggtatattcaagggtaataaggacaaaggggactagggtaaggggatagggtcacagtattcaaagtagggtggtcacacagggtgggcctgtgagaaaccctcaggaggcacagaagatgagctcaatgaatatttgttgcattgaattcgtgctcatctctttccttctgaagatggggaagcagcagtccagaggaggctggggatcatcccaggcaccacagcaaccaggcaggagattctgatgaaaatccaggctgcatactcctctgcagtgtggcatgactgtctgttctccagaaggagagacacaccttgcaggttcttcctcactgagcctcctatgacctgtatgctctcaaaacagctggctacacagcccagtccttccccattctcagcttgccccacccaagctggtcttcccaccatgccttgcctaagcccggaaaatccgagagctccttgtgggctgtcctcgtcggtctccttctaagattctcacttctcttttcatttaaaaatcagtgttgagcacctccccgcttatgctcagcactatgtgagtgaaacaaccacattccctgcctccatgcagcctctgtgccccagagaggtcagtgacaaacacatgatcagacaagcaaatgtgtgattacaaactgagggctgtgctttggaagcaaatataaaaagctatgaagacgtctaaaggggatctgagggggaaggctctctgaggaacagacatttgaacccagatccaaagagcaagtaggagttaaccaggtgaaggaagcaggagaggcagaaggcaaaaggcaggtatctctatagtcctatggctgtcacgctgtgcacagagaaagccagaggcataggtgcaaaagatgcattgtggaagatgaggtttcaggagtcagtaggaacccagccacgcagatcttcctggtccagaataaaaattttgctttttttcttcagttcaatggaaagcaactgagaagttttcagcaggagagcattgtgatcacatctgtttttttaagccatcttttttgttgcatttggattttggctgggaggtgcaaagtgggaagagacctttgaggaggctactgtaggaatccaggtgaaaggtgatagagcctggctaagtgtggtgtcgtggagacagagctatggttctaagagatatttagaaagtaaaattcatggggcttagggtcccagagagctctctatgtccccacccttgttcctgagcagccctcaactcctatagtggatttttcctggatgtgggcatcagttttaattaaggcaggctagttagggatatgggagactggattcaggggcccattaactcctggagcactaggttagggtggggaaggaatcaggaagcctccctcaaggtgactgcagctagaaatgaagaccagtggtaaggccaaggggaggcttgtggatggacacaagggatgacagtgtggggagcagaggtgaggatggaggtagacccttgccttgaaggcttggcgtcctggagcccagctgagagttgccaagggttttcagccccagatggcatcatcaacattgctctttagaaagcctgcttcctcactagagatgcatgtgcccctggccacctgtgccccccagcctcaatggggtaccaggggtgccctgcatgtgcctgctgcccaggtttgggctggcaggacatataagcaaccagcagagggctcactcccctcatcctcctccctccctagggaactcccagaggaattacaatctctgtaaaggaagtagaaaaaggctttcttgagaattgtttcaatcccaccaggatgtaacatggatttcaacattttacaggaaaataaaaccacacacatgcagtcaaaataagcagctccgactgggcgcagtacctcacgcctgtaatcccagcactttgggaggctggggtgggcggatcatttgaggtcaggagttcgagaccagtctggccaacatggtgaaaccccatctctactaaaaatacaaaaattagctgggcatggtggcgcatgcctgtaatcccagctactcaggagggtgaggcaggagaatcgcttgaacccaagaggcagaggttgcagtgagccgagatagcaccactgcactccaacctgggcaacagaacgagactctgtcaagaaaaaaaaaaaaaaaaaacagctcccacatttgcctagcacatttgcccagcacatttgcaattacaggttaagaaattgtttctcagagtagtgaaatgacttcccccaagttcactcagcctccaagtgtcaaagctgggttctctgactccttgagtcacaatgccttaaggaacatccttctgcacaattattctttcattcactcttccaattaggacacttggagcacctgccatttactggttccctcataacactttacagtttgcaaagccaacgtgtttataacaatttctttacagtcaccatctttttagtgagagctgagctcaaatcccatgttttccaattactggatcatcttggtctaattgcttaattcttctgagcatccatcaaaatgatcatgaagtgtacctaccctgatgagaatctgtgatagtttaaaagagaaaaccgacagcatcttgcctggagaaaatgctgtcaacacaggtttgtctcactaaaaattgaaaggcaaa

SEQ ID NO: 10720 - DNA, 24974 bp, Homo sapiens
  misc_feature (1)...(24974): n = A,T,C or G, or insertion/deletion polymorphism (see Tables 1-2)
cccaacaggcacagggggctatgagtggcctggaggggggcagcatctcggtgcctatcttgtggccaacttccaccgtgcattctcatgccaggcctagcccgtcccccagggagtccccttgttcttctcctgccatactcccagctgctccatcctgacctccagcccatatccccctgcccagcagagggaggctccagatcactgggagttacttgtgtctgtgactgggtggaggagctgggcaggggggcctttcccttttgtatcctctaacaaagacttcttcctccagggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtgagtgcctgggctacaggaagacaccagcaggcagggcaaggcctggaggaccccagggcccagccatgcttattaaccctgccgtggctcctggtgtagggatgaacagaggaagttggaatattcctgggtcttacactggactcaggctttgggcctccctggccccatctttcctccattggagcttccttcctgctagtgagataggcctacaggcttggggtgaagctgggaggtgggggcggtactgggccaggaggggcccctttagcctgagagctcttgcttcttacgctggtctgggaacctcttctgtaactccttagctgttgggattctgcctttcccctcccaggaagtgagggaggaaggggtcctcccaacagtcttttatatctctccccacccttcccctcccaggtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaargcaygtgctgcaacactgaagacagaaagaagaagcctctggacactgccagagatgggggttgagcctctggcctaatttcccccctygcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacnggagaggtcactgggcctgttttctccctcctgaccctgcatctcccacccygtgtatcatagggaactttcaccttaaaatctttctaagcaaagtgtgaataggatttttactccctttgtacagtattctgagaaacgcaaataaaagggcaacatgtttctgtttccctgtgtctggccttcgcttcctggaaggctgaggggagggggcaggggtgtgggcagcggctcccgctgaggtgctggtggggcatcagtgcagctctgacggtggcaggaggggcgctgggactgctgggctttctgctggcttcagcagggaaatcccccaagggggctgtgagggaactggcggcggcagcggtagtcagagagcaaaattctctgtgcttttgcctggctgttctccgacaggtcttgcgccttggccccagaggctggggtgacctgtgccatggccaaggagggggacactccagcaatggtttacacgtggagccagggtcccaagtggtgctcagtccttcccagtgaatccccagcccttctccagtttctcacttctctccccaaggcctttccccagtcacctctcccttgggagcgctgcgtttccttctggcctttcagtggaggggacttttcatacttcctcctcccaccataagcctgagtggcaggggaagaggttctggggactttctgaggccaacatggctaggagagagaggagtcctatagcaaggaatccttatctcacgagggcactgaccttccagcgtgttctggggagtatcagctgctattcccaggagaggcacaaagtcccaggtagaagggaggagctgtccccagcagcctggggtctctagccccggtccaccatcacagcacccttggagtgagtgtcagggagtgtgggatatttgcccaagtccagccaccacccctgtccgagtagagcccacacagtattggaaagagaaatatagccactgctttcactcctgggagtaggggtgccctggttgctttcaccagcctgcaagagtatagtcagggtgaggtgctggagaacatcaacaacgatctgggttcaaatcccagctttgccacttattagccatgttgctgtgtcaacttctctgagcttcagtttattccactgttgtgtaaagataatgcctcttagggctgttgtgagcattagcacagtgcctggcatatagtaaatactcaatatatggtagccatattattataattgtaattgttactaccaccactgtcgtctatttatttatttatttatttatttttttgcgactgagtcttgctctgttgcccaggctggagtgcagtggcaccatcttggctcactgcaacctccgcctcccaggttcaagcaattctcatgcctcagcctcctgagtagctgggattacaggtgtgtgccaaaacatctggctaattttttttttttttttttttttggtagagacggggtttcgccatgttggccaggctggtcttgaactcctggcctcaagtgatctgcctgcttcggcctctgaaagtgttgggattacaggcatgaaccaccacgcctggcctgtcatcccttcaaatgttctttcagaactgaggcatgcagaggctggaagacaggctgggctcaccggggtggttatctctgagagaggacatgggtgaggtcagaggcctctccctggagaaggaggtaggtggagaagccagatggcatccagataaggaagaccagcatctccttgagagtgtacacgggagcacgagatggggagggaggctgagtgctccttacaggcccaccctgttgcctccaggtgttagctgctgttgtcctgggtcttcagtgttgaccgtcgcatggcatttgggcagctggttctgctgggttatggtcctcatgtccctggcacagacacagccattgcctgctggcacttgatacctactcatattccatttctctattccaaacacactggattgcatggcccagggcgccacggtgtgcaccattgtctggcccacactcacctagaatacataccaggatctcctacccactccttaggtacaagaagaagaaggggttctggccgggcatggtggctcacacctgtaatcccagcactttgagaggccgaggtgggtgggtcacaaggtcaggagattgagaccatcctggctaacacggtgaaaccccgtctctactaaaaaacacacacaaaaaaattagctgggcgtggtggcaggcacctgtagtcccagctactcgggaggctgaggcaggagaatggcgtgaacttgggaggcggagcttgcagtgagccgagattgcgccattgcactccagcctcggcgatagagcaagactccgtctcaaaaaaaaaaaaaaaaggggggttctggccttaatctgcctccagctcagttataaggtggcttatctaaaggcttgggaggtggggcacccagccctacccacccgtccaggaagttccacacctggacaactttcagtttcattattttagcttcctgagattcagaggccaggaactgtgcagagatctgtggggattctcacaacttccatttctggtgaacagctgaggtcagagaggaggtgggtaccacttgagatgggcctgtggttcccgggtactgtctttccagacacctagaattcccaggttggtagtgaactgagagtcaaccaccatgatggggccagagacagaggaggaagcagtgagtggataagtgcctgtgctgggcagaagggatataggggaaggtggccaaaggtaggatggggaagtggatcccaggaagcttttgtttcttctgaggccaatttaccaccacctcattgggaaattgttggtagggaggcacccatccaattgccttgcagaatacagcaaggcagggagcccaagaatcagagccaagggaagaaacgaccagttgaggttagtaatgtgaagtctggcaaccgtgcccgtcattcctccctggttcctctgttcatcaacgttggggctagtctggctggggcatggtgggcctgcctttccatcccttgggccccttggaacaagggggcaactctgctgtgggagatgtagaaaatgggtctcactttctctatttggggcaatagctgctacttttttcctccagatgggtaccatgaggggcagaggagaatctgggatctgtgatgtttagccctctttactgagtcatggctgcctcacgttctagaagtaaggcaggcaaatcattccaggtactgattgtcctggaacctttggctcttccttgacctcatgtcacgtgcgtccatgtgaagagagtccacgaaacgggctttatatgagcaacaaggctgggtgcaggcaagctgagtccaaaaaaggggtcagcaaagggtggtggcattatcattagttcttatatgtttgggataggcttacaaagtacattctcaagggtggagaaatattacaaagtaccttcttaagggcaggggagaatattacaaagtaccttcttaagggcggcggcggggagactatattgtatcagggtggggcaggaacaaatcacaatggtggaatgtcatcagttaaggctattttcatttcttttgtggatcttcagttgcttcaggccatctggatgtatacatgcaggtcacagggaatatgatggcttagcttgggttcagaggcctgacacctcaggctgccaaatgtggaagatttaaatacttgaaccaataccctcctcccaaaaactgaaattggcttctgtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcagtataaggtagatgacaggtggccagccaggaggccttgaccgtttgtactccatctccttctcaattccccattgttatcaaccaatcaacaacgaaactgtgggatttgtacacatccacacaccttaatttaagaaatgcacggaagagctgcatggtgggaggagagtgggagaagtggagatttatttccactggaaaccgttcctaaatggtcttccttttccattttttcccttgtaaaataatctgcttttaatttagcgagctcttctcatgtgtttatcatttaaatgaataagtaaatgagggcagtttgcttactggttaagaaaggatgcaggctttagggctggaagcacctggtttcaaagcctggctctgcctcttatcagctgcgtaacctttggacaagttgttttattgctctaagtttcagtttcctcctgtgtcaactctagaggactgttgtaagaatcaagtgagggatgggtgcggtggctcactcctgtaatcccagcactttgggaggccgaggtgggcggatcacgaggtcaggagatcgagaccatcctggctaacacagtgaaaccccgtctctgcttaaaaaaaaaaaatacaaaaaattagccaggcgtggtggcatgcgcctgtagtcctggctactcaggaggctgaggcaagagaattgcttgaacccgggaggtgcaggttgccgtgagctgagatcacgccactgcactccagcctgggagacaaagcaagcctctgtctcaaaaaaaaaaaaaaaaaaaaaaatcaaatgagaacaaattacgtgaatcatttatcacagtgcctgccacaaaaggagcacccaataaaagttatctcccaggtcggtggtgattcttattatcctttcatgttccttggctatcaagactgaaagggaagtttctgatgagcagaaatccctaaggtattgagggaatttatggaagagtcaattattccaaccccctgcctctgatctcagttattcctggggtacttgggtttcagaagccccagggttaagtgttgaactctcacttggagcccanastggaatatggtgaggagttcattatatttcataatgtgaaaaaatatttcataatatgaacaatagcaaggngctcatagctcagacctctctgatacagtccatttctttttatgaggtctcatgccaagagacggaaaagagctctaacagccctgagcagctttagagtattacagtgtgccaggaactgctttaagtgaccaagagcagtacccagattacttggaggtggtggacctttccacaagcagagtttcgttaagcaagcaaggggcttttggagaaatttcagattcgcatctttcaaagactgagtcaattctctgaaaagtaaattgctaagagccaatttgctaaaagtcagctctcaaaaaaaaaaaaaatcagtttgccaaatgatcaattcactgaaaatggaaaaatactttaacccagaactaggatgttttgccacaataatattactccccagggacagggcaaagtttaagtctgggaaaaaaaaattgactaagtcagtcaacttcctttaaggaaaagctcatctgtgtgcatacaaaattcggaggcagaggtgaaaccaaacttaaaaagaaaatccttacaatgatgggaattggtaatttgaattgatttttagcttggtctgctccctatttaaatgggttattttgtaactgtataatgctgatggtgcagttaaagtgtgcatagggctgggcacagtggctcgcgcctgtaatcccagcactttgggagactgaggcgggtggatcacttgaggtcaggagttcaagtctggcctggccaacatggcgaaaccctgtctctactaaaaatacaaaaattagctgggcatgatggcgcatgcctgtaatcccagcactttgggaggctgaggcgggcggatcacttgaggccaggagttcgagaccagcctggccaacatggcaaaaccctgtctttactaaaaatacaaaaattagctgggcgtggtgtcgcatgcctgtaatcccagctactcgggaggctgaggcaggagaattgcttgaacctgggaggtggaggttgcacagtgagccatgattataccactgcactccagcctggcgacaaagcaagactccgtctcaaaaaaaaacaaaaaaaaaagtgtgcataggattttgtgtttgttattaaagtccatactttattcacattaacttttttttttttttttttttgagatggagtgtcgctctattgcccaggctggagagcagtggcgcgatctcggctcactgcaaccttcacctctaggttcaagtggttctcctgcctcagcctcccgagtagctgggattataggtgcctgccaccacacctggcaaattttttgtatttttagtagagacaaggtttcaccatgttggccaggctggtcttgaactcctgacctcaggtgatccgcccgccttggcctcccaaagtgctgggattacaggtgtgagccgctgcacccagcccatgttatcttagttttgacctagtgtcctttttctattccagaatcccatccaggatcctacattacatttcgttgtcatgtctccttaggctcctcttggctgtgacagtttctcagactttacctgtttgggataatcttagcagttttgagcagtactggtcagggatactgtagaacgtccctctgttggaatttggctgatgttttttctcatggttagactgggttctgggtctcggggaggaagaccacagaggtaaaggaccattcctattacatcacatcaggggtacgtactgtcaacatgacctatcactgttgatgttgaccttgatcacttggctgaggtaatgtttgtcaggtttctctaccagaagttactctttttcctcttcttcatatagtactctttgtgcacatagtttttatttttctttttctctctgatatttttcttttcttttacactgctcaagaagcaaatggtccctaagacattagtgtctcatgtacacacaaatagtgatttcagtcactgtttctaattctgtcacatttccaccagttccaaaatggatttgtctttggaaatccagccctgcctccaaaacctagcagtgggagctctccctcccctgtaggttcccatctgggaggttggagacaaaggcacgcagccccttcggcatgcccacacatcctccacgaacctggggtggcaactgactcagaaccaaggcccttattagtgcctgatcaatcagggccgagtccatgcgtgtttgtgactttccagggttgcctcacttcatacttgtgtggttcatacaaacaacagcgacagaactgcttttattggagatggagtctcgctgtcgcccaggctggagtgcagtggcttgatcttggctcactgcaatctttgcttctgcctcccaggttcaagcgattctcctgcctcggcctcccaagtagctggaattacaggcatgtgccaccacccccgactaatttggtagagatggggtttcaccatgttggccaggttggtctccaactcctgacctcaagtgatctacccacctcagcctcccaaagtgctgggattacaggcgtgagccaccccaccgtgcccacccagaactgcttaatttttatttcccaattggctggggctcctacttctttagctttacttttctttgtcttgtttcagcctacaagactggcttacaattattaagcagttagaatgtatgccaggcacttggttaagtgcttaactacatcattatatttaatttcttcatttcttttcttttcctttccttttctttttcttgttttgttttgttttgaggcagagaggcagagtgtcactctcctccaggctggagtgcagtggtgtgatctcagctcactgcaacctccgcctcctgggttcaagcaattctcatgcctcagcctctcaagtagctgtgattacaggcacacaccaccaggcctggctactttttgtattttttagtagagacggggtttcaccatattggccaggctggtctcgaactcctgacctcaagtgatctgcctgccacagcctcccaaagttctgggattacaggcgtgagccactgtgcccagccytaatttccctaaatataggaagtagacattagtaatattctcctactatagatgaagaaacagattcaaagaggttaagtgacttacccaaggtcatgtggtaagaaggtggaggagtgggctcaaatctgggatcctgtgaccccaaggtaactgtgcttytggtgagaacagcatttcctggacagccacagctgtggcgctccctcagaagggagggggatggtggcacggaacccaggatggggctgccccagggagggtgttttggagagagatcttttgggggtctgctccagagtgacctttatcattctctttccaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggtgaggttggagttgggcagcagggaaggaggggaagaagcccatcttgggcaccaagggattcragggtggcagaccggctctttttaaaatttatttatttttatttttcttttccctgcttttcatgagctttgtgggggactggctctctagggcagcctctcgctctctacttccaggattccctcagccckcccctttaygcaagcacgccttcctcttctctgcctccagaagccttctcattcacccaggagcagtctccaggaagccttctgatgcccccaattcactcatatccctgctgtcccccaggatggttaattcctctgacttggacaaacctggttgttttttttttgtttggtttttgttttgtttttttttgagacggagtctcgctctgtcggccaggctagagtgcaatggcatgatctcggctcactgcaacctccacctccaaacctggtggtttaagaggcactctcctttgctctcctctgctctcctgcactgagctgcccacatcagtrttttgtgcttgtttccctctgccttgtgggcaagccagtggcttccatgttcgtctttcccactggactggaagcaacttgtgacaagggactgactttactaacctctctgtattgaccccaagcacacagtaggtactgagtgaaagagagctgaagtgaagcacgaggaaagcaaagaaccccttggaggatgtttcctgcatggagtacagccaccccaccccagcagggtggcaccgatccagtgccacagaggttctggtagctggtgggcaggtgcttccaattcaagaggacatcactagccatcccctcagcaatagttctgttgttgttttcttcagctgggattgttggagattgaggagtagctcaggggaaggtgacccacagttttcctggccttgctctccttgagtggagcgggtaccttttttcttttccttttccttttttttttttttttttttgagatggagtttcacttttgttgcccaggctggagtgcaatggyacattcttggctcactgcaacctctgcctcctggattcaagagattcttctgcctcaacctcccgaggagctgggactacaggtgcccgccaccacgcctagctaatttttgtatttttggtagagacagggtttcattcaccctattggccagggttttttggagagagatctggtctcgaactcctgacctcaggtgatccacctgccttggcctcccaaagtgctgggattacaggtgtgagccaccatgcccatgccacccttttttattaataaattaaaaacaaaggcttacaataaaattttactggtcctttgaattacccctccctaccacagtattgctggggagaggccttcagaattgttctaagagagctcggtgttttctattatagaatgcttgtttgtcaggtgagggtattggtatctgtatgtggggtggggcactggataggtaggggaaagtcatcggaggcagggacccatgtcttgagggccttttgattrcaaatagaaactccatcagactgttttaggtctcaacatgagtttcccccagcgggaatggaatctgatgcttcatgagcctaagggcagatgatgcagctggctccagggaccagcgcaaggagctggagccccttgtcagagaagagggtgtcttgggcttcacagatgcctatctcagtgtcacgggaagggcactctctttggacttacactgaccagggtttgaatcccagctctacacttactagctgtgtgaccttggaccactcacaacctgtcactaagcctcagtatctttacatggaaagtggacgtaattctgcctaccatcataggattgtgaaggttaagtggaaaagcgtggctcacagctggcacattgtaatcttccataaatgctggtgaattcttgccccactttgtttttatttatttgttttgaggtggagtcttgctctgttgcccaggctggagtgcaatggtgcagtcttggctcactgcaacctccgcctcccgggttcaagtgattctcctgtctcagcctcctgagtagctgggattacagatgtgtgcctggtgatccactcacctcagcctcccaaaatgctgggattacaggcgatagccaccgtacctggcctctcrccctactttgtaccccacccctacctccaccccgaggtgggtaaagtgaactgcgatggggtgctgtgttccttggttttccagtctcagaagcgattaatcttmaataggagctggctcacagagagggaraagagtcagtgggaggtaaggccctgagatccttaactctcatctctctccactctctccaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaaggttaggatcctgggaggcagggactgtggaggccagtgttggcccacaccccgcaggtcaaggcgatgccagccttagactcttccttcactcctctccgagcagccctgctgctcttggccaccttgccccaagaaagggtgggtggcattgcccagtccttcccttgttactctctagcggtgccctcttttcatttgcattttctttctttcttttttaaatagagatgaggtcttgcatgttgtccaggctggtctcaaactcctgggctcaagcaatccacccacctcggcctcccaaagtgctgggattacaggtgtgagccacgcacccagccttcattttctttgtacatttcccatggttcatcattacacaggtgtatttttgcttgtttattgtctgtctcctttctaggaggtaggaggacaggagccatggtgcctagaacaaagcagctcctcagtaaacatttgttgaatgaacagtggcaacaagatgagttttggcatcagacgtgggttcaaatttcagctctgccactgtttttagctgtgagactgtctcacctgctgacctctgagagcctcagttttctcgtctataaaatggggatacaaatgactgcctcacaggattgtttgggagatcaggcaagataatgatgtagaaacacctggggatccgtcaatgtgagctcctttttctagggccaaagggaagtgaccatccccccaaatcgggtcctgagctatcgagtaaagcagcttgtcttccccaacaaggagacgatgagtaagcaaaggcagatggagaacaggatggggggccctaaacacaccagtgaggtggggggtgggattcaaccaggctctgtcagcctagggtgggtggctggtgagcttggaggttggggaggggtccagggaaaagggtgggttcagcactaggaaggactgaggctccatgctctgacctgggkacctggacccgctgacccaggatttgcctgaacatgacataagagtcattaactcctctcccagtctccaaatagaataattgtcttttttggctggacgtggtggctcacgcctgtaatcccagcactttgggaggccaaggtgggyggatcacctgagatcaggagttcgagaccagcctagccaacatggtgaaaccctgtctctactaaaaatataaatattagctgggtgtggtggtatgcgcctgtaatcccagctacttgggaggctgaggcaggagaattgcttgaacctgggaagtggaggttgcagtgagccgagatctcaccattgcactccagcctaggcaacaagagcaaaactccatctcaaaaacaaaaaacaaaaaacaaaaaacaaaaacaaaaacaaaaaacagttgtcttttttttttttttttttgattggaggctggtatagggattgagagggactggagaaagggaacttacagagtgataactggtctctccaataacttgttttttcctccctttttggtgctggtttrgatattcatttcaggggcaaaacaaaatcctttccagaaggtgagtgagctgctgggcttcccrttcgtcatttcagaatgggcaaagacactatttttaaaaatggaattacagagtggttaggtccgaggatgtggtaagacgcacccacaggtgggaaccatggcaagcgcaggggaaraattagcctgttgaagagtctggattgcacatcggactagggtttccaggctgctcctaggacaacttcgtgctggcagtcagctggatcctgagcttacagccctccctgaagtcttgttggcctaggaagcacaattaaatgacttggccagttccagcaggacagcactggctgtgaaaagggtcctggactggagtcaggcagtctcagggtctagtcccaccctgccactcactagctctacagcctcccaagtcacagttttcctgactttattttaatttaatttaatttaatttttttgagacagagtcttgctctgtcgcccaggctggagtgcagtggtgtgatctcagctcactgcaacctctacctcctgggttcaagcgattctcctgcctcagcctcccaagtagctgggaatacaggtgccctccaccacgccaagttaagtttgkttttttttgtttttcttttttttgtatttttagtagagacagggtttcactatatgttggcaggctgctctcaaactcctgaactcaggtgatccacccactgcagcctcccaaagtgctgggattacaggcgtgagccaccatgcccagcctttcctgactttaaactaaaggagtgagactagaaggtccctgtgattctgaattatgtggcttcctctggaatttctaggttttccccttgatcccagcagggttgtactgcctaagagagcttggaaagggatagagaagtctgacccaaatttgcggagcgactgagtgtatgctgccccctttctgggccttggcttcttcctcaatcatctaggcacagtcctatgactgcctgtttttgaggatgtgggaagggtctgcaaatacagtgctttcccattgacacacrctggtgaggatgcaggctccctggcaccagcagtgagggctcagattgcaagagtaaaaacttccatcactgggaagagaagtctgcaggggactggaggtgatctgaagattctgaaataactcttcctctctctgcagagaaggatggtgcttcatcctgtttaggtaagggtgatagccaagtgtgttcagggtggctgcaccaacccaccctgagtccatgtggctcaagactgctgctcaggtggggtcagctgagtgggtaggaagtcgggaggcactgcctagcaggtttcaactttagtctggaggctgcatctgtctcctctaaacacagtggttctcattggttataccccaaaatcacaccaggaaactttaaaactagtgacgactgagtccygtctccagaaactctgacttaattgtgggggkgtggcctggacatcaggatttgtaataactcctcaggtgattctcatgtagtcaaggttgagaaccactgctttaactttctccaaatcctaattacttctagtgtggcctgaggactgcactttgaatggcaagggccaaataaccaagtttttgtttttttccaggaagtggagaagaatttggggttgggactagactggggktgagctggggagatggaagatggaagtggggtcagtgggaggcaatgatggtaggtatcttggaagaaggatgcttaattttaacacggaaagactggaagaagggaagatacaaagaggtggtctccagaagacagtcagacaaataacagagccttagaaataaaaccttttgggctgggtggcccaggttctcaattgctgcctctacaggaaagtctttgggttcggaggrttccagaaacatgaaggagaagttggaggacatggagagtgtcctcaaggacctgacagaggagaagagaaaagatgtgctaaactccctcgctaagtgcctcggcaaggagratattcggcaggatctagagcaaagagtaagggaccctaagaaagccttggggcagagagagataggagccagaggggatggcagttggcacagtgaggataatctgctatggtgagactgctgctcatctcccacacttcctggccctaggtatctgaggtcctgatttccrgggagctacacatggaggacycagacaagcctctcctaagcagcctttttaatgctgctggggtcttggtagaagcgygtgcaaaagccattctggacttcctggatgccctgctaggtgaggaagggtctcgctgtaggctggggtggaggaagtgtgagcagagaggcctgtggggagtcacatcttgggaggaggggctgcatgttgctcttcacagtttatggggggcactccttcatgtcttcctcaggccaggcattgaggggctggttcctcgtctgtgactcctgcaggccaagagggaagcaggagtcacagcagaggcctgtttggagtaagtctcatctagcactcccaggggctctctggaaccttttgatgatacatgttctgggtgtgatcagccactgaggccctgtcccaccatatatctctcctttttaccactctttctttgcccccasagctgtctgaagagcagcagtttgtggctgaggccctggagaaggggacccttcctctgttgaaggaccaggtgagacagcctgggctgagggccatggtcatagtggaagggaatgcccatattctcaagggacccagaagtcccagggtacagccccttcttattccatagttttctgccggctcacatccatgcagctggtttgtgacaattccctggacagagagttgccagaacaatttgtggtgggttctttaggctctgttttttatctgtgggcaagagagggctgcaaattggttagtcccrggacagcagctggtatgatcttgagttcccatgcagactgactagcagagcctgccactatgttgagagagtatgaagctctccgggctctgcaggaaagagtgccatgatggattattacgtctgcctatcagctcagcagcaaggagtgtggccaaatatttgccatttctggtatatcgttgttcctagctgttacartctggggggtttccttccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagcyctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaattttgtcttttgaagcctcactaaatgacagtaaagcaatagaaaaactttgtataaacctacaaggatagaaagaatgcagcagcagataagaaactttaacacatctttggaagctagaaagcaatgaaaggagtgcaggctggcaggtgtgggactgaggggtagacaggagattgctgtttttatcatcaggcttttatttatttatttatttatttacttatttatttatttatttatttatttttgagacagcttgttgcctaggctggagtgcaatggcgtgatctcggctcactgcaacctctgcctcctgggttcaagcgattctcctgcctcagtctccagaatacctgggattacaggtgcccacaatgatgcccagctaatttttgtatttttagtagagatggggtttaacccttgttggccaggctggtctcgaactcctgagctccagtgatccacccccctcggcctcccaaagtactgggattacagcggtgagccaccgcgcctggccagctttttagttctatttgatatttttaaagaaactgtaattaaaagttaaagaaatgtatgcttgttataaaacattcaaacatttcccaaatataaattagcaggtgaagttactctgtgacctaccctttctttctagagacccagagaggtaagtgaaatatcagaacattaaagtaattttgcctcaggtaagggggattgatatttgcaaatccaggcaaactaagtttgggtttggctagcctcctggactgatggctccagaagccaaggccaagggcctatccaagtttgggagtctagtacaaggaaacctgccctaccatattagactaatctcaaaggctacactgtaagtgttagggtgaatcagcagtaaacttactgttcttactccacccccaggggactgcagggaagactctcttggtactgagtgaggaagaggttagcgaaaggaaaggaaaaaaaattctgagaaaaccacagcccagtcttttctcagaacttagcctgcatttgtatcctcttgagaattccagagaatctgaaattgtgaacttggtttttgggggtcttggactgaatgtacccccagatgcctgtcagaaccaaacacaaattatctctggaggaagtaatcttccacaaatatatatatttgagacagagtcatgctctgtcacccaggttggagtgcagtggagcaatcacagctcactacagcctccacttcccaggctcaagcgatcctcccacctcagcctcttgagtagctgggactacaggtgtgcaccatcatgcctggctaatttaaaaaattttttttgtagagatggcgtctccctgtattgcccaggctggtcttgaatttctgggttcaagcgatccttctgccttggcctcccaaagtgttgggattacaggtgtgagtcactgtgcttggctggctaaggcacatatgttttccttttgagagatgtggtattgctctgttgcccaggctagagtgcagtggtgcaatcatggctcactgcagcctctacctcctgggctcaagtgatcctcccatttcagccccctgagtagctgggaccacaggtacgcaccaccatgccccatctaattttttatttttattttttgtagagatggggtctcactatgttgccagggcctcactatgttgccagggctggtgttgaactcttaggctcaagtggtcctccctcctcagcctcctgaagtgttggaattataggagtgagccactatgccggcctaaggcacatactgtcaagtaactcaaaagtcaagggagaaatcctaatggaagttataagatttttttttctacttagtgataataaaaatatacatatcaaacttgtggaattaagctaaagtcttttgtttttagagaaaatatatgtttcaccttgtttgttttagaaaagaaaaaaagctaaaaaaatcaaaaagctaagtattcatgtcaaaaagctaacaaagaaaactccaaaacaaacccaacaacaagccgctcccttcccctccaaaaaagcccagcaaaataaatccaggaaaaagaggagaaaaagcacacaaattgacaaaataagaaacaaaaacattaagaggatcaataaagacagacattggacctttaaaatgactcacagatctctgacaagagtgatatttaatttaatttatttatttgtttttgtttttgagatggagtctcactctgtctcccaggctggagtgcagtggtgcaatcttggcgcactgcaaccttcactgcctggattcaaacaattctcttgcctcagcctcttgagtagctgggactacaggtgcacaccaccacacctgtttaatttttgtattttttagtaaagacaagagttttgccatgttggccaggctgatcttgaactcctgacttcaggtaatccacccacctcagcctcccaaagtgctgggattataggtgtgagccaccgtgcccagcttgacaagagtgataaaaagagagagggagcaaatatcatcagttttaagagtgaaaagggaacagttctaaagatgttacaggcatttaaaagacaggaggatattagaaacgactttatgccaataaatttgaaattttaggtgaaatgggtgttatcctaaaaaaatacaatttcccaaagttgtcccagaaaaaaatagaaaacatgggcctggcgcggtggctcacgcctgtaatcccagcacttcgggaggccaaggtgggcagatcacgaggtcaggagatcgagtccatcctggctgacacggtgaaaccccatctctactaaaaatacaaaaaattagccgggcatggtggcaggcacctgtagtcccagctactcaggaggctgaggcaggagaatggtgtgaaccagggaagcagagcttgcagtgagcagagattgtgccactgcactccaccctgagcgacagagcgagactctgtctcaaaaaacaacaacaacaacaacaacaagaaaaaccagaaaacatgaataatcctctaagaacaaaggatactctatcaagaacaaaatattggccaagcacggtggctcacacctgtaatcctagcactttgggagactgaggtgggtggatcacttgaggtcaagaattcgagaccaatctgggcaacatggtgaagcccgtgtctactaaaaatacaaaaattagctgggcatgatggcgcatgcctgtaatcccagctacttaggaggctgaggcatgaaaattgcttgaatctgggagacagaggttgcagtgagccgagatcacgacactgcactccagcctgggtgacagagtgagactctttctcaaaaacaaacaaacaaaatattcccacaaagaaaattccaagcccagatggtttcttcagttatacaattaagcatttaagaataagtaactctaatttcacacaaactttttcagagacactttccaattcatccacaacactagcaaaacttaacaagaacaataagagaaaggaaaatgcaggccagtctcattcgtgagcttagatgaaaaaacagaaaaacaaatcagcaaaccaaatcaccgtagaaaaataataatataaactggatttatctgggatttcaaggctggcttaacattgaaaaattaatgtaatttaccacactagcaatttaagaagaaaaatgatgggatcatttcaataaagacaaaaatgcatctgataaaattcaatgtccattcatgattaaaattccaagaaaactaggaacagggccaggtgtggtggcttacacctgtaatcccagcactttgggaggccgaggtgggcgcatcacttgacgtcaggggttcaagaccagcctggccaacatggtgaaaccccatctctacaaaaatacaaaaattagccaggcttggtagtgggttcctgtaaccccagctacttgggaggctgaggtgggagagtcgtttgaacccgggaggtgtaggttgcaatgaaccaagatcacgccattgcactccagcctgggggacagagccagactccgtctcaaaaaaaaaaaaagaaaaaaaagaaaagaaaactaggaacaggaggaaacttctttaatctgataagagtatatacaaaatatttatagtaaatatcatatttatggtaaaatgttgtaagctttctctctgaaatcagtaataagacaaggatattcactatcactgtctatttgacattgtacagaagatctagcaaatgcagttaaacaagaaaaagcaacaaaatatgtaagaattataaaatattgcattacttacagatgatctaatgtgtacattgaaaatccagaagatttacagataaattatgaaattaataatttaacaattttgtaaaatcaatatatggaccagttgtaatcctatatataccactaacaagtacaaaatgaaatttgaaaaatacaatgataatggcaccaaaaatatgaaatatttaggaaaatgttgaactgaaggtccgaaagagctgaaatacattgttataaaatcttactgaagccaggtgtggtggctcacacctgcaatcccaacactttgggaggctgaggtgggcggatcacctgaggctgggagttcaagtccagcctgaccaacatggagaaaccccatctctactaaaaatacagaattagctgggcgtggtggcgcacacctgtaatctcagctacttgggaggctgaggcaggagaatcgcttgaacccgagaggcagaggttgtggtgagccgagatcgcgccattgcactccagcctggtgacagatcgagactctgttcaaaaaaaaaaaaaaaatcttactgagagaccttagaaaagacttaaacaaaagaagagatactacattgaaggattaggagacacaatattgtaaaaatgttaattcttctcagattgatttatggattcagtacaatcccaataaaaatcctaacagttgagtgaatgagtgagtgtgtgtgtttgtgtgtgtgtgtttatgtaggtgtgtaatttaaaaagctgattctaaaatgcaaagggcaaaaacagctatgaggctcttgaagaagaacaaggtggaaagacttgttctaccagatccaagactgattttgaaagctatattatttcagtgtggcactgaacagggatagacagaaaaacaatgaaatagagatctcagaaatggatccccatgtaaaaatggacatttgatatatgagaaaagtgtcactgaagattagttaagaaaggctagacttttcaataaacggtgccaagacaactggataagcatgtagataaaaaatgaaatttggctgggcatggtggctcacacctgtaattccagcattttgggaggctgaagtaggaggttaatttgagccagaagtttgaggttacagtgagctatgactgctactgcactccattctgggtgacagagtgaaaccctgtctctaaaaagaaaaaaaaaaaaaatgagccaggtgtggtggctcatgcatgtaattccagcactttgggaggccgaggtgggcagatcacctgaggtcaggagtttgagaccagcctggccaacgtggtgaaaccccatctctactaaaaatacaaaaattagctgggtgtggtggcaggcgcatgtaatcccggctattcaggaggctgaggcaggagaatcgcttgaacctgggaggtgaaggttgcagtgagctgagatcacgccattgcactccagcctgggcaacaggttgagactccgtctcagaaaaaaaaaaaaaaaaggatccctatcacacagtatacataaaaattaaattccagatgggttatagatctaaatgtgaaaggtaaaatgataattatattaacattaaaaacttctgttc

SEQ ID NO: 10721 - DNA, 21707 bp, Homo sapiens
  misc_feature (1)...(21707): n = A,T,C or G, or insertion/deletion polymorphism (see Tables 1-2)
tgtcttttaagtaagtgtttagaaaccatttccttttttttttttttttttgtgaaacagagtctcactctgttgcccaggctggagtgcagtgggcaatctccgctcactgaaacctctgcttcccgggttcaagtgattctcctgcctcagtctcctgaggagctgggattacaggcacccacgaccacgtctggctaatttttatatttttagtagggacggggtttcaccatgttgcccaggctcatcttgaactcctgacctcaagtgatctgcctgccttggccccccaaagtgctgggattacaggcgtgagccacagcgccgggcaaccatttacatttaatatgttgatacagaaaggtttatcatcttgctatttcttcttatttatcccatttgcttgttctttttttcttttttgctagctcctctcttttttattgaagtactactccacaatgctgccttctttgagactaagtacccgatgccattttacctccacagtggagataataatattagaccatgtcacatatagtgtaagagtcttacctagtaacttctatttccctccatcatttttatgttttatgaaaatgttattactttcatatatttaattctgcatgtgctaagaactccacactgtactgttatatttgcttgaaccagttatcatttaaagagattaaaaaggtaaaaatgggccgggcgtggtggctcacacctgtaatccccagcactttggaaggccaaggcgggtggatcacctgaggtcaggagttcgagaccagcctggccaacatggtgaaaccccgtctctactaaaaatacaaaaattagccgggcgtggtggcgggcacctgtagtcgtagctacttgggaggctgaggcaggagaatcgcttgaacctgggaggcggaggttgcagtgagctgggatcgcgccattgcactccagcctgggtgacggaatgacacattgtctcaaaaaaacaaaaaaaaaaaacaaaaaaaaccccaaaaaagtaaaaatgtttttttgattttacctataggtttacaatttttggtactcctttgtgcagatccaaatttccatctcatgtcattttccttttgcccgaataactaacatttcttgtagcgtagatctgctagtgaagaatcctgttgggttttgtctaaaaaaatctgtttcttgtcctcatttttaaatgataaggaaataaacctggggtctcagttcctcttccccgcccctcactgagcagagttcttatgcactgctgccatgtgggaggtggagatgggttcagaggtttgtgaaaagcttgacgcgctgcacgcccactccacagggcacctttagaggcttcttggggaagctggtcgggtagctctgactcctcgcatctctgtgtgtccttgggaatgtcaggtggaagatcgatgtgcatttgcaaatgggagtgagtgtgagaaaagaaaaatgtggggttgtggctggtagggtgtgttcagggagcaatggtgacctctgttgtctgtgctctcccaacagttctgggattgtggggaatgcaattgttctgtatcccttttgtattttggaagttctccgtgaagtctaactgcaggtcatattgtcatttagtctagagttggaggatggatataatttcatgagtatgaaataatatgcagagttgttggacaccaactgggcccacccactccaccagaactcaggtctccttcatttgactcccaccggcaacgtcactcacctgaattactctctcttagataccagaggggaaacggaggcatgcaggtgagaacgtggcagcagtccctaaaagtcacttctggtgctggccctggctcatccgtgccctgggggagaaatgcaagtgtcagagctgcggaaaggagctgagatctagcagggctcgcccttatcaacctccgcctctaacaagggccacacagcacgtaggggagattaggccgatctgcctgcctcatggcgggaggccaggagggtggaaggcagcggatcgcgccctagcgagcaacccacatgctctggaagtgtggttcaactttcaccaggctactgcgggcggccggccagctgtcagcgggcactccgcccccaggagctgtccgcaagcgcggggcggtgggcaccgcggggaacagcccccggacagccagtggcacgcggagacctcggagagcgcaggccctgctttcccgtaggaacactcgtgggcatcgggtcgcccgcttcgcccccgcgctctagacgcactttcctgccgcctggcgatgtccgaagtgcatatcagagcatggacttggtcttcccagcgctaccagaccgctgagcctccccgcacgtggtggggcgcaggcggggcgccagctgcgcgggaatccgggcgagcgcgctccacccgggcagtgcgggcctggagcgccctctggcgggacggtgcgcggcgttgcgcgtctccagccttgggattggcccggactcgccttcaacgcaccggacagcgctgccaggaggcagagctctgaaaacctcgacaacgacgcctctctcttcagtgcccgcactgcgtcccaggctgacgccaaggaggcccaagacagccctgggtggccattaggacgggtctggaggggacatcagtgtggacatctagttgctgggcctggggtcacagccccctttcttgtctgaactggccactgcccggaggagctgcgctgtgcgccttagtgtgccaccacctaaccgccatcgcggctgagcccacctcctttcccggacattagaggacgaggggtgcgaaggtcggggaaagctgggggcatccagatatccagagtagaggaggggcctcttccctgcgtggatgtgcatgggaaggattccaggaatttaattttcttttcttttgagatggagtctcgctctgtcaccaagctggagtgcagtggcgcgatctgggctcactgcaacctccgcttcccgggttcaagggattcccctgcctcagcctccctagtagctgggactgcaggcgcgtgccaccacacctggctaattttttgtattttagtagagacgggggtttcaccatgttggccaggatggtctcgatctcctgacctcgtgatctgcccgccttggcctcccaaagtgctgggattacaggcgtgagccaccgcgcctggccgaattttcttttttcttttttttttctggagtcatcatctctccactcgcagatagggagtcagcgtggtttgtatgcaggtgggagggactgagcccctgaaaatggttaggattgtctctggcctcagccttggtacacacatcacaggacaaatcaagcagacagtggtgagtccgccacagtgggcaaatttctacccgtgccagacagtgtacaggatcttttgtttttttttctctctctctcttccttttgagacaaggtcctgctctgtcacccaggccggagtgcagtggcgtgatctccactcactgcaacctccacctcctgggctcaagcgattttcccacctcagcctccccagtagctgggattacaggctcaagccactgccccccgctaatttttgtatctttttgggtagagatgggtttttgccatgttgcccaggctggtcttgaactcctgggctcaagccatgtgcccgccttggcctcccaaagtgctaggattactggcgtgagccaccttacctggtggggcacaggattttaaattaaatttttttttttttaatttttagagacagagtcttgctctgtcgcccaggctggagtgcagtggcatgatcttggctcactacaatctctgcctctagagttccggcgattcttgtgcctcagcctctctagtagttgggattacaggcgtgcaccaccacacccagttaattttttctatttttagtacagacagggttttgctatgttagccaggctggtcttgaactcctggcctcaagtgatctgcctgctttggcctcccaaagtgctgggatcacaggcgtgagccactgcgcctggcctaaatttttcgtctttaagacggggtctctctctctctgtcatccaggctggaatgcagtggcacaatcatagctcactgcagccttgaactcctgggctcaagtgagcctccagcctcaactttctaagtagctgggactacaggctgatgcgaccatgcccgacttggcacaggatttaaatatggccctggacaagtcactggccttctctggccttcccaggtaagcttggactttctgggatgcttcaagttcaaatcatcagtggtacaactgttgaacaatatgaggaacgctgcgggttactgggcctgtgtggacccgttttggattctaagctgggtcctgggcagaagttggaggctggggcagctgcaagcaggacaggcaggtggccagagggcccagcagcttcagcactgaggactggactgggtcgccacgcccaaaggaaggataattactcacctcccactcaagaagcaggcggcagaactgttttggagagcatggcttggggcctgggacctatgttcatgcggtccagacggagatccatgagagttaagactctttctagatatcaggtagcacttctgattacaaaacttttgcacatggtctcctctctgctttacaacagctcaggaaagtaggcccaaacatccactttaatagatgagggagctcagagggggtaaccaacccctccaggtcacacagccagggagggggttgagccaaggttcaaaccactgcctcggttgttgcagatacatccctgcagacacctttattgaagagggaccctgaaggctgaacggccaacacagaagaggaggcacttgggagtaagggtgatttatggccctgggagggcccagtgcaggtaggatgggagctaaggtaaggctgggccatgcctagctgcaagcaaatttccttaaaaaacaaacaacaaaaaacattactttttctaaacctaaagtttgtggtggcattcaagtcccatcatagcccatctatmcagactcatctgcctgggatccccgtcttgggactagtggtcactggcctgcttcctggtcaattagcttccgggactagggggaggtgtgaggagcctagagtgcaaaatttaagaagcactcagtctcaggggcgtgcaggtgcagggtagcgacggcaggactctaagagtgagtctctttcctccccgtttccccgtcctactttcactctaagcatttagttcccaggggacagagacgacttcttcattagaagaccccggggggtccccagcccggaagggctcacagttggagctcaaacatttgccactgttcaggctcatctttctttccccagtgaaaaatggtctaggttgggaagggcaggttcctgtctactgcgtgatccaaccgattctggttcgcccaatgtctggacttgtcctttgccaagaataagcagatgagatgggcggatgaaccccaatgtccctgcaagattcaggaagtcccagccagaaagtaaaggacgtttagttccatgtattgttttcttttttacatgcggggcaacacacctggacagtgtcgatggcttgctccaagccacacggccgcatagggacagggactgggctacataacaagttcttcgacgctgtgatctaatcaaggaaaacctgggacgcagctaatagatgcgcatcgagtgtatcgacgctctaagtacgagggctggaacagtgagcaggatcagtccattgcttttgcctacctgctgagcgctgattggtccccgtttaggaaacggaaaaaggggcgtgcacgcgggcgcggctgcgtgagaggcgcgcggcggcgcagtraacagtctccttccacaaaaccatggcgtcgctcaaatgtagyaccgtcgtctgcgtgatctgcttggagaagcccaaataccgctgtccagcctgccgcgtgccctagtgagcggggaggtcgcggggtccaggggcgcgggtgtccggccatggcgggagggcgggaggccgggaggccgggcgggagcgggcgggctgctggaggggccggggaccctcggggctgacgcggcctgtggcctctgttgttacagctgctcggtagtctgcttccggaagcacaaaggtgagccccgtccccgccagccctcgtaccactgcgcacggggcagcccccacgtccagcctccgtcttgggggcgtggacccttgggstgcgcttcctttcccgcctcgggtctccgcgggttctgcaggaaccttgcttcctctgacttggtccctggtgtctctgtgtgtcggacagttccctctgttgtccctgcctgtaatcgctctcagggttttggtcagtagcctttcttctaccccgcttctccttctgcgtgttactcttttttgcttagaaatagtttccgattgcttttcccaccgaggtctaccctagcagtttcttcctcagtattctgatgtagcccctcaccatttggctgaaactgcgctaactttaacagtattttcactcgtgtaaataatgtcttgttagaaacaaagaggtaagtccatgtacaatacaaggagacgtccttgatttgttaagagaaaaaaagaaccaagtaagttctgtgtatgatgtgaacacacttttgtacagttaaaaagaagtgacctggccgggcgcggtggctcacgcctgtggtcccggcactttgagaggccaaggcgggtggatcacctgagcccaggagttcgagaccagcctggccaacatggtgaaactccgtctctactaaaaatacaaaaattaggcgggcgaggtgcgcgcctgtaatcccagctactcaggaggctgaggcaggagaatcgcttgaacccgggaggcggaggttgtagtgagccgaaatcgcaccactgcactccagcctgggctacagagccagactcagtctggaaaaaaaaagaaaaaaaaaagtttgatgtaggtggggcgcggtgggtcacgcctgtaatcccagcactttgggaggccgaggcgggcggatcatttgagctcaggagtttgagaccagcctgggcaacatagcgaaaccccgtctctataaacaaacaaagccaggcgtggtggcctgtgccagtggtcccagctactcaggargcagaggtgggaagatcgcttgagcctgggaggaggaggttgcagtgagccaggatcgtaccactgcactccagcctgggagacagcaagactgtctcaaaaaaaaaaaaaaaaaaagcttgatgtagattctttcagcttatttccactcttgtaccaatatatagaacttttttttttagcttttagaatctcagcaatgagactgtacccaacatcctcatttgagtttatatattgggcactttttaaaacctagtgcatacaggctgggcgcagtggctcatgcctgtaatcccagcactttgggatgccaaggtgggtggatcacctgaggtcaggagttcgagaccagcctggccaacattatgaaaccacatctctactaaaaatacaaaaataagctgggtgtggaggtgcgcgcctgtaatcccagctacttaggaggctgaggcaggataattgcttgaaccatggagacgcaggttgcagtgagccaagactgcaccactgcactccagcctgggcaacagagtgagactccatctaaaaaaaaattaaaaaaattaaaaataaagactagtgcatacaagttctagctcactgacttaaaggactgtatgttatttcattatatagttggtacgaccattatttatataaagcctcctattggttgatttttctttttaatatttgtttttaattgacacataattgcatacaatttgagttacagtgtgatacttcgatacctgtatacaatgtttaaggatcaaattagggtaattagcatattcgccccaaataatcatttcttcatgttgggaacactcgcaatcctctcttgtagctatttgaaagtataaattgctgccaacatggtcacactaaggtactgtgtaacactagaacttmttcctcccatctagctgtaattttgtatccattaagcaacttctccctagccccctacactctactcttcctagcctccagttaccactattctgctctctacttctgtgaaatcaacttgcttagcatccacatgttaacaagaacatcttatggtgcctggcttgtttcacttaacattatgttctttgggctcatccatgttcctgcaagtgacaggatttcatggttttttatggctaatatccagtgtatatatgtaccgcatttctttatccatctgttggtggatccttaggttcattccttatcttggctgttgtgactagcagtaaacgcaggagtgcaggtatctcttcggcagactgatttcatttcctttggatatatatacagtagtgggattgctggatcatatggtagttctattcgtagtttttttttaggaacctctatgctgttttccataatgactatactaatttacattcccaataacagtgcagtgtataagagttcccttttctccacatccttgccaacatgtttttttctttttgataatagccattcttactgtggtgagatgatacctcattgtggtcttgacttgcatgtccctaataattagtgatgttgaacattttttcatgtacttgttggccatttatatgtcttcttttgagaagtgtctgtttggctcatttgcccattttttttttttttctttttgagacagagtcttgctcttgtcgcccgggctggagtacagtggcgcagtctctgcttactgcaacctccgcttccagggttcaggtgattctcctgcctcagcctccaaagtagctgggattacaggtgcctgctggctgatttttgtatttttagtagagacaaggtttcaccatgttggccaggctggtcttgagctcttgacctcaggtgatccacctgcctcggcctcccaaagggctgggattacaggggtgagccaccatgcccggcccatttgtccacttaatttttttttttttttttttttggctgttgagctccttgtgtattctagatattaatcctttgtcaagtgaatattttgcaaatattttctcccatcctgtgggttgtctcttcattctattgtttcctttgttgtacagaagcttttttgtgtaatagaattccatttgcctatttttgcttttcttgcctgtgtttttgagattttattcataaaatctttgcctagaccaatgtcctgaagcatttcccctgtgttttcttgtagtagtttcaggtcttacatttaggtctttaatccattttgatatttatatatggtgacagataaggatctagtttcattcttctgcatatggttattcttacagttatcctatttttccagtaccatttattgaagagtgcttttttccccagtatatgctcttggtgcctttgtgaaaagtcagttggctgtaaatgtgtgaatttatatctgggttctctattctgttccattgatctatgtgtctatttttatgctagtaccatgctgtttagatattatagctttgtagtatatttcgaggccaagtagtggtgatgcctccagctttgttctgtttgctcaggattgctttggctattgggggtcttttgtggttccatattaattttagaatttttttttgacatttctgtgaacaggatcattggtattttgatagggattgcattgactctagattactttgggtagtatggtcattttaatatttatttttcttattggtggatatttacattaattttgcctttgttgctgctataggcagtgttaaagtggtatttaataaataatttttatcagaaatttctaatagccacatctgttgtacacttttcatttgtcttttttatttttttgcaacaaagtcttgctctgtcacccaggctggagtgcagtggtgctcactatagccttgacttcctgggctcaggcagtcctcctacctcagcctcccaagtagttgggactgcaggcgtgtgccaccatgcctggcttatttatttttaattttaatttttgtggagatgaagtctcactgtattgcctgggctggtcttgaattcctgggctcaagtgatccttccaccttggcctcccaaagcgttgggattacagacgtgagctacccatgctcagcctgtcatctttcttgattcccatgaatatctgctgtgtttggctttttctttcttgatattctttggaggctgggaagataccgctctgtggtattctctcctccctttctcccttcgaagtcctaaccaggcctgaccctgttacagcttctgaggtcagatgagatagggtgcattcagggtggcttagctgtagactctcgttttcttttttttccttttttcgagacagggtcttgctcttttgcccaggatggagtgcagtggtgtgatcacagctcattgcacccttggcctcctgggcccaagtgatcctcccaccttagcctcctgagtaacggagacaaactttatctatttttcgtagagacagggtctcactgtattgtctaggctggtcttggactcctgggcttaagcagtcctcctgcctcaacctcccaaattgctgggattacaggcaggagccactgtgcccagcttctccttccttttgctagatctctctcttgaaatgtggtccttgacttttattcctaggtaggtgatctctctttcactttaaacttttttttttcttgctgacatccaactgtttagctccagcctctttttgagcaccttagacacaaatgtattttggggtcaggtacaacccagaaaattcacctctccttcagtccctcctgctgtgttccttacacatatagcatagccgtaaagttagacccggattccaaatctgcctctgctacttactagctgtggaccccaatggacaagtttattacaagaaaatttaatcctttcatctgtaagtggaattaacagtctccatgtcatgggggcttcgtaaaggttcattgagccactatgtatctcactgtgtacctggcacagtgctcggcacttagtcactggcagctgttgtaactgccacctacatgactagaacctttccgtagcatattgtcaaatctacattttaagtctctacaatctggtcctgcctttatgtcctcagaaccctttcctgtgacttcatgctctgttgatactgtcacccaggctggagtgcagtggcacaatcacagctcactgcagccttgacacactgggcttaagggatcctcctgcctcagcctcccaagtagctgagaccacatgtgtgtaccaccatgcctggatgattttttttattttctgtagagacatagtcttgctaggttgcccaggctggtctcaaactcctgggctcaagtgatcctcccaccttggcctccgaatgttaggattacaggcgtgagccagcacagctggccttctgttgactctgtaagttctttggtggttttgcccctagttttatcccatctggtatctggtttacagcagctatttcaaacacctcagttaattgtggtgagaattttgtaagattcggcagggtagggaggatggggacagkttcttggggtgcatgaatgagtcctgctttctcagcctgctggcggttttccttaatctytctcttgctttgatctctcacttcttccacattcctgggcacccacccacatcccttaccccagacacttgcttcctacctagatgctaccttggtagggaggtgcagccttgtcgctgaaatggaggtaatgtgggcctgggatttgtgtctttttcagaacagtgcaaccctgaaactcgtcctgttgagaaaaaaataagatcagctcttcctaccaaaaccgtaaagcctgtggaaaacaaaggtgggttggttgacttcaaacaaatctacaagggacttcacatagaataagtcgaaggaaaaggggagagtggggctggtcagggaatccagaacaatagcttcattgggaaggaacagcttccttagccytgagcatcaggagtggggccatgtcatcatgggtgatattgaggcaacagcctgaaagcagtattcaggagaagaaaaatgggcagaagacagagatgagaaaggccatggctgtggtttgggggtttgcggtgggccctgctggcaggagccttctctagcccatagctgctggwswccctccatgaatctggctgggactgtcagttcacctgaactcagcccaggcaggaggctttctttgtcctagatcatctcgctgctgctgggggttcagagctcacagcagtagtgggctgtcaacccatccgtccagccatctaaacgttctttaatacctcctgggtgtcaagcaccatgccaggctctgaaagcagcccctctggtgccaccaaagaggtattgaacattcactccaaaggcatggcccatttttgccctttgagaaatttccaggttgggttcaggcaatgccagcagtttctgcccatgctgaaagcacaggagattctacttggctggtttttacagagcatccagttaattggcccatcacagggttggagccatgttgaggtggggatgggtattaagttattagacaaccggggtctaagcctaaagaccacaggaccacatatacagtaaggktgtgaacactagagtgcatttgttaaaatcaccaattctttcacttagcctccctcttctaaaaaaggagtgttagtatagtcacagactccggagaagaggatttttgtctgtacctgcttgaatacccctatcactatcacatgtgcgtgcacacatttttatcctgttsaagtagtggttaaaatctggtgcccaggcctcctttttagccatgagccattgactgttttgtattccttagatgatgatgactctatagctgattttctcaatagtgatgaggaagaagacagagtttctttgcagaatttaaagaatttaggtaagtctgtgctatgcttgtcaatcgttgagatacatttactgtgttgtaaggattgtgattttttaaaaagtttttaatttcttgaataagtatggcatgtagggctcttactrtctagccacataatctgtaaacatacagggtttcacacctcccagcctgcccacaccattccttctgcctggaatcctgctggtcttgtgggttggcaaaattctgctcctccttcaagccttggttcaagttttcttcactcagctaagcttttcttgaccttttgtgtctctttcagaattaggcacttttttggtttcccatagcaacttggacttaatagtaataaatcactgttacatttcatggtaatttgtctctcacataccgatttgtacagcagggacctgtattcccagatccccagtgctcagctcacagtccagcccttaacacaaactggttatcacatgatttgatttagggggaaacaggtgttgccatttttgtagcactgcttattcagtccttacaacattctgttacatgtgcatggggtctgttaatttcattcttcccatttcacagaatcatgttaaaaggttatgttttgcacttagtctcatggtaatgattagttagactgagtttggagatgagctagtaataggtgtgaaaaattttacagactgtgaagtaccatgcaggtattattgttggttccctgctactggtgctgctgcatgccaaatggcatgcttagacatcattcagantatttcgtatagccgtcttcaccactggcaacttttatggctagaaagaaagaaaacatgccagcagcttaatgctactatttgctttgtgattgtgctgataaagcatttttttcttagctgaagtggcacgaagttacaatatttacaaagataccaagaactggtatctgttactgcatttaatgcggaaatagtttgatatgctggtcttacctttcrttttatagaggtggggtctcgccatgttgcacaggctggtcttgaactcctgagctcaagcaatctgcccaccttgacctccccagttgctggtattacaggcatgagccaccacaccttgctgatagttttattacacttgaaatagctcttcacttttcagccatctccatgtgtttccacttgaactcagactggctttttttcttgttaatttttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttmaggtggcaagtcctttatggagagaaaacttgacattcagatgattgtttttaaatgttttacttttggtacagttgatagacatcataaacgatatcaagcttacacttcatatggagttaaacttggkcagtgttaataaaatcaaaacgtgattctactgtacattgcattattcataatttaattgtttgaaattacattaaataaatcaactaattaaatactaaagttttgttcctttttaaaggaaataaccacaagatttttcccagcccaaattccagcgccaattttaggccaactttggctgttttcttccaaaagtgcttatgtggaattgggatccccagtgtagtgacagacagtcatgactgctgctgagtttgatctgtgaaggtagtgaaatgtggccctgatgtttcttaaccctgatttggtaactaccagccctgacaccatcagtgcttgatgtagcctggaaccccaggcccactgacgcactgggcacggggctctgggtcgaaggctggagccgtcactgttgttcatgtgcatttggagcactgtgggaatagtctggcagctgtgtgctgattaaatgtctttggcaaggcagggggcaggaaaaggccttgtggaaacaaaggcaccaaggatcaccccagcccagtgaaggcagaagaggtcacgtggatcagcctgtgtctttccagcagaatctgattaaagcctgtaatgctgtagggtgaaggttcagggcagatgtcagcataccgcagtggagactttctgcagtgaaactttatcgatccctagaggggagagagagatgcagctttagcactagttcctgggagtgccagggcctaacaaccccacagagcagacgctaaaaatgcaagaaggtatggacaagtactagtattgggggccacagcaggattaaaatagcattacatccactcagtgtgagacagatgaggaaaccctaggaggaggcgctccctaagaggaatgtctgtcacattcctatgactgcttaaagccagaagggcaaaacatttacccttctgtttagcaggcctgtgtgttttcatgggagacttcatccagattaaggcctatagttattcctctgaatggaaatttggtgtttccttctgccttgtcatttcacttactccttgctgtgactccatgcagtaggttgagtattagcccattttatagacaggctccgagaaaatgtgtcttagccaagatcatccagtgaatggggcagaaccaggatccagaccctggggttctacctcccagtgcaacatactttcacctttcctcggccactttaattctatgaggcctggcttactggggtgactcacaaagccctgagtgacaatgacttcctgagtgtgctggctgacttttccctggatgcttatataaaaacagctgggcacggtggctcacacctgtaatcccagcactttgggagggcaaggcaggcagaccacttgaggtcaggagtttgagaccagcctggccaatatggcgaaaccccgtctctattaaaaatacaaaaaaaaaaatatagccaggcatggtggcacatgccctgtagtcccagctattcgggaggctgaggcaggagaatcgcttaaacccactgcattccatcctgggcgacagagtgagactccgtctcaaaaaattaaataacatgaaaaaaaaaaaaaacccacagagaacttggaccactgaccctgcttgtcatttcgtcagccagaaaaggaaaaaaccaagcaatacaatttggggaaaacatggtgccaaatccagtgccatttgaggtaacaaactcctcacaacccaagttgtgatgtgggactaattagattatttgctctcaagtcttgggtagtttcttttttgctatgtctcgtgaatttttcctcttttctgtaattgacctattattaccctaaaccaaacttttttttttttttagatggactctcgtcctgtcacccaggctggagtgcagcggcgcaatctcggctcactgcaacctctccctcccagattcaagcaattctcatgcctcagcctcccgagcagctgggactacaggcgcctgccactacgcccaaccaatttttgtatttttagtagagatggggtttcgccatgttggccaggctggtcttgaactcctgacctcaggtgatacacccgcctcgacttcccaaagtactgggattataggcgtgagccaccgctccaggccctaagctaaactttcatcacctcctgctcctgactcatctaaagccttggttctcacagtgtggttcatggagcatcagaatcagctgggagcttgctagaaacgcagcattgcatttggaaatgggactagaagatttagagatgctgaaataattagaagcagtttttaaaaagataaagggctctggaagattcccagttataacaaaataaataatccaaacctgcagctgattgggacatgcagccctctggtttacccagtagggttagggatggatcttgtcccagcctcagtctcattcccgctgtgaacttgtaggctttgctcctgctgttctcaggaacaaagctgtcatggccatcacacacaacgtacctgaggcagcgctcggatggacgtgacaccagcctggtcttgtgctgtctggacagtgtagctactggggctgcccctggggagctggaggcaagcccagaccactaatttcctctgaaagctgcctacacccatagccgtattggccaggaccagtcccaggggccagangcggattattgcctccaggagcctggtctgcagcggcgaggtgctcagggaacagggagcttgagagaagtgtttttcttccacaccatccagctctttagcagcaaggcaggccattctgatcttaaaaagcaaatatccctttatagctttagatttatctagccctcttagcagaaaatggaaatcaaaactatctttaacaaatcatcttaacaaggtgaactgaaggcacctggttgcaaacagctggctgccctgaaccaaactggttccatatgccacaagtctatacaccccaggcaactgtgcttaggccttacatatgctacttgaaaacaagataagagtccatcaagatataactgatatgccataaaacccagtcttctaaagtgtacatcccagagtttggtatattcccagagttgcttataccactcttcacctacataaccaccctgcagggtaggtgttactgtgcccactgcatacatgaggaatatgaggctcagagaggctaaacaacctgcccaaggccacctgcattgcagtggcagagccagcattcccactcgggtccatctggtccccaaaattgatccactgcccaccccgacttcttgggtcttacttactctccacttctgccatgcacgcttgatgactgtggcagctgcatgcagcctctggatgtgtttccgagttaaccaggaacgaatggctaagaggtttgcccagaaacaggaaagagataataaaggggccattagagctgtcagtgacctcgctgcagcagcaccacagttgctgtcaaagtttcaaatacgttttttttttttcaataaattgctacaaataaggttctaaaatcaatacataaggcaaaattggcttttaaacattccttacactgcccacacacttgaatacacctacacaacacagtgaaggggcactggggagaaggactggctgagggcccagcaatcacttcccgtctcaggctgggtccaggtcagcacccagggaatgggaggggtctggattgtctgtgcctttaaaaacttttttttttgttttgtttttaatcctcagttgaatttgttcgctttatgcatccctgatctcacatcaccatatacccaaacactgatacaattaatagatggtggtaatttttattcccttctctgcaatttcagcatattctttttctttttggttccttttttttttttttttttttttttttttgagacagggtcttgcccaggctggagtgcagtggcacgaacagcttattgtagcctccgtaaggctgtagcttcaatctcccaggctcaagcaatcctcttgcctcagcctctggagtaactgggactacaggcatgtgccaccaggcacggttaattatgttttgttgttttttttttttttgagacagagtcttgctctgtcacccaggctggagtgtaatggtgcaatctcagctcactgcaacctctgcctcctgggttgaggtgattctcctgcctcagcctcctgagtagctaggattataggtgcatactaccacacttggctaatttttgtatttttagtagagaaagggttttgccatgttgcccggctggtatgaaattcctgggctcaagtgatcctcccacctcagcctcccaaaatgctgggattacaggagcgaactactgtgcccagcttccttatacaattttttaatgcctacacacacacaaacacaccttaaaaggagggcatcgcccttaatatgtagtttgacatctaggtatgaatatcattttggaagtggttctccattaaatttataatattcttcaaaaacacttagctgcatcatagggatggtccagtccatcatttggccatgatgtcaccactgttagatatttgggttctttccaacacttttccttttcaaaataagaccactatgaacatgttggttaatacatcttttcatctgatgaactccttttggtttttaccttctccttaaattcattccagccctagagcccagcaggtaatggtttgagttgtcataaagggaaaaaaagttggcctaaacagctgtcagggtctgagaaaggaattaaagacaacgcttagacaacgcttagcctccacttcttacagagcacctttgtttgtggagtgacttggtttccattgaactggagagacgttatgagtgagggggacagggaatttgaatcccagcacaccacagggacatctcttcaggctgggacacagcttcaggagatggggactcgacgagctatgtttcaaaggaaaccaacatcctgtggggtctgtgagcagtgctgacaggtgacctgcccacctacctgcctggatgagcatgacggcccgccrctgccgctcctgctctcggtgccggtgtcgcctccagccaccctggatgcagcgggcacactgctccagcacccgggcacgcccacattccagaagctccagctgggagaaaaggcatccattgagggcagcctcttctccccctgccccctcctgctgaggagagcacacagcttgcctctgtaacctcctcatccccaaaccagctcaccatagagtcagtcatgaacaccttggtcctgccayagtgcatgggggctggcatggcctcagccgagtcaccagttatggctgctgcctgagttaggaccggcagagtgtggagaatgtcctggatgagaggttcaagcgtggcttcctcgctgtgtggacaccattctgggggagggagatggccccatcagtgcatggtcatctctacatgcctctgtggcctgaagaaactggctttggcctccctagcactctacaggtctctttcctgctgttcttggctctagccattttctccttgttcttcttttggaggaagccacaaacagcctctctgttgtccctcagggtgctagctgttccgtggagccttggaatacccacttgcgcctgtgtgtcctggggtgtcccacagcctctactgccatgagtccctttgggcaggctggcagagggtgcttgacacctggaagggtgactccttccaagcttggaatcccaggctgctcagccagcatttgtttccaaggcccaaacacacatcctgagggccaaatagggcagctataggccactccctcagccccgacccctcaactccccaccatgtatgggaaaagggagatccaatcccagcccttagtttgggaatcttctactgcaaataaaaagaataaattaaaaaataaatttaaaaaatcccagccctgcaaaggtcccgtgtcccactgcctgccctcccgcagctcgcagagctgactcctggagaggtaggatttacctgagggctctgaccaccttagatgcccagtgcctctctgaagacagaggctgccaaaggagacaccacagatgagaaacagcagcaaaatcaaccaggggccagaagggctatgggcaagagacacggaacaggacagcaaaccatggagagggagaagaaaggagaaagggtgaaaggaaagtgaaaactgcccaggaggggaggaaacaaagcaggattgccccaatggctgtgaggggcccagggtaaggctgggtgggaggggcagaggtgctgggctggggtcctgccgaggcggggccccccggcagcctgtccttggcctgttctccctctgcctgtgtctgggccctgtggctcccacagcctctcttttatctgcatgccgacaacccccatatgagggcctccagatccttcctttgagactaaagcctgcctaagtgccttgcagacttcttcactggacctgcaggacaagtcacccatgcccgggctcttcagcctccctgaac

SEQ ID NO: 10722 - DNA, 109977 bp, Homo sapiens
  misc_feature (1)...(109977): n = A,T,C or G, or insertion/deletion polymorphism (see Tables 1-2)
atcggtcaatggtgccttattcagtccattcagtgaggccatgttttcctggatgttcttgataattgtggatattcgtccatgtctgggccttgaagatttaggtatttattcccatctttatagtccaggcttgtttgtccctgtccttgagaaggttttccaagaattcaaaggggattgagttttgtggcctaagcctgtggttactgcagccatctcagcacttgggggtgccctaagcccaggaacactgaaactcttacagactcttaggtacacagccttggtgtatctaagacttgggaagataggggagaattccctgggttaccaggcaaagtctctttctctcttccctctctttcccaaatcagaaggcatctctctccaggcttggctaactggagctgggggaggagtgatgcagacactctactggccacagctggcattacactgggtcatacctgaagcccatggccttccagaccagctctgtattggggctcaccaaggcctgcagccactactgcctggttatgcctgcagctaatgtttattcaaggcccaaggccacattagtcagcagatggtgaatcctgccaggaccaagtccgtaccaaccgggcagtggattcccttctgacccaggatgggcctagaaacactatccaggaacaaagcctggaatcgggggcttcgggaatctgtttgatgttttatcgtattgtggctaagctgatacccaagttgcaagacaaagtcctctgtgctcttctctcttctttccccaagcagaaggaatctctccccaagcatcagtacctgaagtttgggaaggagtgacatacatactcctgtggctgccacagctagtgttaaactgtgttgcaccctaagtccactgcctccaagaccaggacagcactagaccttgcccgaggacttgctaacagaggaaaaaaaatctgtgaaatatttcagagtggaatattttgagccaatatgagtgatcatggtcttgggaacagtcttaagaggttctgaggaagtatgcctgaagcaggtaggttatagtttggttttatacatttccaggagaaaagagttacaggcgaagacataaatcgatacatggaaagtatatattgattcagcccaaaaaagcaggacatctccaagcagggacttagtagttataggtgggtcttaaggattcttcagttgacaattggttgagagggttaagctattgtctaaaggcttaaagtcaatagtaagtaatgcttgagttaaaggaggttgtggggtccaaggttcttgttacgttgatgaatcctcataggtagcagccctccgagagaatcaatggcaaacgtctgtctctttgcagacctttgagatgtcagactctcagttcaactctgccagaactgggaaaagcctagaaagggaaggcctggttgcattaatggagattatctacagatgcaaatctcactcacaaaagatagctttgcagggccatttcaaaatatgtcaaataaatatattttgaggtaaaatatttttattccctacagggtctgctatctgtcatgtgatgctatatcagagtcaggttgaaaagcaaaccatattacagcaggtttatttttatttatttatttattttgaggcagcgttttgctctcattgcccaggctggagtgcaatggcacgatcttggctcactgcaacctctgcctcccaggttcaagcaattctgctgcctcagcctcctgagtagctgggattacaggcacctgtcaccacacccagctaatttttgtatttttagtagagatgaggtttcaccatattggccagactggtcttgaactcctgacctcaggtgatctgcctgcctcagcctcccaaagtgctgggattacaggagtgagccaccacgcccggactataccaggttaacttttaaaactcatttaatgatattttatggtttgtagggtgtgattccttgcatgaatggcctgaggtcttgtttataatttggtatcttattgccacagagtctgttttgtccgtcttatgatattttaacttgaatgctggtcagttgtgcctaaactccaaagggagggggtataacaaggcatgtctaacctcccttcccatcacggccaggaattcaatttttaagatgtttctggggtctctttggccaagtgggagttcattcagtcaatagggggcaagttgggggtgcttagcattttatgtttagtctacacactttagtccttgtgtcctgactgccactcaaatagactcaggacctcagaccactttagttagccagtggtgaagctagccatgacctgggtttctccctctggagcacagaattctcctctgtcccaaggcctgcctaaatgcactgtcagaattctaggcacctgcagaattctgtcctgtgttatgttccaccgtgacggggcagcactgacttccagtgcaaagtcccacactcactttgctctctctcctccaagcacacggattctctttcctgctgtgcagcctgtggttggaggaggggtggtataggcaatacagggagatcttcccccctacccccacccyatcttcaatgcctctttccttatcattacggtaaaagtaggcactgtgatcactcacctgattttatggcttttatgaaggtgctgtcttgcgtggatagttgttctatttggtgttcctgtgtggagaactatctctgggggggttctattcagccatcttgatccacctccgccctctctccagtcagtctttaaactgctggcaccgaagcctccagtgcctttctcctctatatcccatggagagttactgaagtagttctttttggatttcagttggccttttagtagagcctttctcctaaaggattaaaacgtgagactgcgggcttgagccaaaaagcagtcagagggacaaatactgggttttacttagaataacccacctgcctagtgccagcctaccactcttgaacaaaacttgtatgattcccgtgtctccatttagaataatttaattctgaggagacgcctctgtttctccactggcctctggacatggaacaggcacatgaaaattacctggggcagctatgggtcacatcacctctcttactctagccagccagcaggcacttgaagttcgcaatctgatgggctgaatttctgaaaacaataacaaacacaatgtcacttattttttattctctaaatttacaacccattaatatacctccctgtaagctgtctgattttgaaaattatacatgataaaatctttttattatacataaaaaagagttctgtagtttgtattaatagaaaattggtgtccagacatattttaccaagtaagtacaaaataactaaagaatatccatttgaaagatacaaaattattatcctgctaggagcaccttggtgtcaaggtgacttcagggaataatcaggtaattcagctccttggccggagtgaagaatggaatgttgaggctggagaactaagcagggctcaagaggggcctggtgcactaggctaggtcatttgggctcaatcatgaggggacaattgaggcagcattagcaggaaggtcaggtgaccaccaaactttctgccagatctgagtttcttctcttttagaaatgcagtatttgtataaaaatgaaaggcttaccaaaggtcacattttaaattataaagaaaaaaaatcatcttttttttttttttttttttctgagatggagtctggctctgttgctcaggctggagtgcggtggcgtgatctgtgctcaacctccacctcccaggttcaagtgaatctcctgcctcagcctcccaagtagctgggattacaggcacccgccaccacgcctggctaatttttgtatttttagtagaggcgggttttcgccatgttggccaggctggtcttgaactcttgacctcaggtgatccacccacctcggcctcccaaagatctgggattacaggtgtgagccagcgtgcccagcctcaaaagttcatctgtgagccacatttagaaggtagataaaaaattttgactaaacacagcttagaatctataaattgttaaacttcagttctgttgagaatctttgagatccatcattctctaaatgttttctaccagagaaacaggacaatggcttgcaaatattggttatcagtatttactctatagctcaagcaaacaaacttatttgcacttaaaatacaaatattacctaccttgatttgagtgttgttgttctctcttaaatttcatttcccaaaaatgatggcaaaagtactgtttgttttaacttgacccatcttttgcaacccagcttaatcatttcacagattcccttttgaaataaatgggctagatgatcagacaatagtggcaaatgtttgtcatttcaatgacatatgcaagagatacctttagtgaaatttgtatatcaaatttccctttgtgctccttttttccctagtgaattcagcattaaagtgtttataaatatttttggtttattatttattaattcaaagcaaagaatgccaatgtgaccataaatatctcatttatatatcataaatatctcattatagaaatatgtttagagacatctgttttattattttaaagaagagtacatattatatattaaggtaaaaatagtactaaaaaagagaaggtagtaaataaaaaaattctaatgaacataaaacatcataaaaattaacttaattaaaaatcagccaggcacagtggctcatgcctgtaatcccagtactttgggaggccaaggtgggtggatcacctgaggtcaggagttcgagaccagcctggccaacacggtgaaaccctacctctactaaaaatacaaaaaattagctggatgtgatgggacatgcctgtagtcccagctacttgggaggctgaggcaggagaatgccttgaacctgggaggcagaggttgccctgagccaagatagtgccactagactccagcctgggcgacagaaagagactctgtctccaaaaaaaaaaaaaaaagtataaagataaaattttagtatattgtgaattaattactagactcaattgttataggaagctttgtttttctggagctcttatattaaaattattaaaatcctcactgaaaagtataacatgtgttttctttaaaagaaagatattctatatctgaataaagacaaactttgaacgagtggtatatgccttaataaatattggagaatatctattctccaatacttagagaatgacgacagcatcctccacatggcgttttcattgccagtcacaactttcctccacctagtgttctctagactgagacagaccaaggaacaattccctagacctcctttgcagagctaggttatgctcagaccatttgcagcaccaaggacactgccattcaggtcaccaaaaaaagatcatcttgtgagccctgtctaaaccaggccccttctaaaatcatttcagtgtgaaactgagtccaggtgggtcttcatcagtattagagtggacctgccagatgtatgcttgcagatgatgcaacatcaaagcaaatgccctgggcaagagaagaaaggccaaagcaatgggcttactggtttctagctttgagccactcttcatagtgccaaattcccattttagggtccctttatttgtattaataaaaataaattccctgggtgtaagttcctgtaaagtactccctatctgtattcctgggcatgaaagggtgttttagttccaattctagttttcccacttagaggttcacctttctgacattaataattaaccagattatctgaattcttcaagttcagtttatttaaaaggagactatcctcaaaagtgttatatccgtggtttcctgctacctccaaccatgggccttttkggaatactttgttttttaatcttcctggggaaaacctggggacaggagcaaacgtaagtaaaacaagctatcttcatttttcaatgcatcttagttatgacgaatgaagagttaaatttaacagattctgttaacttgaaaataacttgctacttctgagaacagcaagtgaatagtatcatctctgaatgagaaagtcatggaagcattttgatttgatgagtagctaacaacatgacagcttttatggaattgttatttattaaaatttacgtaagtgattattcaaattcctcttcaaaaaagcacaaaagaaactccagataataaactttcttgacattttttgcttattttaacttggtgtttagttttctttgtgtttttcatagactatacacagttaaaccagggttatttaggagtcaatctaatactgtgatctgaaaatctgttgttgtagtgacttctaccatacatttatgagctgacttttcacaatttttagtgtcattattgagataatatgcattttaagtaatgttttaaaaataatgatcttatatctagaaatattttaatactgaaaagtaactgcagatcatctaatcaaacctattcattttatatatgagaataagtccagataagggaagtgactgaccaaaggtcacagttctagagagagagaaacaggatttttattaaggtctcctgtttatcacttcaatttttttcattttgtcataaatgtatacatgtaaatatattatatataaacacatacttaggatgtcattcttttttagcaccctcgtatttctgatctgtgatctttttacatggccacaagcactcaactaccttagcatcctgcctttattctttttgaaagacgagcagctaaggcttagagagactgaaattaagtgacttcaaattggtggcagaactagggctaggacctgggttccatgattcttgtccagacttattctgaattctttctactagcccttaataaaaattatttcctcactttctctgaagaagtcagagtgtaccatttacaacatggcaatcaatcactttaattaattggttgattgattgattcaacaaatatttattgagcatctaaacatatgataggcactgcagatatagcaaacggtaagacaattcctagagcttgcattctagtgggagaagcaagtaatgaatgaatgaaccaatgaaagaatgtgtaaggtcaggtaggtagtattatgaagaaaaaaataaagcagagtatgagaattaaaaaataattatggggcactattttaaaatgtggccaggaaaggttctcttaaggaggctgcactcaaacagagcctgaaggaagtgaggaagcaaaccatgcaaatatttgaggaaagagcattccagatagaggccaaaataacattcttgcctctctgcaagctcagtaacctgatcctctgcagcaattgaaagacaaagaaaactatgaaattatttatatggatagwttatgctactgataagtcaataagaaccaaaatctttataaagggtggttccagaatattcttttaggggcttctaaacactatgtatttttgcttgacrgctaccatcacatagaccagcagtccccaaccattttggcactagggacaggttttgtggaagacaatgtttccatggaccaggattggggtggggatggtttcagaatgaaactgttccacttcagatcatcaggcattatattctcataaggagcttgcaatctagatccctcgcatgtgcggttcacaatagagttcatgctcctaggagaatctaatgccaccactgatctgacaggaggcagagctcaggtggtaatgctcctttgccccactgctcacctcctgctgtgtngcctggttcctaacaagccatggactggtatttgtccatggcccaggggttggggacccctaccatacacaattcaaaattaaagcaatactaaacttaaaaacataaagcttctataaatactgaaattaaagtagcrttatatccctaaatttttctaattacaaaactctttataaattccatttagtacaacagttgaaaatgttaattctggaaacgggctgctcaggttcgatttctaattctataatttgtgaattatagaattcataaatcctatatgtgtggccttgggaaaattaattagcagtttcttcaccttaaaattggagtaatagttcctcacagagtggttgtaatgacacaatgagtttatacaaataaagtattcagaatagtgccttatcacagggcaaaatttcagtaaatatatcttattatcataaaaactgaactcctctcattttctgccatctcctactaggcatgtggggaaggggaattcagatgatggttggaaatctggaaattctttcctctcttttgtaatttgcctgtaagtggatccaaattaattgtaatgcaggataactgtcagatgctttaaaggatttaattgctgataaattaattccattgttactaaaaacttcctgcttttaccagactcttaaaatgtcacaatgttggcaraagcctggaataattctgccaggtggggtggtgggtgccctccaagcttgttgggccacttgaattagtcgatcactatgcccttttgggttaaaacacttttttttcctatgtaatagcgtatgtagttctcgctattcaaattagatactnttgtgatatacacttagtaatccagtttatatttgtaagtttttaaataaaataatttttaaaaatcactcaaaagcatgtatagactcacttccattattgtataaatcacatgaaaagtaaaaataagagaacagtctatggttgtgaataacatataaacttgacctcaactgtacacataacaactgagaactcatataaaggcctcccccatttacttacaaaccgtataaccttagccaagttagccttttaccacttgcaaagtacgaataatgatagtaccagcatcattggcttattgtaaaaattaacaagagctgtatgtaaagtgctgatacagcctctgatatgtggcaagtacttaattaccattattgtttgaagatgatgatttgctcttaaaggaccatcatcactatttccatttccaaatgcacttcccagctcactcatattctatcctttccgttatccgtttactagtataacatagtatttctaagatcactccctttaaactaatttagtgagattaataaatcttaacatgtattgagtactaagagtgctagaccttttcatatatatgttcttatttaatctttaccagagcctggtaaagaaggtgattattttcacagtaagttattttagcctcagaaagacttagtgactttaccacggtcactcagccagcagatgccacagctggaattcaatcactgcttttttcttcattgagcaaaaaatattgaccccatttacattttctggtcaacatgattaaaagtcttccttggctgcagtagctaagagaaagtgctgctatcaccttaactttctaaatgtaaactaaacctccagcttctcaggtcttaattccaaactacttggaaattatgctgaagttatggtgggtcacaagtacattttgacttattagtatcatttttaagtgaggaaatatatgtattttaaatggaatctctcaagtgagagaaaaaaatcaaaagtaaaagaaaatatgtcatataaagacattgagccttatcttttcctttttcaacagatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattycaaaactctgcaatcttaacagtatgtatttatcctttattttctttatatatatatacagaatattctcaataaaaatgtgtacaaagtttgaatattgataacatatagatttaatcatttacatccactgtgggattattagatgatgtcagtcactaatgataatgtaagtgaaaattctaacagaaacagaaaattctaaacagaagttatgtctgctttttgagcaatgcatgtccattttcacattcttattggaaaataaagttgtactaatgtgaaaatatttggagataattgaaaatacttgtttgctatgaaaattactattagaaagaaattgagaaatatgagtatgattttatctgtagtacattgcccacaaaaatccatggatattattgaacattcgattgaactctaatattctacaattatagtttcaaaaactaaaaaatttgtgattactaaagtgaatagctctcattgacaacctgcagttaatagaaagaacaaccttgatcaaataactctcctattaagatattgtagtatagattgcttagagacatacttgcaacttatttttactaaaaattctgatacttaataaagaaaatcaaagaatatcagacgtaaaatgggctctgcagttcatttagaccagagtttctctaaagtgagttctttataaagaaattaaaaatggaaatttaataaagagcttaaaattcgaattatattgattttgtaacattttgaatttattttataaatttgttttgagtttttaattatacaaaaatcataagcataagattgtaccgttttaagtttgtatatatttaagtatctttgtatcaaaaattattttgattatgttataaataataaaaagccaatgctgagggtcctccatgacttttgtcctttaaaaggactatgcatnttactcaagtttaagaaacactaatctaaaaaatttctagtcaaacataggaattctttaatgttcttagcagtaaatgctcatatctcttaacaaattcttccacttattaggtttgttaacaattaaaattcatttattaaaagtgttacttttatggcatatgcctgtaatcccagctactcgggagactgaggcaggagaatcgcttgaacccagaaggcggaggttgcagtgagccaagatcgcgccactgcactccagcctaggcaacagagtgagactccatctcaaaaaaaaaaaaaaaaaaagaaagtgttactttcaaaagacactcttttatctgatacaatgtatttgtggctcttagttttaaatttaaatcaaacaaatttaactgaaattaaaaatgcagtatctcagttgcactagcaacatttcaagtgttcaaatagccccaggtagctattggctaccatagtaaacagcatagatatagaatatttctgtcatcacagaaagttctctgaacagtgctgacctatatgattaactgaaaaactagattaaggtggggcaatcatagtcaatacatattttaaccatttaattttatcatagcaatatcatgtatctttatttgccaattgtttaatgttgtaccaaggtcttttaagtgtgggtctatggattgcagtgtcaaatctcatttattacgtgctacaaatttaatggatcatctttgttctatagtttcttttttgttgttgttgttgttgttgttgagacagggtctcgctctgtcacccaggctggaagacagtggtgtaatatcggctcactgcagccttcgcctcccaggttcaagcaattctcccacctcagcctctcaagtagctgggattaacaggcgtgcaccaccacacctggctaatttttgcatttttaataaagaaggtgtttcaccatgttggccaggatggtctcgaactcctgacctcaggtgatccgcccgcctcggcctcccaaagtgctgggattacaggcataggttactgtgcccagcctgttctatagtttctgtttcttaaaaggggagaaagaacttaaaggcacttacaaagcaatctgggtgcagaatatttatagatttttcttgttttccaaacttttacaataatttcgcatagctaattctacagcagttggtttttgtaattaactttcatcccgtgtttccaaagcctaatttttcatagatacacttttcttttttatcacttttcatgcattaaatttacatatcattgaatgtaaaggggataattacaaacataaattggaaaatgagcatctcaactcaggggagcagaaatatgtgaggtaatactaagggtccagagatgctggacacatgggcacggtgactgatgcctgtaatcccagcactttgggaagccgaggcaggtggatcacttgaggccaggagttcaggaccagcctggccaacatggtgaaacccgtctctattaaaaatacaaaaaaaaaaaaaaaaaaaagttagctggacatggtggcgcacacctgtaatctcagctacttgggaggctgaggcaggagaatcacttgaatctgggaggcagaggttgtcgtgagctgagatggcaccactgctttccagcctgggcaacagagtaagtgagactccgtctcaaaaaaaaaaagctaagggtccagagaatcggtcaggaggtttcacaaagggaatggggagcatggggtaacccagcaaactaattgagtgaaggtttcttaaaggcttttatagtagtagtttcactaaatgtatataaaatttaggaaacatggaaccaaagagactttcaattgcttaaagctaaatttttattatgtaattagacactgaagggcttcgggcaaaatttatttactcttcttgctcctgtatcactttttaaatgattacatatacatactgattgttctaatgagattacagttgtatttagaaagttaatggtttaataactttagaattattatactttttccatcaacaatttcttttccagatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcaggtagattataagatatttcttcctctgggtgggggatttgacagtattgacactatattgtagagctttttaatacctgaaattgagtggagatcggtttctttttaatttgctcaaaagactctcaattcccaaagacatctatacttacaaatatttaatagcattttaattttaaatttatggagaaagtgctaaataaattacaaaaccaacaattacattacctgccccatcacttatttccaagtagaaaatgctttttcaaaattgtaaaatgttgaatgttatgtaaaaatgtaaaatgttatgttgttacaaaaaccaactgctgtagaattagctatgcgaaattattgtaaaagtttggaaaacaagaaaaatttgttttccaatatgttacaatttattaaacaaatataagacttaattgcaaatataatttggcaatgggaaaatataatttattgtagaaccatgttcattaaaaattccactgggtctggagctaatccccaaactggaaaaataaatctaacctaggggatcagatatttcagcagaggataaactagatcacagaaatatatggatattaattttcaaaggggatctacctaagaaagttactgttagaacattgtttaacattcatggttcttctgttagaggcaaaagggcagaatagccaatcaaaatcatgtgaataggaatgactggacctattcccaatgaaccaaaagtaaaacacagaaaagtatgaatgcttcccaatatattcatgtgtttgcaaagccttccattcccccgtttctccctctcgtcatcaatgacttttaagtacatcagaaatagaatattagagatgtatatatgggaaggagaggctatggaatttcattaatgatattcttggaggaggacagagaaaggaagtggggaccatctgactttgttgaaaaactttgtacacagtagatatttgctaaatgttggttgatgttgatgatgagaatagtggggtggaactggactgaaccattaccgtttcagcaggagcatttgttatgatcagctcagaaaggaaaagcctaaagggggtggagatattgctatctacttggccagaataaaatctccagaataatagcatcttttttctccaagagacaactttttatacaaggaaatagtctctgcccacaaaggttgggtccttttagacataatcatacctagaaacaagcatatcatctctcttgtcctcctcctacattgaaggattcttttttgcttggatcctgttgacacgtcccacaactaagggtcatcagtctttgtccagtaagcagtgtaatatccagaggctgggaccttcctcggttatcaaggctttccttaagaatggcttcatgtctcatgcctgtaatcccagcactttgggagtccgaggtggggggatcacaaggtcaggagtttaagaccagcctggccaagatggtgaaaccctgtctctactaaaactacaaaaattagccaggcactgtggcaggcgcctgtaatcccagctactctggaggctgaggcaggagaatcgcttgaacccaggtggcagaggttgcagtgagctgagatcaagccactgcactccagcctgggcgaaagagtgagacttcgtctcagcaaaaaaaaaaaaaaaaaaaaaaaaaaaggcttcatgtattatttctctatcaggactttactgtaagatgatgtaatacctggccaggcacagtggctcatgcctgtaatcccagtactttgggaagcccaggcgggtggatcacttgaggtcaggagtttgagaccagcctgaccaacatggtgaaaccctgtttccactaaaaatacaaaaattagctggatgtggtggtgcacgcctgtaattccagctactcgggaggctgaggcatgagaattgcttgaacatggcaggcagaggttgcagtgagatcgcgccactgcactccagcctgggcaacagagcaagactgtctcaaaaaaaaaaaaaaaagagaaaaaaaaagaagacgatgtaatatcctcatccattctaatcgtagagtaaaatgagagaagtttgctataaatattggcccatttctgcaagatagtgaagtaaattggttaaaagcagactctggagtcagattgtctgggttcaagtcacagcttgagctgctgtgagctgtatgaccctgtgtgaatcactcagcctctcagactcccactttcctcacttgtaaaatagagataataatacaacttacctcatagagttgtgagaattaactgaattagtatgtgtaaagcacttaagatagagccaagcacacagtaagcactaggaaagtgttttccattattatctatggaatagcacaaagccatatttacagaaaagaaaaataattacttaaaagtattttttaatcgtcttgttatttatagctataatgtcccgatcaacacatttaatctgaagattcttgagggatttttagtgtaagcatctttaggataaaggcttcaaggctttactggataaatgactttagaatattgcccaaaatccttcaatttcataaagcctgtgtcctgccttcttccccagcttcatcacctactacggccccaccctctatagacacaagccaaactgacctcctttcagatgctttctcacaccgtttccccatccatattaaggcctgtgtaacatgctgttgcctctacatggtacattcttgcccctcctttgccttgttaactcctacttcaccctcacgtgtcatcacagatccttctaaaggcagctttcgctgatttccctgacctcttcaaatctccctcttctacatgctcataaggccaggcaaatatcctttgtggcacttcacaccctagaattttacatataattgtgtttgcctctttcctccacaccattaaaagatgtccatgtctgatttgtttcactactgtatctcagtacgtagcataatgactggcacattagaaggcattcaaggccgggcgcggtggctcatgcctgtaatcccagcactttgggaggccgaggcaggcggatcacaaggtcaggagatcgagaccatcctggctcacacgggatgtgagctaatacaaaaaattagccaggcatggtggtgggtgcctgtagtcccagctactcgggaggctgaggcaggagaatggcatgaacccaggaggtggagtttgcagtgaaccgagattgcgccactgcactccagcctggcattcaaactttttttaaattaataaaccacatcttttatttttatttttatttagtgagtgtctcgctctgtcacccaggctggagggcagtggtgcaatcttgtctcattgcaatctccgcctcccaggttcaagcgattctccagcctcagcatcccaagtaagtgggattcaggcgcgtgccaccatgcctggctaattttgtatatttagtagagatgggatttcaccatgttggccaggctgggcttgaactcttggcctcaagtgatccacttacctcggcctcccaaagtgctgggattccaggtgtaagccactgcacccggccaataagccatatcttttatacaaaaaattgtatagatcttgcctccaatgtaccatcgctgtgaagacaagattaattttctaacctaaacacaaactgggttaaaaactagccaaatagtagtaacagaaataataataaaataaacatttattgattacttagtatgtgtcaggctatgcaaaagctttgcattatttaattctcacaaggacactatgagcacacactagtattcctgttttacaagtgagttaactaaggtttagagggattaagtatcctgctcagggtcatactaaaaagtggcagaggcaggagtgaaaccaaagtgtttaattccagggcctgtgctcttaacttttgtgactttctgacttgggcagcttcccagtgatactcaggcctagactgggtgtgtcccaaaaagcaggagataggatttgtggtgggagacaggtgtgaggggaaggagagagcagagaggtggggcatttactgagcacattgtttttatcttgtgaacttagtaaaaccagtgttaatgtggcttcttatatagagctttgcataatactgatcttttaaaagatactgggtttatggtgccagttctattttattttgtgggtaaagttttggccatgaaatgatttgagcatcagcaacaccctagagaaattaagtttgtcattggaaagaattagatcactgtgtctcaaacagctgtgagttaaaagcgaaacagatgcttttgtttaaaaagtagggatctattaactgacagaaagaaatggaagagaactaacagttattgagcccctgccattgctcttttaacaatgagcgaacaagtgtaggatctggctcaataaatagaacaaaaccatataatccaaagctgccttttgcaataagagctaatttggagccttgtgggttttcataagtggaagagtgtatgtctgaatcaagctcccaattttccattaagatcttcaactctgagacaatatattatgctcctctataaccatatggtgatgtcactattttgctactatgaaattcttaataaataatggcctaattacagatgtaattaatttcatactgtgaatgttttctcaaaacattgtaggtaaatgtattttaagaaagtgaactgtactttaaatccactaagagaaatagttctttaaaggaatccctgaggattctcttaaataagagaatctttagtaatgtatatgtctgcaaactaatttttgtttttttcaaatatggacttttgtgtattgagttttttaaagtaagattcatctcttttaaggatggttgttttaaaaaatcaaaatatccttgtttttagcagagtttttgattatatcaattattcttacagtaaaagttagagtttattcgttgaatgacgacttgaagccagccaaaagagaaactgtcttaactttcatagtaagtattttatttatttaaataatactttaattcatttttcaggacaagaatctcatttcatwaccctgtcctcacactacactaaatcattcaatgttccataaatggttattgaacatctgcaatgagtatagaatcatagatctatacctctgtaatacacgtatgtgaaaggctcatacaaattaaatttcaataacttgaaggattttgagctaaaccatttaagtacaatcttgctgatttattttttaaagaacacccactggccgggcgtggtggctcacacctgtaatcccagcactttgggaggccgaggcaggtggatcacgaggtcaggagatcgagactaacctggccaacatagtgaaacctcatctctactaaaatacaaaaaattagctggtgcagtggcaggcgcctgtagtcccagctacagctactcgggaggctgaggtgggggaattgcttgaacccgggaggcagagcttgcagtgagccgagattgtgccactgcactccagcctggtgacagtgtgagactccatctcaaaaaagaaaatctaaaaaaaaaaaaaaaaccaaaaaacaaaaaaccacccaccaatcactaagaattgactgaatacccatttaactataagatatacataatggatatatctattatgtatttattatgtgcaaaagaactatatttaatggtacttactcttaaggaacttagagtttaataactattatactaacacaaaaaatcttgctaaatcatgagttaaagattggcagtaattcaccatttatcagacatgacatatgtaacagacgctgtgcattgaactcccatgatctcatctaatttgtgtcacataccccaaacacttttgtgaggaaataaaataatacaactagttataactgctcagttattaacagtaggtatactactaatggtccttcaatataggctgcagcacttttgctgctactcaaaaaaaaaaccaaaaaataaaaataaaaacttatcagaatgcaggtgcaaaagcatagatactacagaacaaaaccatactaaaatataaaacaaataaattatacagtaggacaaataccatgagctcagagggaagaccaatgagaggtgagagtgggggtgatacacatccttctctggaacggagtagttaaagggaaccctgagttgggtgttaatgaaaggaattgacataaattatttaaaaatagtgaagaccatccatgtaagaaacagttgagttaagctatgggggcaagaagaaataaaaaaaaatgaagctagtaaataaactgattgactgatagaatgtctgaaagagaactaaggagagcaatgtcagctcaaatgccctttttctatcagggaatgataggggtgtggatgtatgctctttatccaacgtcttcatggttgaacttaagtgatgcagaatcatggcataacctgcagaaaaatgaatgtcagtcatctcttgtaagagctgccccaggaagaaaagattgagaaagctgatcccagagccttaaggagttaatatagaggaagtatcctcaaaatagtacctgagaaagatgatcttagaagaattgtgcacaatggatagtgcgatgaagaagagccataaaaatactcagctacaagtataattcttgttcaaaataggcttctgtaagttttacaattaattacgaaataaaacctctaaaatccaactgtgaatttcagtcatggtaaatggtgctaagattttttgctttgggttttttgttggtttgtttgtttttgtttgtatgtttttgacaaggtcttgctctgtcaccaaggctggagtgcagtggtgtgatcatagctcactgtagcctcaaactcctgggctcaagccatcctcccacctcagcttcctgagtagctaggactacaggcacccatcaccacaccctgctaactctttaaacatttttttgtaggctggtcagtgactcatgcctgtaattgtaatcccagcactttgggaggctaaaatgggaggattgcttgagctcaggagattgagaccagcctgggcaacctggagagacctcatctctactaaaaattaaaaaaaaaaaaatagctgggcatggtggcatgtgcctgtggtcctggctacttgggaggctgaggtgggaggattgcttgagcctgtgagttcaaagctgcagtgagctatgatcacaccactgcactccagcctggatcacagagcaagatccctgtctcaaaaaagttttttgtacagataggggcctcacttatgttgcctgctatgtttatgtgttgagttaaggctgaattggacccccatgtgtagtccaaagaaagtcaaaacctcatttcaattatttgctaacccaaacacaaaattaagtttatggggaagctttacgagaactatcaagtttgtttaaccatttgagagttttaccaagctgaaaaatgcccatactatacatttataaaacatctggctaaaaaatataattcatagaatatttgcttttgaaagctttaaatgaacatatataaaaattagattctggtatttataaagccaacaaaattcacatttagtttatcaaaaacatcattgtttgtttgtttgtttgtttgttgttgtttttacgtgttgttacacttcatcttttagatgtacaacagagagttgagtctcttcaagataatgaggagagatggggaagattggaaaaagaagaagggaaatggctgaaatgaaccatatttcccttctataacatttaacwgatcttcatccttcatatttaatttgaagacatgggtatttgtcttcaaatatttgatctataaatattttgtacatcaaagattgtataatcagttaaattttttaaaatgtagtttctggcctttgagggtgtttgtttttatttacaggatcctgaaggatcagaagttgacatggtagaagaaattgatcatattggaattatctcttttcctgacttcaagattccgtctaatcctaggtatgtaaaaatagttgttaataaaaccacatacggaacttttggtgaagaagcaggtaaccagttaaagggggccacctaatgttaacaaagggtgtcacataggtggatatgcaaaatcttttgaagttctagcaagaacttaagctctgttcttggcaaaaaatttccaatacttctcagccattctttttacatatagaaataaaaattgggaagaggaaaaaatagtacccaggtttttttgtcataaaaaacatcaactcctacccctcaaagtatctaatagattgtcagtttaaaaggctggtgtggtcttgttccttgctctggttgctataaaatagggtcgtctgtagtttttgcctggataaactaccagaaggcaaagtccaagagggaaggagttctcagagctatatctattatttggcctcacatgaaaggatttaagaaaaagtttaaacagggttcaatgtaataaatattcaatgaacacattcttggtatgtgcaaatcacaataagagggagagatacaaaataaataatccacagtccctgctttcaagaaatttgtaataggccaggtgcggtggctcatgcctgtaatcccaacgctttgggaggccaatgtcggtggatcacctgaggtcaggaatttgagaccagcctggccaacatggtgaaaccccgtctctatcaaaaatacaaaaaaagccaggcgtggtggcaggcacctgtaatcccagctactcgggaggctgaggcaggagaatcgcttgaatctgggaggtgagggttaaagtgagccaagatcatgccactgcactccatgttgggcaacaggagcaaaactccaactaagatagaaagaagaaggaaggaaggaaggaaggaaagaaagagggaggggagggaggaaggaaggagggaagaaaagaaagaaagaaatttataatagagcagaatgaataagacaagtgcatctatacatggctgcactagaattttagaacaacatctttttatggtcatttttcctctgccctcagttaattcgctgactgaaatttttctaaaaatttaaattgaatttggaggttttaaataacttggataatttaaaaattgtgtacattcttgaaaatactacatgttccatagtgcagaattaaacctattattttattactgctatcatttctccaacttcatcttgtgccacttgccccrtggcaaattatgtgctagccatggtctggcatgtccagtgctttcctacctccgtgcctttgcacatgtcatcccctctacttggaatgggcttcacctggctcttcataagcctggcttcttttcattgttatgacccagagtagaagctgctacaaaaaggctattcctggatgcatgatgtaatgtaatctcttgctttgttttactccctatctcagcatcttgtttattttcttcatgacacttatctcaatgtcataatcatttctttacttgcttgctggcatttttattccccactagcttataaactctttaaggtgggccttgtctgtattgcacaccagcagttcaacataataggcccttgataaatattcattgaattgatgatgatggtaataatcattattataatactattaacatttgtggacttcatagccaatctgcaaggtaggctcagtatatatatgtgtgtgtgtgtgtatatatatgtgtgtatacacacatatatacatacatacacacacacacacacacacacacacacatagtttttttgaaacagagtctcactctgtcacccaggctggagtgcagtggtgtgatctcagctcaccacagccttgatctcccgggctcaagcaattctcccacctcagcctcctaagtagctgggactacaagcatgcaccaccacaccagactaatttttgtatttttttgtagagatggggtttcatcatgttgcctgggctggtctcgaactcctgggctcaagcgatcctcctgccttggcctcccaaagtgctgggattataggcatgagccactatacctggcctagtatatgtttttgaataaaggttattaattaaagccaggtcattttcatcttttaaaaaccatgctttgtttccaaccataaattcatttttgtgaggtgtaaattttatcatctgtataagcttgtcttgtattatatgtttctagagacgttattatggattttgtactgtattttggattttagtattatgttagcataattaggctccaagattaaataaattctcagaaataataagttcttcaaatcaaaactaatgactgtattaagataaaataccaggaaaaataatacaatatatgaaaaactggttactaaacaatatctattatctattatcctaaaaatgctcaattatttattgcttaaaaatcagtcacaaataaaatatattacttaggttttatatatctttgtgtattcttccctctttaaaacaggaatttattagatctcctctgagtgaattaaaaacatttgatgacatctataattttaaatattttgcttccacagatatggtatgtggacgatcaaggctaaatataaagaggacttttcaacaactggaaccgcatattttgaagttaaagaatatggtaatttctgacaagtaaaagtttttctttgctttttgttttttgtttttgagatggagtctcgctctgttgcccaggctggagtgcagtggcacgatctcagctcactgcaacctccgcctcctgggttcaagcaattctctgcctcagcatcccaagtagctgggattacaggcaccaaccaccatagccggctaatttttgtatttttagtagagacagggtgtcaccatcttggccaggctggtcttgaactcctgacctcgtgatccacccacctcggcctcccaaagtgctgggattacaggcatgagccaccgcacccagccaattaaaagtttttctataaaaagttagtgttttgcaataattctttttaataatgtagttaatgcaaaattattcccagatgaagatgaggcagcctgtacgtatggctagaagtactggctagaggttggagggaggagtagtagttgaatgcctagattctagttccagcatgcctttaaccctgatcaagcagaacaacctctgtgtacttgtgttccccatcagagagctggaagagatctagtcccctgaagagcttgactagtaaagatcctttctagaattgtgattattattaggagaaacttaaatagtcatagatgaggtgagtggaacccagtaaaaccaataaatgatttacttgagtcttaaaaccaattagtgacaaaacaaaaacaacaattaggtttccttacccctagtccaacactattttctggctcctaaattcctaatatattcatttgaatatttaagatattcttattttgaaataaattatattaatagactaacaagtaacgtaaatagtttaatctttcatttcttatagtagtttactagcatttctgtgtgctctgctatcaaatttaactttcttctgcttgaagccattttttattccctcaagagattcataatgacatggagaagaataaatactgacacaaattttaacaattaacaagaaaaacagtgacaaaacaaattcgttatgatgaaactcaaccttaaagattacaggctctctgtaacatataatcctaacccatctcccttcttctaagtgtttttgtattttctctgtatatctagaatccacccacctcttactgtctgtagccactctcatcaattcatcagcactctccctcctggactacagcaaaagcctcctaactgatgtctctgcttccaagctatcttgcttggtattagccaaaataatcttgaaatgcaaatttcattatgttatgtcacaattgaaaagtttttttgttttcaaggaacctatactctaatggaagaaataacctattgcctataataaatgctgtaatcaaaatataggcaaagtgcttctggattgacctctgattgttggagtgggaaggttctgcagagattgttgttggtgatgacgatgatgaygatgatgattatgataataaagtggatgttgtgttgatgttacagcttgtccaactataccagaaagtctagctgtttgctaggctttaaagtctgctctaatcaaaatggtaatattacctgtttgtttttattttcagtcttgccacatttttctgtctcaatcgagccagaatataatttcattggttacaagaactttaagaattttgaaattactataaaagcaaggtaagaacatttgtttttttgttgtttttatttttatttttcaaattaactcaactctggttgatgatagttgcccaaagtgagatctgtgatttattatcaaagtgtgccatgatttggggactaattgataaaggagacatcatgctggtagttcatttgcttattctgattttagctgattctgagtttagctttgttggctattcaacagcaaaaacaaagaaaagtgccaaagatctaagtttggtgtatgtgtttagaaactagggtaacttagaatattgggactgagatatgaaggattcacttcctatctttttttaatgatttaatcagccagctaatgctgcgtaactacttcaaaacccagtgccttgaaactcccacatttatgagtcagctgggaagttctgctgatctgggccaggctggtgtcagctgggctcacccatgtagctgcagccagttggtaggtcagctgggggctggctggtctaggaaggtcctgtccatatgtctggcagttggatggggctaaaagtgtgtgtgcctctcatcatccagcaggctagcttgtagcagcagcaacactcaaagaggcaatggaagcatgaaagtccccctgagcctaggcttggtgctggcacaccatcacttccacacattattttgtccaaagcaagttacaaggtcagcccagaggaaatagacccctcccacactttgtggacacaatgaactgtgcaaaggtcgttgatacatggggaggtagagaattgggggttagttttgcaagcaacctatcacaaaagcttaggtcattttaaaattacaatataatgtagttataccaatctatataactatatgtgtggggtactcttctaagtactcagcatatattagcacatttaatctttacaacaactctatgcgttgatattgttactattcccatgttacaagtggaaaaactgaggtacataaatgtttaataatttgctcaaaatcatacagctagtaagttgcacagcctgtctgcttccagagtccatgcctcaaacattaccctatgctagctctcttattagcattgatttgaaaaatagagtgtttattacttggtctaaaccagcataaaaggctcacttgagagaaaattatagaaactgacctcctataatggggactatttattcaaaccataaataaggaaagttagctcttgctatagtattatttgctgggtagaaagtttactttattcttactttaattctaaactaaaaagggaaacatgcagtttaaattttttatgaatagatctcatataacagtgagattggacacgtaccttttaaaaacataaaagaaaacagagagtagctgatatcaaaattatcaaggaagtaatttggcatataggagagggccctgattctaagtcttgtgatctccccaagatcaatttttttcatctagcacatagctttattaatgtggctttatgaggatgaaatgtaatagtgcatgaaggacgctttatttattattattatactttaagttctagggtacatgtacacaacgtgcaggtttgttacataggtatacatgtgccatgttggtttgctgcacctattaactcatcatacattaggtatttctcctaatgctatccctccccgtcccccaccccatgacaggccccagagtgtgatgttccccgcactgtgtccaagtgttttcattgttcagttcccacctgtgagtgagaacatgcggcatttggttttctgtccttgtggtagttcactcagaatgatggtttccagcttcatccatgtccctgcaaaggacatgaactcatccttttttatgcctgcatagtattccatggtgtatatgtgccacattttcttaatccagtctatcattgatgggcatttaggtgggttccaagtctttgctagtgtgaatagtgctgcagtaaacatacgtgtgcatgtgtctttatagcagcatgatttataatcctttgggtatatacrcagtaatggaatcactgggtcaaattgtatttctagttctagatccttaaggaattgccacactgtcttccacaatggttgaactagtttacactcccaccaacagtgtaaaagcgttcctatttctccacatcctctccagcatctgttgtttcctgactttttaatgattgccattctaactggtgtgagatggtatctcattgtggttttgatttgcatttctctgatgaccagtgatgatgagcattttttcatgtgtctgttagctgcataaatgtcttcttttgagaagtatctgttcatatcctttgcccactttttgatggggttgtttgtttttttcttgtaaatttgtttaagttctttgtagattctggatattagccctttgtcagatgggtagattgcaaaaattttctccattctgtgggctgcctgttcactctgatggtagtttcttttactgtgcagaagctctttagtttaattagatcccatttgtcaattttggcttttgttgccattgcttttggtgttttagtcatgaaatccttgcccatgcctatgtcctgaatggtattgcctaggttttcttctagcgtttttatggttttaggtctaccatgtaagtctttaatccatcttgaattaatttttgtataagatataaggaagggatccagtttcagctttctatatatggctagccagttttcccatcaccatttattaaattgggaatcctttccccatttcttgtttttgtcaggtttgtcaaagatcagatggttgtagatgtgtggtgttatttctgaggcctctgttctgttccattggtctatatatctgttttggtaccagtaccatgctgttttggttactgtagccttgtagtatagtttgaagtcaggtagcatgatgcctccagctttgttctttttgcttaggatgaaagacactttaaagtgcctcaagtgctttacrtaatttcaaattgttacattttatctgaatcctgttattgtaaccatgttagtaaaacagttttatgctattgtctgacagatatttttataataaagtagtcactgaggctgacgtttatatcacatttggaataagagaagacttaaaagatgatcaaaaagaaatgatgcaaacagcaatgcaaaacacaatggtaagatgttaagacacagtcactcacacctacagatgcatccagaggtgagagatgagaagttacttaaaaaccatctagtccaatcccccattttagataggttgaaacttaaaatcctccattggcttccctttgcctttagggtaaagttcattttccttggcatcagcctcccttaccagctgatctcatgccctttcctccctccctcccctttgtattaatcactccaatttctctaactgaccaaagtctctcttgcctccaggtctttacaatatcatttattctgcttgaaaatgctctttcccattgtcacctcctgccccttctttgcctggctaattccttctcattctttaagtttcaacattgacagcctttctctgggaagcctcccctgactcttctacactaggttagctgccccggctgtatagcctcttttcttaacacattcttcacatttcattgcagcggttctcaactaggggtgattttttattcccaaggagacatttggcaatgtccagagacatttgtggttgctactggtgtttactagggagaggccggggatgctgctaaattcctaccatgcacagggcaggcccctacaacaaagaattatcctgttcaaaatgtcaataatgctgaggggttgagaaacccttctttactggaatggcttgtttacttatctatcattttcaatattaaactatttgtgagtctgaatcatttcccttatatgcccagagacagcatagtttcttgcaaggaaatattcatgaagttatttgtccatagtttagggctaatgattgctggaactgagattagggcgctggttccctttcccttattcagcgttctttacattataccacagatgatatgagttcatgtcatttttgctcactttttcgtattcatttggtttgcatcatcaatcatttatcctctacaatcttattaattcaagatgtaaattaaatgcatttttaaaatgcaaaattctatgctagacactgggatgtaaggctaaataagacaaaaatgcctgccctcaagtcgctcaattttataagaaaaaataaggcaaagtttattttactgttgtgttaataattaaataatataatatgacttaaccccacatccctttactcattgtgtgttttaaaattagtatttaaatttgtaagcagtgaagtacaaattaaatattataaaaaccaacaaactctcagttaagggcggaagtacgctgagaggcctataaagatgaatgatgacgcaggaattggaagaagtcgtgtttgtcagctattaccaaaaagacctgttggaccatgtgatgttcaagacccttctacttctataattctatacaaataattagaaaataacatcctgggcttaatcgtggactcggttatctactttacttttgacactaaaccattcttctgacatttaccttcaatttagaggttagtaaaagcagattttattaatttttccttataagttcttctccgaaataactcctcctttttctccttttaaaaagttgataaatggaattgctcaagtcacatttgattctgaaacagcagtsaaagaactgtcatactacagtttagaagatttaaacaacaagtacctttatattgctgtaacagtcatagagtctacaggtaagtgtgtgtgtgtgtgtgtgtgtgtgtgtgtgtgtgtgtatactttcttttgaaaaatatttagacagaatattaaagatataaataatttccaatttctataattatttcacattgtattttctttcatagttaaatataattataagaagtagacttttatatagttacaaaaaggcagtagggctctgcttctttttagtcattggacaagccattgggtccctattacctccacttctactgcaaaaatgggaaaacagtacccaattcatgtccaaagtagttctgcaggctctctgccttgaccatttggcaccctagtgtcctcacgtggtgaaaatcaaaaccaaaataagattatgtgtgtaaaactatttgataaagtactatacaaataaaagttattactattatcattattatagtctacataatgatggagtcaaactgaatgtttcctaaagcctaaagttttcaacattattttaatgtttcttctttttattttttcctcaacttattttaaataagttcagtttaagcagtatctatgagatatttaaagtattgccaaacagacaggcttgcaaacattaatgatgtatgatgccagcactaaagtggcttacaaattagcatcaggtataagacaggtgaagaaagaactgttgcaagaaagaattccatatgagctctaagcaaaatattaatgcaataggattcagaggaaggtgagcttctagatgattgttgagcaagcaagaacagtgttgtgaagatgatcagtcttgaaaaataattagggttttgaggcagagttgctagacagggtgaaatagaaaccctccagagagagggcagatgaagaagagtagatggtgaagcttaatctttgaggacagcagatcatccagtttggctaaaatataggatatgtatagaatgtattagagatgtaatattggaaaggagtttgggaatattaaagcttcaaatgttattcttaatagtttaacttaatctttacctggaggataacattattgggctcttgccagttgtctggtcatgtccccttccctccccctcccccctcccgctcccctccctcccctccccctcccctccccctcccctccccctcccccctcccgctcccctcccctccccctcccctccccctcccccctcccactcccccctccccctcccccctcccctcccctccctccctcccctcccgagtcttgctctgttgcccagactggagtgcagtggtacagtctcagctcaatgcaacctccgcctcctgggttcaagcaattctcctgcctcagcctcccgagtagctgagattacaggcatataccaccatgcctggcactttttttgttttcgttttttagttttagtagggatgaggtttcaccatgttggcccggctggtctcgaactccctttcagggttctttctatatcaagctccctttttctgatttctctctatgtatctatgctctgtgaacaccaacccccatcccccacctccacttctgtaaggctcagtttctggcctgacccttccctctctcctcaatcccttgaatacagtcaactgaaactcaggccactgatgaaaagtggtgtcccttcctggcatccttcctcagtccagtcctgtagctctacttctccaagggcttctctacatacgagcttgtgcataaggccttggaaactcctgaggtctaaactcttctctgctgtgcccctctgaagcaagacctatgtcctacttactactggtaaatgaatgaatgcaagaatggagtgagtgaatgaataagtctgtggagacatatagagatgaaatggatatccatacagatcatgatactcctaaaaactgtcaacatgatgcttgccatttccttaggtggattttctgaagaggcagaaatacctggcatcaaatatgtcctctctccctacaaamtgaatttggttgctactcctcttttcctgaagcctgggattccatatcccatcaaggtagattgggtgagggggtagacgttgctacatatgatcatcttgttctgttcatggaaaacatgtgggtggcaaacagggtaagaatgttgccatgaagtcacagagggagcttattctgtgaaacctgcccctcytggtggacacagacagggatgggaaattgaaggtcagctgcagccttggcaatgacttcaaaagtgagggcaagatagccttgtattaggcatccctaaataagcattaaattacatgtaataaataagcattaaattatatgtaaataaaatctcataagactctagttcaaaaatacaaacatttaaaattatttggtggcaaattcttaaaaagccttaagatggagatatcattccttgaaaatagactcctttctctcactatgtttttgcctccagtgtgtctcatttgyttccctctgtctctgtgttgtctttgtgcataactctgttcaatctctygtctctgtattgctctctgttcttttcatttttgcttctttccgtccctgaatctctttttttctgtcttttttgcttactcctctgcattcatttttctctctttcaccttcttttcctcctctaaatgctgacagtatagaattgaaacattcatgtggtttttagatttttatctatcattatatattttattayaaataatatattttattatgttgattaaatggaaatgtttattccctgcccttaatttagaaatccagagcaaaatttttttttgttctttgaaaatgtgttactttttaaaatcaacttaagtacaatcaaaatgtgttatttattatttactgtgggtcatgggcttttaagaaaaaaaaggatttaccaagcccaaagcaaggtttggacatgcttgtaggttcttacatatatatactatatatagaaaataatatataacaaagtatcatataatgcatatacagtaatatataatatatatactaaaatatgtaaatatagcaatattatatagaacataagcttaaaatatgtttatataaaagtaaaataacaaactatatctgtgtggaattgtgtgtgtatatatatatatatatggcagtgagaggtagatgttaaaggaaaaaaggtgtatctatttttgtttctcatattcaagggacttattcccagaarcgattgcctcattttctcctttatccagtcctaaaccaatcaaagaaatacagaagttagatagcagaagaccttatcacacctactccttgactgacttaatagaatgatatttatgttttgagtttgcttgatttatgggagaatctattcaagaatgatttaactaaatagaattaaatctttctataagctgagaatacacttctctttactaaattaaacataagtaaaccaggtgtggtggagcatgcctaaatagttccagctwcttgggaggctgaggtgggaggatggcttgaggccaatagttcaaggttgcagtgcgctatgattgtgcctgtgaatagccactgcactccaacctgggcaacgtagtaagtctctgtctcagaaaaaaaattttcagaaaaaaatacataaataatttatactttggtggggaggaaggaaaattatttcagaattgtgctttaaaataagtgatgagctgttgaaatagatytggattgttttgacaaacaggtgcaggttaaagattcgcttgaccagttggtaggaggrgtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtgagctgaattctcctgttgtattttctaggacaatgtgtactcttgaccatgtgttttggctagtgtgcagaacagatgcggcagattttacacatgagtccagtgaacagttccataattttgcatccaagacaaattagtcccagagacaatctgctaatccattgaatggtccttgaggaagataaatgtatcaattttttatttgggagttaattgttttatcttacaccgttaagaccatatcagactctagaagcttcagaataggtatagcagtgcacatgagtgttaggaatatcctctcttcccccctcacttttaatcccctgaagggccacaaaagggtcaaaaatatggaagcctcccttttttctaactacagaaaccattctactttagagcccacttaatagtcttctctcgcagcaaatattatttaagttcccaatctcaaataaaatatgagcaataacatagtaacatagttacaaagtaacttagtaacataataacataggccaatgactgcagcatgcatatgctcactgtcatctattgagcacttactaaatgctaggcatcatgctgagagctttatgaagaatacatgaaacaccatttaattagcaagatgagttagaatattatctttgccattgtgtggctcaggaaatggaggcttctaacctctcttttgattaactaattttatccagagttaatangtggtggtactggtatgtgaaccagtgtgtacctgactccagagcatgagctaataacacttctgctgtctgagggtagatattgctgccatgatatcatttcttctccacctcatatttataagcacccatctgtgcctctacttcacaatgaaactgggccagatagtctctgagatgttcgttcatagctcctgtccccaagagttagtgctacctccccactacttcccttctcctacccccatttcctaaatgcttaggcatctctctgtaatcatcccatgcgaggagaagtcccaacttaccatgacatttcaggaagaccaccaataattattcctggagcatctttctctcttcatttcagacttttccgccatagcccataatcccatcattcttgtctgtagtctttgtaaagttgcttgacaccacagctgtataaacactgaagtaatggagggttttttcccctttascatttgttattgtgaaatttagaaatttataaagcaaggaaaataatttgaaaggtatgttttacagaaagcattacatcacagtatacatgtctttttgaaatttctcttttcaggtcaaaactgatgctccagatcttccagaagaaaatcaggccrgggaaggttaccgagcaatagcatactcatctctcagccaaagttacctttatattgattggactgataaccataaggctttgctagtgggagaacatctgaatattattgttacycccaaaagcccatatattgayaaaataactcactataattacttggtaagtacataatgatggatttacatcttattcccccacctggaacattttcctttgcctctagagaggcattagaattatcctttatacttttattcccaaagcactttcaagaycatcatctaacttgaacatcagtttctcaaaaaacctttgaaatagggcatgattttcatgaccatttcacagatgaggaaactgagggacagagaagttaaaagacttatgatggttactcagctgggaagaggaaaattttgatttgagctgaggactctgactcctgttctaataacactttttaccaaagagagcctagttattccaaagcragaacctgattaaatcatgttgcctctgttctctttcatggccaaagattatatgcctagacccagttcggataagtgaattttattgtcaaaaaatggggaagcaaaatcctctcctgagaattgaatcctatcttgcctgttccaattcngtagctgagcaacatccctattgcatcatttatattaaacagaggtggatcgatgaagcctgttggtgaaaccaagaaaaaaacttacagaaaatattaagagcttcctgacaatcaccaaataaatggaatgaattatttcgacagccaggccaagtacatgctgttggcttttcaacatttttgaggaagaaattgaaaaaacagtaatgaggaccatagataaatattgactgataaagggaaactgtttatggactagataccaaatccatgtatgcagttctggtctctaaggacaatttaagggacctctgagggcattttggcttcaygtgattttttttttttaatcttaaaccttcaatttagaatctaaaccctggctttaaatccccaaataagatgcactccacttattcatctatttttttttaatcrgtgaaacaaaaggggttttagtgacagtgtgatgactttgaacagtttttgggttcaaattttagctctctaatttactagttgtgtgattttgaattaaaatcagtatgacttttagtttctgagcctcagtttcttaaatgaggagaataatattcctcttattgatgtattgtgagaatgaaaggagttaaatacatgttaaagttcctggcacatagtaggcccataaacgttaactcactctttcttccttccttccttccttccttccttccttccttccttccttccttccttccttccttctctttctttccttccttccttctttctttctttcttttctttctttctttccctccctccctcccttctttccttccttccttccttctttctttctttccctccctccctccctcccttctttcttgccttccttccttccttccttccttccttccttccttcctttctttttggtggagtctcactctgtcccccaagctggagtgcagtggcatgatttcgactcactgcaacctctgcctcccaagttcaagcaattctcctgcctcagccttccgagtagctgggattacatatgcccaccacagtgcccggctaatttttttatttttagtagagccagggtttcaccatgttggccaggcaggtctcaaacttctgacctcaggtgatctgcctgccttggcctcccaaacttctgggattacaggtgtgagccaccgtgcccagccaaaattggtatgtctttttttttttttttttttttttttgagacagagtcttgctctgttgcacaggctggagtgcagtggcatgatctcagctcactgcaaacttcacctctcgggctccagtaattctcatgcctcagcctcccgagtaggtgtgattacagtcatgcaccaccatgcctggctaacttttgtatttttagtagagatggtgtttcactatgttggccaggctggtcttgaactcctggcctcaagtgatcggcccacctcggcctcccaaagtgctaggattacaggtgtgagccactgtgcccagcctaactttatttttctttaacataatttctgctccagctccaggctgcatcctaaagcacaggttttgtttttgtttgtttattttttacttattgttgctgctgctgtttatttttagattttatccaagggcaaaattatccaytttggcacgagggagaaattttcagatgcatcttatcaaagtataaacattccagtaacacagaacatggttccttcatcccgacttctggtctattanatcgtcacaggagaacagacagcagaattagtgtctgattcagtctggttaaatattgaagaaaaatgtggcaaccagctccaggtaagccacaaattataagtcacaattgaattttcttttcaatgaaggaggctgccaaagttttagctgcttctgaaaagtcttgtctcatacmaatgatcttttcttttctttttcaaatgaacttttaggttcatctntctcctgatgcagatgcatattctccaggccaaactgtgtctcttaatatggcaactggaatggattcctgggtggcattagcagcagtggacagtgctgtgtatggagtccaaagaggagccaaaaagcccttggaaagagttaagtaatgcatgtctcgctgcagtgttgcatgaagtgtggccaccaggctaggatatggaggaagaactaagggaagactaggcctgcttttctgtaatctactcaacatactcatttttaggaaggtaaaccatcctcctgtcagctcccaaagcacaggtcaatcctcttttgtttttcaaatgtaaatgtaagcactttaagaatatatgatcatggtagcaattacattcatggaggaaaaattactatcagaatactttggaggtttagggtagggtgttgatggcagttatagtagctagtagcagcacaggaaagacctgtataggtaacatttggattttttttaaattctcattgaaatccatagcacagaagaatctcaaaatcattcaattctcataagttcctatttatcttattatgttcagctattattttcgaggcttgaatgtctttgaacaaggaaggaaggactgagaaactgtaaaattaaaaaatactcggagaacgaataagcctgtccaaacaagtcttcagccatttagaacctagggacctccccaccaaaatgcacaaagttgtgcttttaaagcaacttaaaattaatttctatgttaattcagtccttcatgcattcatacctatttatttatttatttggaacattatattgattgcagcattcattctatgtacaaaacactatatatcagtttctaagaaactcctcatcaaagctatttgtttaagacttagttcttgatttaactttgaatagttatgtatttataaatacaaaaggacaaacttagaaacaaagttgggaaattttgtctttgatcatttgaaaaatatcatctgtgtatttcactggtttgtgataaccatgtaacaattagtaccttttagatctttagaggaatgatttatacatctcaatgkgctcaacattttgcctttctggacaggtatttcaattcttagagaagagtgatctgggctgtggggcaggtggtggcctcaacaatgccaatgtgttccacctagctggacttaccttcctcactaatgcaaatgcagatgactcccaagaaaatggtaaaatgctcagcatgtttattactgaaaatcccattgatcatttgccccccaratctcatttttatccttcttcccaaatattctgtaccctgatcttagaatgccaagactacataactcacctgtataaaatgtttcactggccttcaagataaagtacaaattctttagtgtagtactcaaaaccttccatgatcttcgccctggctctctccaactagctcttaccctgctgtgccttacgttatgtttaagctctacagaaccaagtggagttcttgagtggcattatgctattttgcacctttgggcctttatttattggaattggtttccccttcattagcctggagaagcaatgtaagaatcatcgcctctacaagacctcttccccacatagaatttataattccctcctcctttaatagggaggctattgcagggactagatctatttacaagttatagaacagcattgtgtcattgtgcattcttacatgtagttgtaagtcctgctcacctactgcatcaggagctctttaaggatagtaaccataccttaatcatcttctttctatggttttaaaattgttcataattatacttgatactgtggtattcatagttatatttgcaataatatagcacaaagagcaaataataaaaatagcatacccaacaaaagcatcactcactctaaatgcttaggtatttctctggaatcagtggatcagagaggctgcaggattcaaaaccaaattcagataaaataagtcaaaagatatgacactagatcatgaactccactaagataaaacaagtcatattaagaagtatggtgcacagttcctaatccaaagcagcccctcaatatttgttaaggaatgacttgtgaaggctctaaatacttaaatagtttcatggaatttttttttgagattttatctcctttttaatccttcttctttatctttttttaaaaaaaccagatgaaccttgtaaagaaattctcaggccaagaagaacgctgcaaaagaagatagaagaaataggtactgtaagattcawgtgattgtaaaaaggttrtggtcatatcattcaaaaactggacaaaattaaatgttatataaattcccctaattgaaataaaatgaatgaaaagaaagatatgtatggaggtctagcttatctctctcagaaagattaatccaaataaagtctagtagttcatttgccatagccttaatctaaggaaataggtctttattacttcaagctctaaaatccaaaatattagcttttatttgtcataaatattttctctctgataacttcatctggcaattaaaatcatatccttccattttattctgacaaaatccatgatttgactattttggggatatacctagaagtctattacttctatttcatatatttaactgttagtagcattgttctttggaaaatacatcttgtgagaattattttaaaataattatttaaatggttatgataattcgtcatgttactgtagaaagaatatcaaactgggagtcagcaaattgagttcaactaatatcatgcctatggtaatataatagtttcttccatttgtatatgagttattttaattctaacctttattctaagttctaatgatatgaaaagagagacattgactaatctgagcacttacaatgaaggataatgctactaggtgaagtccacaaaccatgttatataagaagtttttgaaaaataggatattcagcttgaagaaggaaatatttgtatagtgatgatagccatcttcaaatatttgaaggcttcttggatatttaacttattttcttaaaaaacattttctattctttttctatatttttctgcatattttcagcagaacccaaagttccagtttcaagagttagtatttagcttaattgcaggaaaccctttaaccatttagtgtgagctggaatggaccatttggtaaggtcacattctccccattcttagaatagttccaaggggagtctggacagtcaactagccataactattgtgggtagggggatcatatagcaacagaaaccaggtatcccttgagattccttctaagcctgagatgttatsactctgcgtcatcaagagcacttgcattattaccatttcagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacgtaagtatgacattttctatcagaattctgctcaatatggggaattttgtgtaattttatgctgctaagaaaggcagttttcatgatctatttagaattgaaagtagaaaagataacttgtaaatgtccataagaaaaaaaaatccttcatttttgggcatccgaagaggtacagtacagagcagagtacactaggccagagttaagacctggcataaccttaaagccaagtcatcccataaacttgaatgattatttatcctctctgagcctcatgcaaggagcttcgaccagatcctctccaatatgcctgtgagttctacaagtctacgcttttgtgatattacaaccattaaaaattctgtctatatctacattgatgaaataaaggagaatatttctaaatctagcctaaggttaagtgtacttatataaaagctgatgtcttatttcagtttcaaccacaatacatgtttccagaatttatagaactctcattaacatgttttcagaacttttaggactttatatatagtctttttttttttttttttcagtaggaatctggctctgtcacccaggctggagtgcagtggtgcaatcttggcttactgcaacctctgcctctgggttcaagygattctcctgcctcagcctcctgagtaactgggattaaaggcgcctgccaccacacctggttaatttttgtatttttagtagggacagggtttcaccatattggccaggctggtcttgaactcctgacctcaggtgatccgtccacctcggcctcccaaagtgctgagattacaggcgtgagccactgtgcccagcctatgtatagtctttaacaaaacaagcaaaagcaaaatgacagcttctgttttatacttatgtgtgctgcgtaatgacattttcatcaatgatggaccacatgtgcaacggtgatcctataggattataataccgtattttttctgtacctttcctgtgtttagatatgcttagatacacaaatacttatcattgcattacagttgtctgcagtattctgttcagtaacatgctgtacaggtttgtagcctaggagaaataggctatactatatagtctagatctgtagtaagttataccatctagattagtgtaagtacgctccatgatggttacacaacaaaatcatctaacaacatatttctcagaacatagccctattgttaagcaatatctaataaccataattttggtaaatggccacaaaatttatgtttgtagaaatatattcattgagatgtacagtgtctaagattcagattgttttccaatatttgttttgctttgtttgtttgtttgtttgagagacagagttttgtttttgttgcccaggctggagtgcaatggcgcagtctcagctcactgcaacctccgcctcccgggttcaagcaattctcctgcctcagcctcccaagtagctgggattacatgcacctgccaccatgcctggctaataatatttgcttattataagcagaattttaataaacagtctagtccatatgttgtttttctttttggagggaggatttggcttttttttctcttaattttttttaatttttaaatttatgtgggtaaatagtatttacggggtacacgagatactttgatacaggaatgcaataagtaataatcatatcatggaaaatggggtatctatcccctgaggtatttctcctttgttttataaacaatccaattatactcttttagttatttttaaatgtacaattaaattattattgactgtagtcaccctgttgtgctgtcaagtactaagtcttattcattctttctattttttgkacccataaaccatccccacatccccctcatcctcctactacccttcccagccttctactctatatctccataagttaaattgttttgatttttagcacccacaaataagtgagaacatgtgaattttgtctttctgtgcctgacttatttcacttaacataatgacctccagttccatccatattgttgcaaatgacaggatctcattcttttcatggctgagtagtactccattgtgtatatgcaccacattttctttatccatttatctgttgatggacatttaggttgcttccaaatcctgactatttttaacagtgcagcaacaaacatgggcgtgcagatatctcttcgatgtactgattttctttcttttgggtatatacccagcagtgggattgccagatcatatggtagctctattctttgttttttaaggaacctccaaactgttctccatagtggttatagtaatttacattccccactaacagtgtacaagagttcccttttctccacatcccctccagcatttgttattgcctgtcttttgaataaaagccattttaactgagatgagatgatatttcattgtagctttgattgcatttctctggtgattactgatgttgagcaccttttcacatgcttttttgccatttgtatgtcttctttagagaaatgtctattcaaatcttttgcccatttttaagtgggattattacattttttcctgtagagttgtttgaactccttatatattcttgttattaatctcttgtcagatgggtagctgcaagtattttctcccattctgtaggttktctgcttactttattgattcctttgctgtacagaagctctttaacttgatgtgatcccatttgtccattttggctttggttgtctgtgtagtggggtattactcaagaaacttttgcccagaccaatgtcctagagagttttcccagtgttttcctatagcagttttatagttagaggtcttagagttaaatctttaatcaatttttatttgagttttgtatatggcaagagataagggtcacgtttcattcttctgcatgaatgggataaccagttttcccagcaccattaattgaagagactgtccttcctccaatgtatgttcttggcacctttgtcaaaaatgagttcactataggtgtgtggatttgtctgggttttctattctgttccataggtctatatgtctgcttttatgccactaccatgctgttttgaattatactatagtataatttgaagtcaggtaatgtgattcctccagtttttttctttttgctcgggattgctttggctattctggtcttttgtagttccatatgaattttaggattttttttctatttctgcaaagaatgttattggtgttttcatagagattgcattgaatcagtagattgctttgggtattaaggcgttttaacaatattgattcttccaatccatgaatatggaataactttccatttttttgagtgtcctcttgaatttctttcattggtgttttatagttttcattgtagaaatcttttacttctttggttaatttaattcctaggtatttaattttatttgtggctattgtaaatggtattactttttaaatttctttttcacattgttcattattgacatatagaaatgctactgatttttgtatgttgattttatatcctgcaactttattgaattcatttagcagttctaatagttttttggtggagtcctcaggtttttccaaatatgtgatcatatcatttgcatacaaggataacttgacttcttgctttctagtttggatgacctttatttccttctcttgtctaattgttctggctaggacttccagtgcactaggacttgcctagaaattgcagtccttgtggcctagactgcccctcaagttaacctagggccctagagcactccagcccatggtggggaggcttgctggaactcaagctccaaccactgggatgagcgatgcccctctggctagggccagtccaaatgctccctccatgggcagacaccagctgagtacagcctggttctgctttccaccgtgacagtgcaacactgagttcaatgcaaagccacagaatgactgcactctccctctcccaacacagagattctccatgctgcacagtcactgctaggggatgtgggaggagtggcattggtgcttcaagactatctttcctgccctcttcaatgtctctttcagtgatgtaaagtcaaaaccaggtactgtgattgctcacctgattttcggttctcttgatggtgctttttgtgtgtagttagttgttaaaatttagtgtaccaacaggaaagacaaatggtgtaggcttctattcagccatcttgctctcccctctcatatattttttcgtttttcaatttttcaactataatcatctggcttggcttcagctggatagaagtctctctctgcagccccctccttcctggaactctccctcattccagacaagttggccttgcaaaactcccatcagtgttgccacaagtcttcaaaatcatcaggctctgcttgtattcctctccctgccctagtctgtaaactgcctctaggcagtaagctggggcaattttaggtttcacctaattgtttcctttctcttagagatcacagtcttgcttatgctctaatgtctgaaaactgttattttgcatatcatgttttgttttctattaaggcatcttatatgaaaacagaagttcagtccatttttattaaagtaaatataaacaaattaccaagttaaagaaggcagagaaccatataaagcctccttttttctaatataaacacaattattacaattatatatataagtgcaaataactttatagactgatcgatatcttgtataatctcaggaatactaaacatttagcaatttaagaaaaaaatcattaaagatatttaatgctttgttttgccaatgctattagtggaaaaatcctaaggcctttatagtttgtttgtttgtttgtttgtttgtttgtttgtttgtgacagagtctctctctgttacccaggctggagtgcagtggtgcaatctcggctcactgcaacctctacctcccaggttcaagtgattcttgtgcctcagcctcctgagtagctgggactatagacacccgccaccatgcccagctaatttttgtgtttttagtagagacggggtttcaacatgttggccaggctgatctcgaattcctgacctcaggtgatctgcccacctcggcctcccaaagtgctgggattacaggcatgagccactgcaccctgcctataattctattttggaagcattaaacaaaatgttttatttacctttcagaaaatgcttaagttacagattaatggccatattttaaaattcacctataagtagaatttatattgtttttccataattgaatatgatttttttgtccagacatgaagaccctgttaccagtaagcaagccagaaattcggagttattttccagaaagctggttgtgggaagttcatcttgttcccagaaggtattatacttctttcatgtttccttgaaagaaatgtggataatgcaagtattatggccaaaaatctagaaactacccatttcccaatagcttgcataggagttaagatgatcctgcaatttgatcaaattttgttttgttttgctttgcttttttaaatttttatttttttaatatacatcgtactggtgattggctccaggtcagaatgaagaagggtgctattccatttaattttatttgacttcagtatgcatttactacacacaactatgtgcgatacactatattaagccactatttttatcctaaaatatctgtactataaaacaaacattaataaacaggaagaaaagttttctttttaaagttttctattcaacacattttaaggaaacacttcctctataccactgaaaacagtgatgggctgagtcctcgagccatactcttcttagatgggcttaaagcactggttttccaatgagaaggcaaggaatgagttcaaaggcctgcagttgtctcctcacgcatctccttatttctacccttgtcttctctaatccttcttccacacaattgtccatttcatctgacattacccattagctagcatgtcctctagtaaaccttctggccactgctccccacactaccagtgattggattaattgcaccctcaattaaccctgttgtgtgtatcatattgtattataatgacttgtttactttcctgtcttccacattaaaatgtaaatacctcaaaggcatgaactaaattcagattactgttttatatccaggacttggcctaggatactgaaaataaatgtgttgaacgaawgcacactgcctctgaactcttataatgccttattggtacaattattacagtgcagtgtaatttatttacttaactatttcttccactagattgtaaactgcctgagagcaggactgtatcttatcagtgctgtttactcagtactcagcactatacctgatacaaagttggtagacaatagctgtaaataaatatacaagcttaatcataatcagcagtttttagttatgtcaactttgttttgagcagtgctaacatgcatcactttgcttccctattttagaatatactcacaacaaacatctttttctttgtttgtgtgcttggattttgcaatgtttcaaaggcattcttctgaacttgaattctcatcatagaggtrcaatgtctaaaaacatgcaatatataagagagttactgaatatatttttcttgatgaggttttccttaatgatgtgatttcatctcgtgaatttttttctttctctaaagtagtttgaagcaaaaattctgttaatggatgtctctgttaagttgggttaatcaatattccactgtatttgaatatcaacattttaacttccagaaaacagttgcagtttgccctacctgattctctaaccacctgggaaattcaaggcrttggcatttcaaacactggtaagcaggtttaagtgatatatgcatttaaatagtgatttgattagcaagatgtaattctttgttagtatctatttagtttacccaggacttaaatggtagcaatttttaaaaaatattcttttttttatgtattaccaaaagacttggatatacccacatctttgaacatattgatttctcctttcactcctctcttttttttctttttcctttttttgtaaatgaagaaggggtctcgctatgttgtccaagctggtctcaaactcctagtttcaagcaaccttcccacctccaccttccaaagtgctgggattacagcttgagccactgcacccagcctcaagtctttattttccttcacttttctcactgactgggagcttgtgtagagttagaaacaaataaatgaactctcttgggctgatctttatgatgattaagtgcagatgctttccaaatagcttcaggaatggttttgtttgtttgtttgctacttttgttttaaaatcttggtttccacaatcaaaattttatactcattaaacatggagccaataatgaatatctaaaaagatttggtgtgttagttgataaacattctcatgccttaaatagaattaactatttgttgaataaatgaagttttttgttaatactaattattattgaaattaagatcaatgaatagaaaattcaaggacatgagttgagagttcagagaaaaacatgatctaatattattttttccttgaagtaaagcaaatgtgagaaattttaataccaataaaacattataggaatttcctaatatgattctactttgcttccactttgggctgaaggtatatgtgttgctgatactgtcaaggcaaaggtgttcaaagatgtcttcctggaaatgaatataccatattctgttgtacgaggagaacagatccaattgaaaggaactgtttacaactataggacttctgggatgcaggtaagtaggtgttaatatttatgggataaaggaaacattctctggttttctgagaattctattagtggaattaccatacacaaaaaagtagaagttcaactcagttcagcaatagaaaccaaacacttaaaatgagcattgtactatatgtgtagggatgtgaattaaagggatgaaggaaggaggaaggacaagtaggtattcatgtaacttcaattgaaagaataaattgcataagataatccatgtgctgtggaagtccagagaagggtgaattcatctttagttcctttatttgcctatactcagagttccttgatttccttgattctaacaaccctttcctccattttagccattcatactcatcttcactttatagatcttatcatcctctctgaaatcttgatttcagacattcacatctcaccatccagtgacaacctccttcctgtcctcctaactcattaaccagattacttccatagctctgggtcagtagcatcactgaaaccttcagtccattgactcaatcccttttattgtcctttacttccctgctctttttactttactccttgttcagattagaattcaccagccatcattaaaaccacactgactaaaattatgccaactccctggatcctatctcactccaggacacaattccaaccatgattggacccaccatttatcttctctttgccagcacacccctaaagagaattatataataggctgactgatttgatttgaaaatcacagtcacaaaactttgcatgagaattcaatgtgttccaaaattctagctatatttttttaaaacactaactttattcttagagattagaatttcagtggtttcctaaaattttgcttacataccctcttgttttggaaaaactatgtatccctctgacactttttttttttaagacggagtctcgctctgccctctgacacattttaaaattggcatctaaaatttttatcatacattttttaaaagatggcaatctattacttttaaaatatttaaatattggtatcttaaaataaaactgttttatcaaacttatgtatagcagactccaaataccatagcaatcaattttttaaatgctcaaataagcctttttttttcaagatggggtcttgttctattgcccaggctggagtgcagtggtgcgatctcggctcactgcaaactcctcctcccctgttcaagcaattctcatgactcagcctcctgagtagctaggattacaggtacacgccaccatgcttggctaatttttgtatttttagtagagacaggtttcgccatgttggccaggctggtctcgaactcctgacctcaagtgacccacctgcctcagcttcccaaagtgctgggattacaagcgtgaggaactgctcctgggctcgaataagctcttagcaacagattacatatcattccttttcctcaatgaattcatatttccattttactcccctaatgttacatattttatgcatgaatttttttctgttgatcaccttattatactttaatgaacaaaaatatgcacatacattgaaaatgaaatatcttaaaatttcatgattgtaaaattccaagtatcaaatgatatgtggatttaggtatcattacaaatattattattagtatactattgataaaataacatatttctaaagttattaaatatagaaataaaattttatttaaaaattctcttctcggccaggagcggtggctcaggcctataatctcagcactttgggaggccgaggcgggtggatcacgaggtcaggcgatcgacaccatcctggcaaacacggtgaaaccccatctctactaaaaatacaaaaaagttagccaggcttggtggcaggcgcctgtagtcccagctactcgggagacagaggccggagaatggcgtgaacccgggaggcggagcttgcagtgagccgagatcgcgccactacactccagcctgggcgacagagcgacactccgtctcaaaaaaaaaattatcttctcattagataaatgaaatttttctctcaattggcttaatagttatggataaatgttatttattgttagaaatgagagagagtttggcataaattctattcttatttttcatttttatagaggtaggcattgctgttcaacccaattttatcaggaaggttgataaaataaaaatattgtcaattttattacccctttatcaatatattttaatcttatatcttggagcttcacatttagcttattcaatttatgtaatatgtttgtcatataatctaactggaaaaatcagtcctcattgataaaatgatcagcgaaaatcagacttactctttgtcatagaaatgccaatttcatttttcaatccaaatcatgttaagaaatgtcactctttttttcacaattttaattttcagtaaaaatgaacttttccatataaacttgtttcatcaggtaacactaaatatcagagaatgcacacacaaattttacttggccacaggatgtaaatggggaataaacttaagtaatcagaatttaccatactgatggtattatcttttttttttttctttttttgagacagagtcttgctctgtcacccaggctggagtgcaatggcacaatctcggttcactgcagcctccgcttcccaagttcaagtgattctcctgcctcagcctcctgagtagctgggattacaagcatgtgccagctcgcctggctaatttttgcatttttagtagagacagggtttcaccatgtggtccaggctggtctcgaactcctgaccttgtgatctgcccaccttggcctcccaaagtgctgaaattacaggcatgagccactgttcccggccagtattatcttatttttacagaaataaaatcaaaatgttactcatttctcttccttagaatttactcacagggtttgcataaatcctatgaatcatgccaccatcttcagccctgtggaattgccctccctcatttggctccatccccaccaccctaaatacaacgtgaagagttggagaaggaccttgattaagaagctgtaaagttgcctttacattatttcttttaaacccactagcttttctgcagacagaatgcttcatgaatttaagataatcataactcagatagagataycaaaggccatttctccatcaggttcctgtagtggttttcatgtctcaaaatcctgattcaagatgggcttgaggcttggaaactgagatactaagacagtcagaccatctcatcaaaacagactcagcataattttataactcacactgatcttggctaccaaaggattttggtagatgattaaggaggtgtcactcttaaaccatgtaaattgtaatttgagatagacacataaataggtggccataacagatgggtaaggcacagaggccacagccaaactctgctcaactgtaggattgagatcagcaagggctcctctgctcacctagtcttagacatataaaatcggcttgtgtaggtatgtgtgtatatatatatatatatatatatatacacacacatatatatatacatatatacatatatacgtatatatacatatatatacatatatacatatatatacatatacatatatacatatatatatatacgtatatatacatatatacgtatatgtacatatctacatatatacatatatgtacatatctatacatatatacatacatatatatatatatacacacactgcctcagcaatttgtgtttccaccaataatattatcagagacatcctttcatatcagtatatacagatttacttcattactttaatggctgcacagtaattcacatggtgggtatactataatttattgaaccatgtttctattaaagacatttgggttgtttacaggttttcactattataactgattttgcaaagtctscatttatgcatacatatcttcctacatgtatatttctgtaggatagatgttttgtcttggagtgaactaactgggctaaagggcatggacattttaccttctgataataaatattgccataattatcttccaaaaggattccatcaattgacattcttaccaagtgtatgcaggtagccttgatccctcacattcttataatttgggggaataaacattttttcttttattcatacaatgaacacttatacagaaattgaaatgaatggactagataactacatgcatcattttgattaaagctcaaaaatgtaacattgctgaaaaaagcaaattgcagaataatatgtatacacaatgaatacaactacataatatttaaaaacatgaaagaccgcgctatatattgtttgttaatacacataaaatttttgccaagttgacagacacaagtgatatgtcactgatgtttctatttcactaccctgattactagcaatgttgaacctcatttcatttgtctgtggccatttgtatttcttctttcatgtattctatgatatcctatatactactttaatatcctttcttttgctttccattgagttccttttttctggggtaagttacctagcttcttcttgcttagtttcctcatctgacaaatgggatgataatagtatctatttcatagttgaagattaaatgagctaattcatgtaaatatagtacttggcccatagtgagtactcaacaaatgtacttattattgtttacaggagcactttgtatgttagagctataaattctttattgattataaatgttgctggtatttaatctgctacttgtctttaactttgttattagtgtttttaatttgtatgttataaaatctgtagatcttttcctttatgtcatttgagttttgtgtttttggaaatcttttctcactgcaagttttaaaaacgtttttctacaaaatactgcatgttctcacttataagtgggagctaaacattgagtatatatggacacaaagaagggaacagcagacaccagggcctgcttgagggtggagggtgagagaagggtaaagatcaaaaaatgacctattaggtactatgcttattacctgaatgatgaaagaatctgcacaccaaacctctgcgacacgccatttacctrtacaacagacctgcacatgtgccccgaacctaaaataaaatgtttttctaaagaactgttttttctatattttctatagtacttttatagttttttgtgagcatttagatttttttatctgaaataaggatctaatcccaaatagccagatgatccagcagtatttgttaaggaattcatgcttttccaactgatttaaaatgtcatcttgcccccatatatattgaatttccatatatgtggatctatttatagattctctcctctgttttgtttacatcagtatcacactgatttaaagtaccatagatttgtggttatattgtatawctattaggcaagtactctctggtattcttatttttcaaacgtttttgatgttgttattcttacacatttactctgccagataaactttggaattagtttgttgaattctccttttaaaattataatagggttttcatattgtcctgaatttatgaattaatataagggaaattgacttgccatattgaatcttttacatctctttatccttttgctttatgaactaaatcaagggtcagcaatttatggaccatgggccaaatctagcctgccatctcttttgtatgtcctttgcaataacacaattatatataacttgacagcattttttttttttttgagacagagtctcgcyctgtcgcccaggctggagtgcaatgggaagatctcgggtcactgcaagctccgcctgccaggttcaagcgattctcctgcctcagcctcccaagtagctgggattacaggcacacaccaccatgcccagccaacttgacagcattttaaagtgtcatgcatatcactatactgccatattttatttaatctttaaattttcagtgcatttccatcatatcaaaataagaaacaagtacatctgtgatattttgggcttagttcctgttaattacctttcctcctgagtgtgggttacactttcctatttctttttatctagtaattttggattgaatcttctactttattaataaaaatattataaagactctggattctattacattcctctgaagatttttcgtgtgtgtgtgtgtgttagcaggcagttggctggattcagttccagactctgaaatctcagttcagtatttttagccttagctggatgctagaaatctgtgctgtgcataggtcaagggtcagccaggtttgagcaaggattatacacagaacttggagttccttcactattcagctgtggtaactattccctactttgtcctctagttcctaaaccagtatgatgtcaggttctactggggttttagccactccaaggcaccaatgggacctgccctcagggtaaagctataaaaagcgggacacttattcagtgtcattcccttctcccaagtgtcactttccctcccactctctagtatctgcaggtagtttgttttaatatgtatcttgtctagagtttgtggttatttttacagaaaggttgcccaatataagctatttggctattactgaaaccagaaccacttttttttttatattttctatcagtttcaaaagttccttttagtctcaatttactaagagtttttgtaatgcaattatgctgaattgtattaaatgactcttctatatctatccttccccaccctcccctgctgttctaaggaaatcattggccgcaggtgatccaatagtcttttgctctggcttctcccaccctggtggttgtctcccaagaagatagttaagaaggaaaaggaactttctgttttcaagaaattcctcaaaattagtggttgaatagctggtgctctcttttgtttacctgcttgacttattctggattttatggatttattattttgggtatagttctcaattctatcagttcaccagaatttggagggaagatgaaaaatgtttactatttgagccagaagtcagtgggcactattattattcccattacaaagatgagaaaatggaggattagagagttcatgcaaccagtttccatcaccagttaataagaggaatgccaaaaattgaatccaggtctttctggagccagagtttggttgtaaaatggggtacaaatgggaagttgataaaattagaaaagtaagctggggacataatgggcagggccttgaatgccgatatagggaattttcagtctttgatgaaacccatcatttactgaataccagaggctgagctaaaagatacaaaaatgaataagatgaaaatgaaaaagtacctgagcctaaggctcccactatctgaaacacaaacatgtaaagagacagggtaataagtgctatcacaacagcatgagctctgtacccaatttagtacgtaacagtctaagaaaggtaagatgtttctgagacagtgttgacttttctagacatctgtttgcattgctaaactctacggcaacttgtgtgtctatgttaggaaatctgaaatgaactttcttctgtgccttagaatctaagggattattttaacattgttaaagtggagagtttgtgtccagacaagcataatcaaggtcaacttttttagagataaagtatttcgagtctgggcacggattacagcatcatgcctgtaattccagtactttgggaggctgaggtgggcrgatcacctgagatcaggagttcgagatcagcctggccaacatggagaaaccgtgcctctactaaaaatacaaaaattagctgggtgtggtggcgcatgcctgtaatcccagctactcaggaggctgaggcaggagaattgcttgaatccrggaggcggaggttgcagtgagctgagatcatgccgctgcactccagcctgggcgacatagcaagastctgtctcaaaaaaaaaaatgtattttgatataattcttcacttgtatttcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtggtaagaaaaacatgcttcaataacttatgcttaaattattgcaaaagagagacacagaaaggggggggagagaaacaatagtgtaaatttaacgaaacattaagcattaaggaaactggatggaggttattccagattttttttgtactattcttgcaatttttctgtaagtctgaaatcgtgcttaaaaatttttaataaaacaatatttgtttcgtagaaaatataaaatactgaaaaacgacagataaataaaaatcatcaataattcccatacccagagatatctaattttaacaattggtacacgtctttttttggtatacaggtacaattggtacacaggcttttttttccccttaatacattcagaaaatgtgtcttgaaatctatgtgccagacattatgcaaggaactggagataaaacaataaataagacatggcccttgaatttaaagaacttgcagtctagaaaactttccattgtataaacaaataaacagtcccaaaaaagaagaaaagtataatttgttaagtacaatttacccacagtctgttaattgtattcacgttattaacattaatatttttatgtaattttaatatttttatataattttaatattttatataagtatgatttaccaattaaaaataatagtacttttaaaggactaagattcttgctaagggtcatatggccaattaatgacagactggatttcctggctcttcactctctgttttcagctatgaaattcacttcagtaaacatgtactgacttattttgtgcaaagcacattcccatgcatccttgcactgtggttccatgcagtctctggagcgaggctgctgggccttgaatcttggctccatcacctcctagcagtgtgacagtgttacttgatttccatgtgtgtcagtctcctcatctgtcgaatgggagtaataacagcaccaacctcatagaggtttttagaggttaaatgagttaatacatataaarcacttagaacaattatctggcttataaataacttctttttaagcatttgctctggtcaatatgcaaatagccataaaatcttattgctgcttatatccatgtaagtatttatacatagtttgccttttccaagaaaaataattttttagtttgaaaagtggtccagaaaagttgatccagggaaytcaggttatataaacttatgtttttaactgaatgttttctgcctttattttagccagaaggtgtcaaaagggaaagctattctggtgttactttggatcctaggggtatttatggtaggcaaaatgattttttattttatatgttatcttttgctttagaagttaaagtgtgtatgtaacttaaaacactatttttcagaaagtgagttgtctaaaatcagtagtatccacttctggccaggcacagtggctcatgcctgtaatcctagcactttgggaggccgaggtgggtggatcatttgaggtcaggagttcgagaccagcctggccaacatagtgaaaccctacctctactaaaaatacaaaaattagctgggcatggtggtgggcacccatagtcccagctatttgggaagctgaggcaggagaatcgcttgaacctgagaggtggaggttacagtgagctgagatcgtgccactgcactccagcctgggcgacagagcaagactgtgtcaaaaaaaaaaaaaaaaaaagtatccacttcttagatcactatctttcttgatagcattatagtacaactactataatctgaatgactgagacacaacaataataattccattaattttgaatgcaaggccttgaaatagtaacaattgcatgacttccctcatatattattcattgtctatccatcacaataataatttataatatattattattgagccaacagtccaaagaacacctaagaaaaagtcatttacataattaacatgcattatttgaaaacataataatgctaattaatcactaaacaaacccattcctcattgctcctgcttccctacttttccttcaattgagatattccaaatcttctcaaagctagaattttgcaaacatttgagtacttaatcaaggcctaaatacatatacatgtatttatgaaatttaggatgtggccagttaaccattctcttttcaactaaagaagacagattactgcagttcttattaaatgcttacaacttatcttaacgttgtatcaataatttttgttttatttcaatgatataacaatggggaaaaaatttacttacagatcatgatcactatcatcagtgtcatttcctctgggaaagcaaagaattaataccctttacactttaattcatctgagtatcatgaactgaggagtgttatttcagtagagraataaaaagtaaaatccatctatgtacatgcgtccacatgcttacttgtttctccaattttttcttcacacagacctcctccttgcctgctcattgtgaatgatctatgggtagagatattacaagtttcaagggttttagcctcatgcaattatatcaagcctcaaaagccactgtgtccttggcttctctttctttttttttttttttcaccacagatgctgcttctgctgacattattgcaaacaattttccagagcagtcttgccttactcatcctaggtgtgaacatcaaggccacaggataggaacaatcttttatctgggaataaatctctgtagagaaaatctgggttaaaacaaaaatctgtgcctctttccaatcttctcatatgacttttttcccttaacattttaggcaacttgggtttaggcagctttcctgatttctgcagagctaaagagggaaaagataaaaattctgttcagcttatttcagatattttattaaatacttctaatatttattwttttttttttgtggggtggggggacagggtctcactctgttgcccaggctggagtgcagtggcgccatgtcagctcactgcaacctccacctcctgatttcaagcgattctcctgcctcagcctctggaatagctgggattacaagcactcaccaccatgcctggccaatttttatatttttagtagagacggggttttaccatgttggcaaggctggtctggaactccttacctcaagtgacccaccagccttggactcccaaaatgctgggactacaggcgtgagccactgtgcccggcctatttctgatatttatatattgaaatcgctatacaactatgatactttacagggttcagttaaaaaaaaatgctaaaaagtgtttggaaaaataaatggactataatgttaaaggaaatctgaaaaaatatatcaatgagggagaacaaacagtatatagtaattaaaattgtgtgacaccagcttaaaaaaagactaaacacagagactcaatgcttaagactagctctagtctttagtttctgctttctgtccctgataagcccttttctcccaactcgtctcatatctcaaatgcagagtgttaagtttctcactccctcatttcctgacacaccatcctcattggtttaggcaggcccctctcgttttattttttccttcatcccggaccccattcccattccccttcctccaartgtacccactcaaatgtgtttgctgtatacttttgaatagaaaggtaatgttgttttgtatgtatgtacctctttaatctatgtatatgtaacattgtgctatagatcctattctgtcttaagttgttacactcaaggcttagttttaaagaaatatctcggccaggcgcggtggctcacgcctgtaatcccagcactttgggaggctgaggcgggcggatcacgaggtcaggagatcgagaccatcctggctaaaacggtgaaaccccgtctctactaaaaatacaaaaaattagccaggcgtggtggtgggcgcctgtagtcccagctactcgggaggctgaggcaggagaagggcgtgaacccgggaggcggagcttgcagtgagccaagatcacgccactgcactccagcctgggcgacagagcgagactccgtctcaaaaatatatatatatatataactctattgttataggtatacttaattcatttttcttacatagaatttcagagcatgttccctcaccattttatccatcactgtatatacaatatatttcccttgaaaaatccatgttagcatttacctggaccatatatccaggagctgggtcaaaggatatatacatatttaatgccatttagtcctgtcatattgcccttcagaatggttatacttccattagcagtgcacgagggttctcgtctctccacaacctcaccaacacttgcctctctaaaatgtggcatttttaatgggtataaagcactatctcwttattgttttaatttggattcttctggttactaatgattttaagcatttcttcatatacttgtccatttgggtttcccatctgtcaattgcctattcatatcttttgcacgtttttaaattttctatttgggttatccttttaaaatttcttcttgattttgtctctgatgtacctctttgagcaacaacaagccttcatgggtttgaaaaggaattatttattctgatgtagtcaaatccatcataatttcatcttatggttatatatttttgaggtaatctttaagaggtctttctctactcttagttcacaaagacattgctggatattttattctgttaattttatagatttgaatttaaaatgttttaatctgtctggaacctgcctttttatgtgatgtcttgatgagtcttttaccgtgatcactgatgaggaataaaattaacttctcttagttttaactttctctttaccttttccacctggtagtagagttgccaatggaattgaaatagtcaagagcaggtttcaatggagaaaatggtgaaggagcaaatctagataatctcaaggctatctgtaataagtatcatatattgagcatgaattgtatgccaggctctttgtctatattatttttatcccacaaaaatcctttgaggaaaatgttgttatctccatttaactgatgaacaaattgaggctaagaaaggttgtatcttgcccagcgtcacatatatactaagctctttttgaacttcatgctctttcactcaaagtgcaaacctcttaaatgtcttctgaattttattttgatatatcctctgcatttatcaaggattaatgaagaaagaagttttatgaggaatgttcctgcatttttaggaaagccatgtggcttgtccattaaattgcaaaatgtgactcatttttctttagcatcttccatatgccagggtctgtgctaagtgccaggactacagctggaatgagaaatgattcctgcccccagagtgctttcttagcaggacaatgggaggtggattctctttgtggtgactagtgtgggctctgcagcaaaacttctggagttcagattgcagctccacttgtattgtttctgggaccttgaacacgttactttctaagcctcaatttcctcatctataaaattaaactaatgaaaatagacctaacatagaggactgttgtgagaatccaatgcaataattcatttaaagaacttagtagcatgcttggtactctatcagtagaatgatcaatgttacctttttttggacataaaccagtgatcacagtagaaaaattatctgataccagtatgctaaaactctgttgttttgcccatagattaaaaagtatcaaaactagactgggaagggaaggtggaaagaatttcagatcatacttccctgtggagctaatgttcaatatatagttgattaagaaattacatgttagttattcttagctttcagttccaggaacaattttctgtctttgggcaagctgrcatgctatattttgctggtgaataagatttatataacctatttatttcacatcttataatgaccaggaagcttacagccaaatttaatgctttatttaataagattatacaagcctagggtttgattaaagtccttgatgatttttaactttcttttaaaattttaatagtctaattataagtcttttattttgaaatattctttggaagtagatacattataaataatctgcaaacagtcttmccctggaaactctgtataaatccanattttctaaattacaggtaccattagcagacgaaaggagttcccatacaggatacccttagatttggtccccaaaacagaaatcaaaaggattttgagtgtaaaaggtaaattaacaaatgccatttttatttctcatttcacttggtgcttcaaacaaaaatcaaatatcctcatgattattctgtttctccacttccgtgttcagtagcacacacaaatctacctttaggagtgctccacccctacccacccccactttcaaacctttaatcacttttcccactatcttcttccaacggcctgatttacatggagatgcattctcctccaatggaaggtagggactgtcattggctcaaagatgtctctaaaatgggggtccagttgcttctagacttaaagaactttccatggtcttagtggccagtcccgctccagagaaggcctatggcctgcacatggcctagcgagaacagcactgctctgctgaagtactggtcccagaagggttgtcttagtccatttatgctgccataacaaaataacaaaatttataaataatacaaatttatttctcacagttctggaggctgggaagtccaagatcaaggcatcaagagattgggtgtttggcaagggctgctctctgtttccatgaggatatatgttgctgtatcctcctgtggcagaaagtggaaaggcaaaagggcaaaaaggggtgaagaacttcctcttacctcgtctataagattattaatcccactcattagggtggagccatcataacctaatcacctctcaaaaagccccaccttctaatactatcaccttggtgattaggcttcagtgtatgaattttggagagacatatacattcaaaccatagcagggattctcctcccctcgcatacatttgcagaagtgatatttgcacaagtgactaggttttccttagtctccaggctttacaattcaataacatattaccgaatgatagaatgtcctgactacattttatctcagataaaaccctagaatcacaaaatgttagtactggaaaggatctttttgatcatgtgcaaccctgctgttggatataaaagaaagtggcatgtccaaggttgcacantgaattatagacagtcatgtcagcactccctgttcaggctctttgctttgcttcctggaagggattggtaaatatggtttataatgtctaaagctaacaggttgaatggcaactaatttgccatgttctcttgcagcaatcagtccactgtattacattacctaccaccatattttagtgatttttaaagtcttttttttttttgtttctttcaaattcatgttcctaaccggatctttttttctcaccccgtttctgagaagcaagtcaactgcctagataaaaagggaagaaccatctctagatggttgttcttctctcttgagaacatactgttagaagttaataaaaagcaatgtgtctactttgatcttttttgtttcaggactgcttgtaggtgagatcttgtctgcagttctaagtcaggaaggcatcaatatcctaacccacctccccaaagggagtgcagaggyggagctgatgagcgttgtcccagtattctatgtttttcactacctggaaacaggaaatcattggaacatttttcattctgacccattaattgaaaagcagaaactgaagaaaaaattaaaagaaggtaaaaaaaaaaagtatttcacataaaaattgggtgattctaaacyaatatttttattaaactaatatttaagttgtgaattatagaaaactttgtaagagaattttagcaaaaaaatcatgagatggactctactatataaataaatattatttctgtagcattttggctcaacttaccaaaaygcctgaatgagargcaaggcacctgcattccaaactacagaacacttccttccttttcgaatgagatcagaatgttctacttgataattcccaattcgagcaattcatatacttcctttgagaagttcaatgctggccacagagcatatgcttgctgcccaacaccaaaggaagcttaccattctcagggcctgataaagtgttctttgagtagaaacggaggtctgttaagcaccgtgttctttttcttgtgcttcttagggatgttgagcattatgtcctacagaaatgctgactactcttacagtgtgtggaagggtggaagtgctagcacttggtaagtagaagattttgagttgcattttcatatagtggttaattaactaaagaataataaccataatggaaactccattcctccagttgctcaggctaaaagcctcgtcatccttcactcctctctttctcttaccgttcacatctgatccagcagatatggattcaaaatatatccttaatttgactacttctcaccacctccaccacactatcctgttccaagacaccttcctctcccacctggattcttacactagtctcccttagtcttctgggttcagcccttgatcctcttcagtatatactcaacacagcaactgaagtgaccctgttaaaacatatgttagatcatgccactcaaaaccatttaggagcttcccatcttacccagagtaaaaaccaaactttttattgtgatttacaaagctctgtatgatctggctccacctcatgtctcctactttatctcctatactctctttccctccaattcagccccactagccttcctcaaacacaccaggcatgcttccacctcagggcctttgcactgttttctcagtctggaatactcctccttaggtgtcagcatgactggctctcatatttccctcaggtctttaccaaatgtcaccttggggaggcctctgctatatcataatgtctaaaattgcaatccactcccctcccaacacctcatatcgtttcttttctcctcagtgtgattactaacgttcttgcttattccactattgtgtatctcccccactggaatataagctccatgcgggaagttctaagtatccctagtgcctggtacctacctggcacatagtagatgctcagtaagtatttattcaatgaaacatatcttccaaaattctgatgatttgagggaaagatagtctgaattaattaagagtccatatggcagtctattttcaaaaaataccggctgggcatggtggctcacgcctgtaatcccagcactttgggaggacaaggcgggcggatcatgaggtcaagagatcgagaccatcctggccaacatggtgaaaccccgtctctatgaaaaatacaaaaattagctgggcgtagtggcatgtgcctgtagtcccagctactcaggaggctgaggcaggagaatcacttaaacccaggaggcaagggttacagtgagccgagatcgcgctactgcactccagcccgggtgacagagtgagactctgtctcaaaaaacaaaacaaaacaaaacaaaaaaaccatcatgctatgacaaaatatttaataaaaacggtgtgccagctgctttgtaggttctatatgaaacatatttaaggagtttacaacctagaatactttaattttagatttttttcttttttcttttttcttttttttttttttgagacggagtcttgctctgttcccaggctggagtgcagtggcacgatctcggctcactgcaacctccgcctcccgggttcaagcgattctcctggctcagcctcctgagagctgggattacaggcgcgcaccaccatgcctaatttttgtatttttagtagaggtggggtttcaccatgttggccaggatggtctcgatctccggacctcgtgatccacccacctcaacctcccaaagggctgggattacaggcatgagccactgcgcctggccagttttttttctttagctattgagatctcccagaattttatctttggccctcttattttctgtaatctcccctggtacagtctcattattgcccatgatttccataacatctaggccaatggccccctaatcaatgtctcaaggcctaacttctttcctaagaagttaggaaatgtcctagatccatatttctaggtttccggaagccaaagatccttcaagcacaatatgtgccaaattcattattttcttcctcaaatacacttctgtttctttactcagtgcacaacaataccctgccctttgtcccccatggatcaagtcagaatcatcagttggtttttgattccttcctttccttttggctttacctctgatcagctaccaagttccatagattataccttaggattaggtctgaccatgtgtgggtgacacacttcaaaagacacacagggccagatacagtggctcacacctataatcctagcactttgggaggctgaagcaggaggatggcttgagcagaggagttccagaccagactgggtaacatagggagaccctgtctttaataaaacaataaaaatataaaaaaataaataaaaggctcatagacccctgcagcacaccaaccagaggataacccaggatgcaggagtgggagtgagtgtcaatgaagactggaaactgacacagcaggacctgggaaatagatgcctggagagcagaaagccccacaggaaggtacaacagcctctcagtaaacactcagagcctttcaagagtttggggcaagactgaaacatacacccaactccatgagttccttgaaagaaataatagacatagaagaaaatgtccagcacctaaataccctcaaacwtttcttgagaaatacaaagcagattttttaaagtacgaatatcattcatattagcaaaacccaaaattgatgatgatgaacattttttatattcgtcttttttttttttttaaagaacattgtggatattgaacttttctctttaactacaagcctccatcttatttctgtttctttcccccaagggcattcactatcatgagtttatgcatctttccagaacatttttaatattttatatagtatatatatacatgaaatcatatagctgtaacttaactccagtttggctgctcactgctcaaatgccaaactcaagagactaaggttggtgggaggaaaagcaggttaattcaggagccagcaacccaaggagatggcagactagagtcaggaaactatcccaaatgccctaggctggccagagggattttaaagaggaaggggcttggaaaactgtgtgcaagagttagctacgtacaggtcagcatgtcttgttctgattattatcttgagtaacgggccatctagtggtcagctagactgaaacaggtttgtagattaactgctcagtatttttcttctccaggggacatttcacatccttgatttttatctcatggctagttcctggaattcttaagtaagcactgtttaagaaagttaagcattgtaaaagaaagaatggttatttgcttccaaaatgaagtgatgggtttacagtccctttttgtatttctaaatgattataactagtatcatactatacctatcattctgtaacttacctttttcttttaatactttttagttactttagatctagtagtataggtaaatatagctcactccttttcattgccatgcagtattttattttacaaatatatcacatagtatatattctttatctattcctatcttgatggacaaccatttccaaattttaatattacaaacaatatgataatgaacatcttcatatgtctctttgtgcacatgtgtgagagtttctctagggtatatcccaggagatagaattgctggaacataaggaatgcatatttacagtttcatcagattttgccagatttctcttcaaggtgactaaaaaattcttttctactctaaatttttagtcccagaccctactgtaaaacatgaggaactaaactagaccatattaagcacttgtagaggtagcctagggtctggaacaaaagcaaatcaaatagcctacttctttttttcctccatgtcacacttaaaatttgaatttcagggcagtctccaagggacaggtcagtgggaagaggagaacgcaaaaagctagagcgaattgtatttgctttacctttagggaagtgctgtctagactctcactccttaaggataccagggatgagacacccaagagtacsaaagagaaagagagataggagtaagagcttataaaaaccaggtgcagtggctcacacctataatcccagcactttgggaggctgaggcgggtggatcacctgaggtcaggagtttgagaccagcctggccaacatggtgaaaccctgtctctactaaaaatacaaaaattagcttggcatggtggcacgtgcctgtagtcccacctactcaggaggctgaggcaggagaatcgcttgaacctgggaggtggaagctgtagtgagccaagattgcgccattgcactccagcctgggcaacagagagagagtccgtctgaaaaaaaaaaaaaaaaaaaaaaagtaagagcttatacctattgaatacttactataatccagaactattttaagtatgttcatatatttaatctttataattgatcccaaaggatgagtccgttgtttctatttattgccattgccttttttcaaagatgtaactaaagcatctttatatatacagatgtatagataagtggagaggcagcctggcygtataactgcactcatatgcctttctagcctgctaaaagaagagagacttccaaaagccaaaatcccaagagagacccaatgtaaaatgtgggccaatctttgaaaatgtgagtgtccttgaacctgagcaatccgtagaagtatttctcatccttgagagcagtgtgggaggattaaaaagagaggagctctcaactcttaccccctaaaagtcaatagagtagaaaataaatttctgatgtttctagagaaagaattaggaaaaggcacctagttgtggaggggcaagttccgattaatatcaaaaaaaaatctttaaaataattaaatcaattagagcaaagactgagaacaacctaaatgtctacagaaagggaaatggcttaaatagctttggtgcatctgtaccaaaatactataatttaatgtataaaatcacttgtaaaagaacaaggaaactttatgtattaatatagatctctaaggcatattactaaatggaaaaaaagccaagtacaggataatgtaaacattctcccactattttggtgtggttgggatggaaaggtagatgggaaggctatatcttgtatctactatttggaagaaagcacaagaaacaatggtcatcttctgttgggaggtggagggggacagggactgctagaaggagacttttcataaaatatccctttgtgcttttggatttttttttttttaagttctctcactcaggctggatgcagtggcaggatctcagcttactgcagcctctacctcctgggctcaagcaattctcccacctcagccttccaagtagctgagactataggtgcctgccaccacatctggctaatgttttgcattttttgtagagacaatgtctcactatgacgcccaggcttcacttttggatttttgaatcatgtgagggttttacctctttaaaaaaatgcttaaaatacatttaaaaaatgaaaatgaaaaagaaacacaaattttttaagtgggggaagtgggagagcaagtcaagtggtctgagtctcagacatttgaggacctggggagtggagcctcctgggcgactgagagagtgaagagatgttatggggggatgaacccaatcctctctgatactcttcgatgggtattagtagagacttgaaattgctttttgactaagtaataatgatcattaaaatttcctgtggggtagtaagttctgtgtcaatggcagcactcaaggacaagtgagataaacactccagggacattgggaaaggggacttggggcctcagataggaatttagattccatggaatgcacaaattttacaatctagaattttgtgatttactctttcatgtctcatgttcataggtcaatgccttgactcaaaactatttattttatctctgttatctttaactttagagtgtaattcttatcatcaggaatcaatttttagcttgtgtgctagcggacaatgttgtaatcacagaagatgtgctgttcacatttgtttaccgaatgttttggaggtattccaaaaatcttcccttcctttgtaaaatgatgacttactttggaattgcatgttttaaaatgttattttcttttaaagaataaagttgtataaattaattgaaagtcaaaagggattcagcgttctaaatatttatttatttgattttgtcttaaaggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacaggtaaggaarccaaatgcacaaattagcaatagttttatttagtttgagttttattctcatctgattatgggaggatgaagaagaagaagaaaaaaatgtaattctgcaagaaattcctttgtgaacaagcaaaatatacaaaggtctttcccataatatctgaagtgaagcgatcttcagacagttcactagagatcagagaagtgatatcttagacctctcgtttaacggggtggaggtagatgggcaagtgaaagcactcaagcgagatagacccagggcttattgagaaatgggaagcaggaagggaaagagtgggagataaggcttaaaacacagagtagaggccaggtgcggtggctcacgcctgtaattgcagcactttgggaggccaaggcrggcggatcatgaggtcaggagttcaaaaccagcctgrtcaatatggtgaaaccccgtctctactaaaaatacaaaaattagccgtgcgtggtagtgcacgcctgtagtaccagctactcagaaggctgaggccggaggatggcttgaacccgggaggcggaggttgcagtgagccaagatcaagccattgcactccagcttgggtgacagagtgagactccatctcaaacaaacaaacaaaaaacagagtagaatcaggtcatttcgccttaaagacaccayttcactccccttttaaaacattgcttctttttagggtaccttgcctgttgaagcccgagagaacagcttatatcttacagcctttactgtgattggaattagaaaggctttcgatatatgccccctggtggtaagtaagagttttctttctctcacacccatcatctatttctgtactatatactggaggggccaccaatcagaagaccttttgtttcaaaagcttcttttccttctttccaataacttgaaaataacttaaactccagaattgaaagatttcagaacaatgatagatattagagaccacctagtccaacctactcatcgrcagttgagaaagctgaggactaagtaaggtgaattcagtttcccagtgtcacasgctaataaattgtagagctgggtctaaaactgatagctgggactgggatggaagaatgatccagtgcccccagcttctctgtcttatctttgctaaatcctgctttatatgttactgttatcctatagtgaaagcattctgtatcatgcaagtactgaggatacacaacagcaaatgtgtatcctccaaatccttccaaacaacatttgcttggaaacgggagaaaagtgatgagccacctaagtaaatcaacatagaagatttccaaggttgagatggaaaatctcaagtggatttgcaaaactggaagcacaaaacaaaaccatttgttttcagtttgtttcagaagcttaacaagacaaaataatcaatgaagactagttcccaggcacctagtggccacatgggtgagagatgcatgtggagctgggagaggaggcaggcaggatgttagcagcatcgcagcaggctttctgctggcccacttgcccaacacaaccattttggtggcgtcaggactagtgatcgggactatttacccaggcattcttaggatctaaaagtactgtggcagttagggtttctttctgctacttattgttttatttatttatttttttaagtgtaactccttttgaacctgtgtgcctgttgcaactacgctgagagggaacaataaaagttgtgtctatgggccgggtgcagtggctcacgcctgtaatcccagcacttgggaggccgaggcgggcggatcacaaggtcaggagattgagaccatcctggcgaacacggtgaaaccccgtctctaccaaaaatacaaaaaaaaaaaattagccgggcgtggtggcggggcgcctgtagtcccagctactccggaggctgaggcaggagaatggcgtgaacctgggaggcggagcttgcagtgagccgagatcgcagcactgcactccagcctgggcgacagagcgagactccgtctcaaaaaaaaagaaaaaaaaagaaattgtgtctatgctcggtgccttttcttcctggaggctaggtctgatggtgtactcagaaactaaaggcacaaaacctctaaaaggaaagtgagaattcagaggcaaaaagcttaacctgatttggacaacctcattgtcccttccaagattatgctctgctccttctctcggagggatttgcttcactgagaagccatccatttccattaggtcagtcctcttttcacccccatattgcttgctccaggatagtgggatctgagggtagttcatatcaattgataggtggttgcttgacakagaaactgaagtatcttctcttgtttccagaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtataacttgttccatacatgtattcagtgagtgttcactaagacataaagtctgctagtctgggaagtgggtggtgacatgtgaacttgagtaagatgcaattcctgtcctcaaggaacaaaccgtcacaatacgatgtaatgtgtgccgttattcattcatttattcatgcattcattcagcaaatatttattcttttttttaagacaggttctcgctctgtcacccaggctggagtgcagtggcatgatcgtggctcactgcagcctcgatctcctgggctcaagtgatcttcccacctcagtagctgggactacaggtgcccaccactgaacccagttacttttttttatattttgcagatacgagtctcactgtgtttccccggatgatctcaaatgcctgggctcaagcactcctactgcctcagccttccaaagtgctaggatcacaggcatgagccaccacacctgtcctctatttattcctttattcaataaatatgcattgagtatcctatgtacaccctggacaccccctatatacctggcactattccagtctctgggaataaaggaataaacaaaacaggctccccaaaatccaggccatcatgaaacttaaattctaactggggagacacaaacatgataaataaataaagctttatgaatagatggtgatggctgatatgaagaaaaatagagcagggaaagaaaataaggtgagaggatgcattgtaattttagacaagctgactgggcttaagtttcactaagaggatggtgtttgagtcaagagctgaaaggaggtgaagaagcaattcctgtggctatctagaaggaagtacctggtggagaacagcacgtgcaaatgccctgaggcatgggcatgcctggtgctccaagaatggcaaggaggccagtgtgactgcagaggagtgagaagaggagtaggaagtgaggtcaggtaaggaaaaagtgagggagcaagggaaggtcatttaaggcattagagagactcttcagggcttctgtaaacagttgtgccgtggacaaagtacctaagcaatcaagtgaatcgaggctgaaatctagcctgtgctccactcccccggccacataccctagtttagggctgcttccacctagagcaaggagtgcccatgtcttatccacagcaatgtgctgtggggaccagaaggagccctagaactttaatttcagctttgagagtgaaaaggggagccactgggggattttgagcaaaggagtgcatgacctggcttatattttaccaggtttgctataaaagtatgtgtttggttttgaagaataaagatactgcttcctataggtcaagagacaaaaaatagaaagagagtagcagtgattattagcatggttgggcactttggagtcctcttctagctaaggctttataaatcttactgaggtttatgaccatctacaaaatatgatttgtgccatcattttaaaattactatattttaacatatgcctcaaaaccacttgtacgatacttcaaaaataacacaaaagaaatgtcttgggtattgtgagatatgggtcataaaatcataaaatttaagatctagaagggaacttaataatccaagagttgttccagttgggtttctttaaaatcctaaactcaactcttcattttaaatacagcaaatctgagactctgagaggaagggtcaatatcattttcaaggtcatgcaaataatgtagttatgaattataaacatacacatcaaaatttttactaaccttcaaatatgatttccaaatatgcattactttttttaaaacaaatagtttgttccaaaaaggatttgaggtttacagatttaaataacaaatataatttacagcctaatttatgaaaagtgctgcatgtacgaaattgtcttgagtgctttaaattggaaagaaataatgaaagactgaactaaggctttaggtttaatctcataatttccaggatgtaaattttcctatcaggaaaaaggttctccagtttattttttagtgtcagtaataataataataataataatcccttatatatgcatggtgctttctagtttacaaaatcttttactttagtatttcatttgagtttcactgcatggaagaaagtattatctatactataggtattaggaaattgagtcacacagaactaaaggaatttgcccaaagtgacatggtaagttagcaacaaaagaaagactagaagctgggtgcaataccagtttattgcactttcgactctactaaactgccccttcctagtacatgtgtactatgttgattttaaaatacagattgaggccgggtgcagtggcttatgcctgtaatcccagtactttggaaggccaaggtaggaggattgcttgagcccagtagtttgagaccaggctggataacataacctggcatggtggcacacccctatagtcccagccactcaggaagctgaggtgggagaatcactgagcccaagagattgaggctgcagtgagctacaatcacaccactgcactccagcctgggtgccagcaagatcctgtctcaaaacacacaaacaaaaaaaacaaaaaataggttgagtgttcctgatctgaactgcttgggaccagaagtatttcagatttcagatttttttcagattttggaatatttacatatacataatgatatatcttggggatgggactcaagtctaaacatgaaattcatttatgtttcatatatactttacacacagcttgaaagtaattttacacactattttcaataattttgtgcatgaaacaaagttttgactgcattttgattgtgacccatcacatgaggtcaggggtgaaattacccacctgtggcatcatgtcagagctcaaaaactttcagattttgggggcatttcatatttcagattttcagattagggatgctcaatgtgtaaagacaagtaataccatattaagggatctcgttttgcattggtcatcttcaggaagttcctctaacaagaaaaagtaagtagcttctagaaactggaaggccataatacacctggtagaattattatgtcaaattcacatttttaatcatattaatgaatggaatttgttgatgttcaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggtaacatttctttgtcttgtttcatctccctgtagacatttttattttctcccccaccacactcatctggcctccatgcctttgtccaccaaatgagcatgcaatagatatgaataatgcctagaattgaaggacccctacaggttatctgcgtcaacactcttattatacagaagaggaaattagcccagggagttttactcagggaattcatggcagagccagaatcagaactcatgtctcctgactttaagcccagtacttccttcatgattctaaatcaccatgaaaggctagtaaggttattggcaattatatcatatcctatgtaataaatagtggttgccatgtagacaaaggtactgatgctccttctccacaacgaaataaataaaaagtgggagaaatactgattgttacatgttaatctatctagctatttaatgtaaactcatttgagtatgtatttttattacaactaattattatgtagtcgtataatacatgtttatattcaaagtttagatcgaatgttaatatcttccctgttgcctggatgtttagataatgatggagtgtgtatatttatatatatgtaatttagatgtagagagggccttcagtattaatttactgaccatgtaatgtgttttattttgggtacaattatagggttagcagaaaagactgccctattgattagcatttgccgccacagatataggcagagggaatggccacattgtttaacatctctgatctagtcatgtttctcagttttatagatgagaaagatgaggtccagaaagataaagtttattcatttattccttcaacaaatatttatgtacctgctaaatgcnatggacattgccttagtccattgtgtgttgctgtaacagaaaaaacgacacactggataatttacaatggacagaaatttattacctcatggttctgggtcctaggaagtccaagatcaggggggctgcacctggtgaaggcattcttgttgcattattccatggtggaagggcaaagagaaggcagagtggagggttggtgggagtggagtataaactcatctttttataacaaattcacttctataataagcagcattaatccatttatgaaagtggtacgccccatgacccaaacacctcccattaggcctcacctcctaacactgccacattggggaccaagctttccaacacatgaactttgggggacacattcaaaccacagcaggcancaagaaaaatatattacctacttgcctcacaaatcttatattgcagtggggtaggccaacaataaactataaataaaagcattacaaattgagatgaatgctagaaagggcaaaaagggaaccttaaaacagagaataacgggaaaggggagtttatggccttgttgtggagatacttaaggtcagactaaaggatgaggaagagataattgttcaaagactcagatgaattctgcaaacagtgacttgcctgaggttacatttgcagaatatatagaggacccagatctgaggccacacttccttcctgtccctgctaacagcatctttattgaggagggagagacctttcttccacctccacaatggggctcttaaccagtcttactgagtcagctggagtttcatctccagacaatgctgccctaccctctcataaaaagggcatttgtaaatagggagtacataaataaactaaacatatttttgtgccttgctgattgctgacaggacacaatcaatgccattgagggcctgacggaatattcactcctggttaaacaactccgcttgartatggacatcgatgtttcttacaagcataaaggtgccttacataattataaaatgacagacaagaatttccttgggaggccagtagaggtaaatgaagaactttstgtagtattttacaattggctragaccattgaaatcatctgttccactctttattttataaatctatctcttcactacttaaacatatattgagtgtcagctatgtcctaaacagggatgcctgctatatcctgggcactgaggattcaaaaataaaacacaaacaatcagcgtagtgcagggagattgtcatttaagcagatagtgaaaaataagagtcttgataggtacatggaagtacagaggggccctcctgatcctggctgaaagatggagggagtttgtcagatgtgtccagatgtgtgggttaaatctgaaaaaatcagaatgagttagccaagtgaagaaaaaggaagaacattccagacatagataacagcgcacagagcagtacagtgagcgtaggagggaaggcatgtctgggaggctgctggtggtcccttctggccctggtcatacatgcagactgtggccaggttggagttggcctttagggtccccagctccttgccccatgtcctttgctactgctggatttttaaaggtggtaactttgatggcttatgaaaatttcacaaagaacaagacatgttggaaaaactgggttctatattaatattagctgcccacatatagctgctgatacatatttttctaattactgtgtttgcattattttaaagtatatttaaatgtacagtaattggaaataatcctcattgttgacatccttcacaaattggtgtttgttaaaagtaaacaagcatgagaaataattttttttttttgagatggagtttcgctcttgttgcccaggctggagtgcaatggcgcaacctcggctcactgcaacctcctgggttcaagcaattctcctgcctcagcctccaaagcaggcgggattataggcgcctgccaccacacctggctcattttttgtatttttggtagatatggggtttcaccatttggccaggctggtctcaaactcctgacctctggtgatccacccaccttggcctcccaaagtgctgggattacaggtgtgagccaccatgcccagcagagaaataaaatttaatgcaaaaattgcaaactggtggcccatactgaaaaaaaagaatatggatataaacatagacatagatatatgccaacatttaaggatccagatatttcaaataaaaacctgattcccaacttcccttgataaaccaaaagacctgaaagcaaagcaccaggcattggcatggcttctacaatttactgcagtccccaccagtcacaggacgtatgcatgtgcatttatgttcatacctgctttgtgcccgggcctctgcaggcatttgtgcttgtggtccctagtttgggaatatgtctcctttccctgggatcatttagagttcaccggagattcatgttctgagtctaagctctaagaaggatctcttgaccttccagctacctgaggtagctgaaattattcttctctatagggataatgctgtaagaggcctcttgtcatcctaacaaaatttaaaccccagcccaggatgctgcttccatgtaaaacctgggctgttattatccagtgtggaattttctactccagcatttcctgaaatgtgttccatgaaagagtgttaggtggttgagtgtgcattaattaagttaaacaaattaatttaaattaagttaaacaagttctttaatccagaattcccctgttctgtaacatgtatgtgattaagtgtggtgactctgggtgtgaaaaggggcagaggcagggcacagtgcacagcatttcccaaacttatttgtcatgcatgcttttcacatgcagtatctcaagacacctgttttccaacaaatgctgctatattctatcagggagaacaagaatgttgacctactttcctacatttactaaaatttgaaggaaggattgagaaactttaacatatgcccaatccatcttgcattattgtgctaagcaaaggaaaggggaggcttggagtaaaggaagtgccaacccctcgggctcaaaattatctctcctgtactttccacaaattagggagcatttggatgacagagtttctctggagaggagaatgacttaactccgtttatgtcttcagtttcctcctagcagagtgggaagaagagcagcagcaactaaggatttggcaggcttgagtggggtgctagtggtttggggtggggtaccaggggtttctgcaaacaaaggcggtgacaagtggaaaagataaatcatcaagagatggaaaaggggtgcaaaggaggagctcagagaggaccaaagatagatgcacccgctttcaagttatgtggaggttccctgctctgggttctaatgaaaacgatctccattggcacacaggatgctgattcctgagctaggcacagaaaggaatttattcagttggcaaaaggagatgaagatccagatttaccatagccatatgtaaatgaaaatgtaaccagaagtgacctctgacatgttgcttttgttggttcactcaggagatctcagacatcttatttacatgtagaagggaaaggggaaataccagccttgtttagcacctgccatgggcataggattttcagtgtctcatccagttactctcagaagagctctgagagaggaggctggtacatgtcaacccacttttcatagctctatcctccctccctatcaaatgatgaaagaaagcatggtttgtttctctattatctttccaggtgcttctcaatgatgacctcattgtcagtacaggatttggcagtggcttggctacagtacatgtaagtatttaattgatatccaataacgagttatgtgtccatttgtactaggtaacataaaagttaggagctttgccacaaagtcacagaaatctgggcttgggtaaccatgactaaagtgggattcacttatgtaaatctttctagcaatctttgtaactatcctcacaatttttttgaaaataacaatgttggtcaggcatggtggctcacgcctttaatcccagcactttgggaggcctaggcgggcagaccacgaggtcaggagatcaagaccaccctggctaacacggtgaaaccccgtctgtactaaaaatacaaaaaattagccgggcatggtggcgtgcgcctgtattcccagctactcagaggctgaggcaggagaatcacttgaacctgggaggcagaggttgcagtgagccgagatggcacaactgcactgcagcctggcaacagagcaagactccgtctcacacacacaaaaaaatttaatccttatatgtatacattctgtatacttatagaaattatatatatttatagagatatataattttatgattatatatgtgtatacgcatatggcatatgtgtatatacatatatctgtgtacatatgtgcattgtatatatatatgttttctatcccatctcatttatccaggattttgggggatttatgtgttattcataaagacttatttcttcattttagccacttggcagttgcaattttttttctttttttttttttttttgagatggagtcttgctctgtcacccaggctagagtgcagtggtgcaatcttggctcactgcaacctccgcctcccaggttcaagcaattctcctgcctcagcctcccaagtaggtgggattacaggcacatgccactacgcctggctaatttttgtatttttagtagagacggagtttcaccatgttgaccaggctggtctcaaactcctgacctcaagtgatccgtccaccttgacctcccaatgtgctgggattatgggcgcgagccaccacgcccagctggcaggtgcaaatttttctaggctgtttaagtatkttcatgcattcttaaattgcatgttctgagcataaattaacatcctattaataattttaatcacgctcttatctttagtgcattcattccttcaaggactgttgtaagtttatatgggggaggagagattgtccacttttctgccacttctggttggtgtcaatatatctacttctggcagcacctctgcccattcatacacacctataatttgttgtttgccatgatggcgtgtggctggaagaaacccacacttcttagccttgtgctgttgtgtgtaaaattaaagtggaaaggttcaaaacaagaaccttgggaactctcctgtagagtgaggtgcccagatttgactgcatggaatttagaccaagcttctgaccggccagaagtcattttttgcttactttgggcctctcaggtttagattatggagtttgcttaaagtccagctgctggaaaaatgagtcactaatgtacaccatttgtgctggattatgaaaatgatccttcgagcatcccatctgcagcagcagtgttgccataatacctttgtcactttcccactttaaatagaatcttcttgcttacttgtccccaatgtaggtaacaactgtakttcacaaaaccagtacctctgaggaagtttgcagcttttatttgaaaatcgatactcaggatattgaaggtaaaaacagcaggatttacgctgtaattttggctaaaaataaagcatgtgtataaatagagagcttctctgattagtaaaaatgtgcttactcaaaaagtgaaatttcttaaccaaatactttagcaggttgacatccaagtaaatattacttccattttttacaatagataactctttaatatagtcggaagctaatattaaataacaatgactaagctaaatgtatttgctattgatcaataaattgttttgactatgttatttttaaagagtgtaactagttgtaaagccacattaaggtctaattccagaaccaggaatttctgttacttttgtgttagccttccaatctgggaccttgaattctcttatcaccctgttagttttccatcccttagcctttctgtattccaaggggcccagaaaataaacatttctctgcctccatctttaacttagtctctcctgtacccctttcttttttagtctctcctgtaccatcctttctttaaatgtacccctgacccttttatttaacccaaggccctcacatccctctgctggttggttctcccttcctggtccaaaagcaagtccacttgcacactccagtcctcctggtctccccattgcctccagggtcagaatgaatgttgctgcctctgccctgatattttccatctattgctcagaagcctgttcctacaggaaacttcccaactaccagcaaattaaggcatctgttcttcctccctccaacatcccccaaacatattaccaatacatatttatctttaataatttcttcattaaattataagttatttgagagcaatgaactgttaattatttaaagacttcctggtattgtcaatagccatgaatttccattagaaccactgaaagtatctaaacttccaaatcacaaatcatttttaagtgtgttcaaagatttgctcattaatgattctgttctgacaggttccaaagcagctgaaaacagtttactcttatatttgtctgtttgttttcttgtyttatgtgccagcatcccactacagaggctacggaaactctgattacaaacgcatagtagcatgtgccaggtgagcctatttccacaaaggggagcatagactccaagttctcatttttgttaacgtattgtttctttacatattttcaaattttggtatgtccagaagatacaaaattgttcaattgtttaaaaatgcagaacatatatattcttaaattkctacttaccataaaaaacagccttggttttgctcataatagttttctctgtctgttttgtcttctgattcaaacagtgtaatattaattttttctctttcagagggatagaaatgtgatttaaaaaattaggaaaaaaatataaaagattctctcaaaaacagcccctactctcttacttagaaaaatcacatttacctaacaaaatccattatcagctagattctcaactcaagctgcacattgaagtcagctggagagctcttagagctgtccaaatgtcccgggctccagaggtcattctaatggtagccagggttgagaaccamtgatgttaaaccctctcccaactaaataccgaggcctcaattggccactgtattagtttcctgttattgctaggtaacaatttattgcaaatgtaatggtttaaaccaacacagttttactatcttgcaattctagaggtgagaagtcccaaaatcaaggagctgggtagggctgtattccttctggaagctctagaatttctttgcctattccagattctagaggctacctgtgttctttggcttgtggcccctctctgtcttcaataccagtgtcacagcatcttccaatctgactgtgacctctgcttccatcatcacacctccttctctgactctcctgcttcctttcctcataaagattcttgtctttacattaggcctgcacaaataaccccctatctcaaatccttaatttaatcacatctgtaaagttctctttgccacataaggtaacatattcacaggttcaggggattaggacatggacacccttgggggccattattctgcttaccacagccaccatcctaaaacatttatgaaagtgtaggttttttgccgggtacagtggctcatactgtaatcccaacactttgggaggccaaggagagagaattgcttgagcccaggagttcaagaacagcctgggcaccatagccagaccccatctctacagcaaattttaaaaattagccagacatggtggcacacacttgtagtcccagctactcaggaggctgaggcaggaggattgcttgagcccaggaggttgaggctgcagtgagctgtgaccacgccactgcactccaacctggacgaaaaattgagaccttgtctccaaataaaaaaaaaaagaaaaagaaaagaatatgtaggtatttgaaaatatgtatatacttttggctttggtgatcacacagtgtgatcagagagtggtagagccaggactgaaacacagacttcttccctgttctttccatcgtccctcagtcctttctattgtgttctattttcttaactcttgtattgtcaataacagtgatatctgtggatggcattttgctgattttacttataatcatgcacccagtgtggataacttggaaattcaatagtgttgtgcaaaagatgagagctgagaaggaccttagggatgatatcataatcctcttgttttggaaatgaagaaactaagacccaaagagataaagtcgcctgccaaatgctcacagagttagaggcagagctaggggctcaaatccccaacctctgatgttcaatccagtatctaaaccacatcttttttttttttttttttgagatggagtttcactctgtctcccaggctggagtgcagtggcgtgatctcggctcactacaacctccacctcccaggttcaggtgattctccttcctcagcctcccgagtagctgggattacaggcacatgccaccatgcctggctaatttttttatttttagtagagatggggtttcagcatgttggccaggctggtcttgaactcctaacctcagctggtctgcccaccttagcctcccaaagtgctgggattacaagcctgagccaccacgctcagcctaaaccacctctttcaatcagtgtaatctaagaccactaatcccaaggaacagcacatagtttctccctgcctccctcccagctgtttcccagtcttctctatgtcccaagcccaatcgcttcttaggattccttcactattcagccctatttccttcctcatcagcatttcttccttccagcatttcctacttccttctgtggccagtccctgctctctgttcccgctcaaacatctttcctcattccctaatgtctttccagtaaggtcgccctttcccaggcagcttctttccccctaaatgccattcctacccttgggcacctaccagctggggaggagcatgatcacaattacctttaaatttgtaacagttgtcaaagggaagtgtaagcaaacttctgggcagagctcgaatcagtgcctgggaccctacagggaggcatctagacttgcaataaagaagagctctctgatagggtgagacacctgtgggatagcctctaccagtaagaactccagtgaccttcaggaaatcagtttacttctccaatcctcttctataaagcaaagatattgcactaccttatctcaagttttctgccagttctaattatccacaattctgccgtacagaaaaaygctgttatcaaaaattcattcatttgacttcattgtcaggaggcctaattccagattatcaatatacaaaagaaagcaaggagaaatgcaatcttgaatagtctatcctttggtttttacaaattggggacaaaatgttccagaaaggcgggtggaatatgcttttggctctgttgacactgaagttaggttgggtaaattccaaaaggaactgtgtagtacttattcatgtaggaacttctttgccttcaaatattctctctcctgattaaaaaatgccagcatgaagtttctgtgttcagagggtctctttcgtgtatttacctttttacaacctctctgttgtattcctaagaaaagaaaaaaggatttcatttccctcacaacaaaatgcctttggggaagattgctggttttggcagcaggcaaagggcttcttgaaaggaggatttctgttccaccattgaaacagtctccatggcaaccagtcatcaaggctccagcaaccttttcatagacactctccactcgggaggcccttttccatcctgctgacaaagtgtttgcatctgtgagcaagagtgctctgcttctacccatccaattagggagatgttcrgatgtcacattagagttccaagtgttttatattctgttctaaattgttaatttggtgaagaatagggttaaatttttatgagtcagagattttagaatacttttctttattgtggcaaatattacatctatgacttctaatggggactgcttttatttatttatttatttatttatttatttatttatttatttttgaggcagagtcttgctcagttgcccagactagagtgcagtggtgcgatctcagctcactgcaacctctgcctcccagcctcaagccattctcgtgcctcagcctcttaagtagctgggattacaggtgtgagctaccacagccagctaatttttgtatttttagtagagaagtggtttcaccatgttggccaggctggtctcgaactcctggcttcagctgatctgactcagcctctcaaagtgctgggatgacaggtgtgagccaccgcacccagctgggactgcattatatatgctctatgaggtgtcattgaggaaaagatatgccctgacccctcactaacttgcttagtatctcctcttccaccaacattcatacctgtaggtgagatcaattcattttaccccttatgaagctgtcttttaatttcttcctttaatcctgactgctctcccaagcttcactctcaaacatccagctgcctttcaagcatcttgaggtgaggctggaacctgaaatcaacttttacagaatcacactccgtctgtctctgccccagcctcagccccgccagcctgtctcttttatgtcttctaacatctcttaatggtagctctaagcctctgccacccaaaaccaaagcctgggaattataaagataaatttaaaacacaaacttatacttcttcacagttaattttacaaataagaaaatgagcttagaaaggggaaatgatttgtgggaatctcagaactggaataaaacccaagtttcctgattctccatttcagtattcttttctctcttacaaaacaaaaacaaaaacaaaaccctcccattgtgccctttttgcatttccgcttaaattcctactagcagaattcctactgaaaggacagtccttgaaacattttctatataaagtagctattatgggaaatatagaaaatagagaaaagcatgaaaaagaaaagagataattgcttataatctcaccatccaaagtagctactaatatttgtgggtttgtttgtttgtttgtttgcttttaaagagggattctcactctgtcgtccaggctgaagtgcagtgctgcgatctcggcgcactgcaacctccgcctcccaggttcaagcaattctcctgtagttaggattacaggtgtgtcccaccaagcccggctaattttttttgtatttttagtaaagacggagtttcaccgtgttagccaggctggtcttgaactcctgacctcaagtgatctgcctgccttggcctcccaaagtgctgggattataggcgtaagccaccgtgccttgccttagtgtattttcttccagcttttcctggacatgtttattgaatctcttttcaacatacaactgattttttccttggaatatgcttcattagaaaatgaactaacgtgagaatccaaagacctggattcttctgtagctctgcatgaattagccatgtgaccttgaaccagtgccttactctcatcctgagtttccccagctagttagcttggtgtggatgacttctgtgttccagtagagtggtctgttgagattattgatcaagtgaggaaagagaatagatgactcaaagatctcttgcaactctaaagtcagagattttaacccntacattgtagaaaagcaaataaatggagacccaaatttaaaaattaaggtctactaaggaagagtgtcctttcttaaagactcttattcacttatttattatattttctaacctcytttttattttagctacaagcccagcagggaagaatcatcatctggatcctctcatgcrgtgatggacatctccttgcctactggaatcagtgcaaatgaagaagacttaaaagccgtatgtgttttcttttaaatcgtgttgtgaatgcttcattttcttttctgaattattttatagacaattttactttctttcatttgaatataccacttttatagaatcacccagaatatttttttttttttggaggtggattttcactcttgttgcccaggctggagtgtgatgcagtcttggctcattgcaaccgcacctctcgggttcaagtgattctcctgcctcagcctcccgagtagctgggattacaggcatgcaccaccacacctggctaatttttttgtatgtttagtagagacgaggtttctccatgtcagtcaggctggtctcgaactcctgacatcagggtgatccactggctttggcctcccaaactgctgggattacaggcgtgagccaccaggcctggccagaatattcttttcaaaacataattaacctaagttttgatttatcaaagtgaagcagaagcatacactagcatgctctgtaaaatatgagtttatatgctaatgtgttcagactttttcaagaagaggaactgctcttcaatttctttgaattacagatcacatccctgcattgtgctatctcatcaacaggtgaatgcatttaaacaaaaagataatgaaatgaaattcaagcttctctcttttcccccttagcttgtggaaggggtggatcaactattcactgattaccaaatcaaagatggacatgttattctgcaactgaattcggtaagctccacctgcaaccatttttcctttactattactattcaaaatatacaggctaaaagattataaatatcatctctccataatttccttaaatccttgaatttgttaaacagattccctccagtgatttcctttgtgtacgattccggatatttgaactctttgaagttgggtttctcagtcctgccactttcacagtgtacgaataccacagaccaggtaatcaactccatgctaacatttcttcagaagaatactttgtattctttccagaacatttagaaatccactagagtcctgtaaattttatgtattgcctctcttagggaccactcttcatgaaagtcccaatttgaacattcaaaactactgcatacaaaatattgtacataaactacttcttgacattgagcagaccgtttcacctcagtcctcagtttcttcatatttaaaataactggattatagtgcctccaacttcaatattctttgcctcaggtttatctatggtgttcacagataaatcatatctctccttttgagagaaatcaactcaatccccccagaacaacttctagcccatctatattcttgttacactttgcagatagctctattatagcagctgtcacattgcattcaattatttgtatgtctttytcatcaaccccagggtgttttcattcttgtgtccctagtatctaacgcagcgtcgggtatagaatgtgaactcaataaatatttatgaatgggtgatcccacatttgactattcagccatttttgagaatgttatgtggttggagagcttattggatcacaagacagatgactccaccttgggcagttctacttgttagaaaattcttgaagtgaaccaaaactctgacacccattcattctagttttatattctgaaatcacatagaacatacatagtccctcttccccttgagatagatatatagagatacatagatatatgcttttcttcccttgtccaccctaaacaattccaactctttcaaaagatcctcatgcaacataatttattttcctcttacttagagaagcatcaaatgttttatttctgagaaacgagtgtttcaagcacagaactaagtgaaaaaggggagatctttctgagggtagcggaacccttcccaggacagccaattcataattttacctccctgggccttagctataaaaagaagggtttaaaataagcaatctctgaggctccatgtaagacacttgccaattagtaaatgtgttgttcttcaatcaaaccacttctcttaaccacacttttgttgccacagataaacagtgtaccatgttttatagcacttccaatatcaaaattcagaaagtctgtgaaggagccgcgtgcaagtgtgtagaaggtaaactttatttaacatatttaggctgcatgcttatttaaagcagtcgttcataacctgaggttaatctgggggacactgtttggtaaactgttctttctcagaagtagaaatgctatctcagctaattgaaagctaatgattccttsagcattgtaaaactacattttcacagttcctgaacaacctgatagttcatgctgtacagaggcagggaaacaccatcgagagggttgttgaatattataggggcaacatgatgtgagattttactttcacctagtctttttatcatataagacnagaggctcagcactgaaccactagcttctgttccttttctcttatacttcccagttaatggaattcngtttattgtccagttccatttagtctttcctaaattgargaaagccttcttggccaaggaaaagatccagaactcaccaataatcaacagctggctccatgagggtctcagttagttttggttttttcaaaatcctcaatatctacacattttctaggtacttattgtgccattttatagctataaatcagtcacattatcattttgggtccttcaaaggacttctgattatactcaaaatggaaaatttccccctttcatcaagggaaccacatacatttctaaagacctgaatgtggagtagccacccagtctaacaataagtcttatgccaggggtgtccaatcttttggcttcagtgggccacattggaagaagaattgtcttgggccatacataaaatacgctaacactaacaatagctaatgagctaaaacaaaaatcacaagaaaaatttcataatattttaagaaagtttacgaatttgtgttgtgccgcattcgaagctgccctgggctgtgtgctgcccacgggccatgggttagacaagcttgtgacatgctcaagattttgttttttgtttttgtttgttttgttttctttatgtaatatttcactttatgaaagaaaagaaaatgggcaggtcttagaaatctgacatttgtaaggttatattgggttgtctctgggctcatgagaaaccgtgtttactcctggaaagagtgtctacttctttccattaaccttatttttaccaattttcacaaaatccagctgattgtgggcaaatgcaggaagaattggatctgacaatctctgcagagacaagaaaacaaacagcatgtaaaccagagattgcatatggtgagttcaaaagttcaatatagctcctttaaacatgaaattttatgaatatgtgttcagttagaaagatcaaaaactttatatagtgattatatgaatacaacattccatgtgatcccctgaaggaaaatgccatcgatttttagcattaacatgcaaagtttttattcctcagcaaagaaatgtgattttcattataaataatagaagtgacatgtatacccagccaggatactttcccacaatagagctttttcaattacaggcactaaaacatagtcaaagggaacttttgagaagccacagaggtataagatttcagttctgtactcttccaattgatagaccagaggcagaggcaaaggtgatttagggggyttggtttttaaaaaaatatcttcagggtaaaaatataaataccaaataatttttaatatattcaagattgcaatccatgtttgagacactctccatttgaaaaagcaaatctcagtgcttctagttgtccagcgcttagagctaaattagtgttcaagtacagttgtagccttgtctcagttcctgataaaattagctcctttgttatctattcagtttttgatgtttattgctggcattttttgagagagagagagcatattgtacactatctcaaatcattttttcattttgaaattggaagggtggagccgggcgcagtggctcatgcctgtaataccagcactttgggaggccgaggtgggtggatcacctgaggtcaggagtttgagaccagcctggggcaaacatggcaaaaccctgtctctactaaaaatacaaaaattagccaagcatagtggtgcgtgcctgtaattccagctactcagcagggtgaggcgggagaatcacttgaacccaggaggaggaggttgcagtgagccaagatcgtgctactgcgctccagtctgggcaacaccagcaagactctgtctcaaaaaaaaaaagaaagaaagaaagaaagaaagaaagaaatttgaagggtgttatttataaattaaaaaaataaacacagccaatttggtactttgtgtttagcaacagcttccataaacagtttctcattgcaatggaaagggttctcattcttacggaaagggtctcgtaagaacttcatgagggctgggtgcggtggctcatgcctgtagtcccagcactttgggaggctgaggcaggtggatcactttgagctcaggggttctagaccagcctgggcaacatggcaaaaccttgtctctacaaaaaatacaaaaattagctgtgcgttgatggctcatgtctgtagtcctagctacttgggaagctgaggtaggaggatcgcttgagcctgggaggtggagattgcagtaagccattgcactccagcctgagtgacagagtgagaccctgtcaaaaaaaaaatgtaacagagtattatcactatttaccagtgaagaaactgaggctcagggagattaaataatttgctcaaggtcatgcagaaagcaagtaatagaattaagatgcatcctgatctccagtattttttccatcgaagtctactgaattctcttaatagtaattcaggcaacagaataagttttatatggttaataacwtttctttctttgaatttatattgattttggaaaaaaaaaaaagctaaaaagctgcctgactcagcctaggcccactgcagtttgttaaatacatgaagacttgagaatactatattgttttaacaaacaaaagttccactaaattatttcttccctccattttagaactattttaaatctaaaatatcagaaatctattttaacacagagaataaatgcaatttgggtttattgtgttgtttcaagaaaagacttcgctggctttttctggactacaagccagaataacagaatagaaacaaaattaagtagttctctctctgtacccaggcccacatagtaagtacattgcccatgtccattataaagacttatgaatctgaaagtcagaacacttttcatgcattttaagccactaatttacatagcccctggttctgccatgatgagttcacctagctacctctcaatcagtcaatctatatctgggatagacttaaagacttgagggatatctagaatgaacaaatcttttaggtcactaatttcaaaacaaaaaatagatcaaaagcaaaaataaaataaatctctcctgaggccacatagaaagaatgggtcccttcaagctggtctttccagacctgaggtcaagcacattatgcatcaaacattgatatctgaatgaagggaaaacaggattgtaggcagctcttgttaggtagttgccaagcaagggtgagtgagaaaacagaatcatcctaaaaaccaaggattaaagccagtggaactatatgaggaagcaaagcaaggaaccaagaaagctcacatggtagacctgaatgagagataaggcctcctctgtggccatggagaagagaatgaaggggctcttcaaaagatgcccatgggcatgactccactcatcttaaaggatcagcctctgaacttaacatctaacaaaggtttatcttgtttgtttgttttatgtgcttctgttattttattaaatatgtctcttattctaatcagcctgttctataacattggccagggctaatgattctaatagattgagagattgaatcagactgaggggattggggaaggcttcttggaggaaataagaactataatagtttgccatgcttcatttctcgtgtttgacaaattctggcttctactggacatagcattaatagtattaagactgaattgtttcattgttgtttgtcttttgccagcttataaagttagcatcacatccatcactgtagaaaatgtttttgtcaagtacaaggcaacccttctggatatctacaaaactggtgagaattcattcgttcattcgttccttcattcagcaactatttagtactgactatgtgccaggcattatattaaacacagaagatacaactcaaataagacagagctcttgcctttttaaagcttatattctacttggggagaaacattttttaaagatgttcgtataaatatttctcattgaattcatttttctaaaacttcagcaaaatgtttttttcaattgcgtaattgtccaatttctttttctttacaacttttattttaggttcaggggatacgtgtgcaaatttgctacatgggtaaattgcatgttttgggggtttggtatatagatcattttgtcacccaggtaataagcatagtacccaataggtaatttttcaatcctcaccctctaccctcaagtaggctctgctgtctagtgttcccttctttgtgtccatgtgtactcactgtttagttcccacttataagtgaaaatatgtgatatttggttttctgttactgtgttaattcacttaggatagtggctttatttctgggtnctgtaacctgttccattggtctacgtgtctttttttgtatcagtaacatgttgctttggttactgtagccttgtaatatagtttgaaatcaggtagtaggaggcatctagctttgttctttttgcttagaattcctttggctattcaagttctttctttgttccatatgaatattaaaatgtttttttctaattttatgaaaaatgataggaatagcattaaatctgtaaattgctttggacagtatggccattttaacaatattaattcttcctatccatgagcgtggaatgtttttccatttgtttgtgtcatctctgatttctttgagcagtgttttgtaattctcattgtagagatcattcacctccctagttagctgtattcctaggcatttttgtgtgtgtgtggctattgtgaatgggattacatttttttttttgaaatgacgtttcactctgtcacccaggctggagcgcagtggcacgatcttggctcactgcaaactctgtttcccaggttcaagtgattctcctgcctcagcctcctgagtagctgggattacagacatgcaccaccacgcctgacttatttttgtatcttagcggagatggggtcttacatgttggccaggctggtcctgaactcctaggctcaagtgatccactcgcctcagcctcctgaaatgctgggattacgtgtgtgagccaccgtgcctggcctcatttcgattgatataaattttgcaataagtaggaccataaagctaaattgcaataatatgtttatactaaatttttttctcttttgaaattctatcaaatatttcaagtcctaaaatgcttgattttttttcttttgagacggggtctcactatgttgttcaggctggtctcaaactcctaggctcaagggatcctctctcctcagcctcccagcttgattattactaaccataccctagagtttaaaattctagtaatatttttcaattttgtatttgctttatcaacactttgataattttttttaaatttttgttattttgaaagtttcattgtatgaaacttatttgtgaagttattttatttttttcttcattgatggtcacaattttttaatttgcaggctagttgccattctaatgaaataagtgtttagaactttgatgttgccacagtccaacttttgagcaacattttcatccaatgttcatattacaagcagtaataagccattctctttttactgaaataacaaagtgcttttcattccagaaatacaaattatttgttttatttgatactgattcttgcatagtatcaaaagacattttagactgttctgaatttttcatagcatcggatggttcccaagctacaatttttttattagtatcatttcttctttgttctcctgtagatccaaagatgcattttatgatatttaaaaggaaatgttaagaaacattggcatacttcatctcctcattctgggcccatttttaacacataaattttgaatttttataaatataaaaataccacacactacttacagaagaattgtggcacagtgaccataagccatttagaatcaagggcaaactgtagtttgaggataamgataaattggtatttctccaaagcacagagtgcttagaataggtaaggatatagaagaataaaagtttagttattgttgaagcccagggtagttgcctgttctctcttctgaatatactttaaattttccatgatgagaagcttaaaaaataataaggccccacacagctacactgcttactatgacaggggctgaaatggcagatagtactggtaatgttgctcagatattgacgtaataggaatctacaccatcagggcagcctaagaaatcagcttgaactaatgggtgtacactgaaatttatatcactaatgaaagtttaccatttacacagtttctattatacactatttgccaattggttcagaagtttttcaggacttaacaattaagatgactctgccagaacttaatagttaaatatcagccctgtatatatagcgataaatcagacacagtccatgccttaagaagtttctagtctagctagaaggacagatgtgggacaaaaaattgtgacagaaattcaagtgtaaaagaggtaargaggagacagaaagatatttaaaacaaagagcatccaggaatattttactggatactgtgagaattgaaggagactttcaagataaatgaaattcaagaggccaacatggggaggaatgcattccaggtaggggaactggctacttgtgagttctttgrgaatcccaaaattactatctttgaagttttccaagtctttcacattttgtacttttccacaaagttaacagttgccaaataccaaataattttatattttactatataatgtggagattaatgttgttcaactgtagagaggttcttttaattctggttatataagagtaataataagtacttacatagttcctactatgttccaggcacttttcatgtattaactcatttaatctcacgatggttctacaaggtaggttttattatcatgcccagtcttaagatgagggtctaaggccttatacagataacataaatcattttcccagagtcacatagccaggaagcagcatgcttagagtttaacccaggcagtctggctccagagactgaagccttaaccacatggatatcacggctgtccactagccatgaacctctcaatagccacgaggaaccagaaaacttgagagtttataattgtgacattaaaacatgaatggtataaccttacttgacttgcatgtctctcaggggaagctgttgctgagaaagactctgagattaccttcattaaaaaggtaacctgtactaacgctgagctggtaaaaggaagacagtacttaattatgggtaaagaagccctccagataaaatacaatttcagtttcaggtaagtcaccaatatttttcagtcactgatcttccctccaaaactgagtataatttattcttaaatacactacgtgtttcttatggccctgctcttaaccaacaaaccattttgaactaaataatattaatgtcaagcaaagaatgatttaaaaccatcgtggcagctgaggacttagctgcctgattaaccatctgagtgtctggacctgatgatgaatctgaaagtactcaccggacctcccctaaccaccacaccagctcccttgatagttctcagactgtttgtaaagaggaaaatgtgtaaatatgtattgtattatctgcttttagaaactagtcattgaaatagatgtactttctgcctttaatatgggagccccaggcagctttacaattccttaagggtttgtgaaccctccccaggagaggccggtacagaagagtttggcggacagcctgacccctggggacctgaccacagctgggctcttataaaataaatcaggctgrgcacggtggctcacacctgtaatcccagcactatgggaggccaagacgggcagatcacaaggtcaggagatcgagaccatcgtggctaacacggtgaaaccccgtctctactaaaaatacaaaaaaaatagccgggcgtggtggcaggcacctgtagtcccagctactcgggaggctgaggcaggagaatggcgtgaacccgagaggcrgagcttgcagtgagctgagatcacgccactgcactccagcatgggcgactgagcaagactccgtctcaaaaaaaaataaagaaatcaaattcagcttttctgttttgtggccacctcacaaacactttgtttcttggtaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcaaactgtgctaaaaagcctgttattttatgctagatcagcttcaaccacacaaagacaggcaaattgagagagatggagaaagtcagcagtagagaaccttaaccttgagcgggcttagcctcagagccctcagcgcactgagaaggtaggtgggtttgtccctgccccctccccgtccattgccctctccatacccctgaagggagaccctctactctctttccctcccttccggcacatgttcatttcccccaggaacctgctctcgccaacaattgctttactaaaagacaggccccagtgcagcaacctggtgaaaagaaactgagtggcggatcgggagacctttctccagccctaaccaggtctctctctgagcctcaatttgagctttataaaagaggatacataacagaagttaatttttaagtgacattttgcagcacttcagatcatattaaaaagctctcgcatatattctcatttaatgtctcaagcctctcacaagattcagaaattattatcattatcatccccatcttacagataagaaaattgagatttaggcctggcatggtggctcaagcctgtaatcccagcactttgggaggccaaggcgggcagatcacttgaggtcaggagttcgagaccagcctggccaacatagtgaaaccccatctctactaaaaatataaaaattagccaggctaatttagcaagcctgtaatcccaggtactcagtaggctgaggcaggaggatcacttgaacccaggaagtggacgttgcagtgagccgagatcatgccactgcattccagcctaggtgacagagtgagactccatctcaaaaaagaaaaaagaaaaagaaaagaaaattgaggttcagaaaagtaaagcagttttcccaacctagtaaggaaaagaattggaaatcaaaccccaagactctatctcagtttaaatacatctctgttccacatcactacatattgcttgttgggttgaattttctaacagtaaggcaggatatagtagaagtttcttagacacagattaaccagccccactgaactatcacaggaaacatgaagatgacctccggatgtaacggtaattaacagagactggaatgcatctccttttgaagagtctgctttttactagttaggtgaagctacacaaggccttgtagtgtgcctttgtaaataacactaagattttccacttccagggactaaggacttatttttctctaatgtcaaagctcacattgtaggcactcccttggcaaaaacaaccaatgtgtcatgttcaagatgcccacactccctgtcagcgaggggtgaggagaccttctccagagcaggcctctcggtgtctcctgtcacttccttgctgggaggagggaaccactggtgctgcttcgaaggcacaggagtctgactgccttttcctgagcactttggcaaatagggcaggccacagtggcctaattaacccacaatgcagctgtcaaatatcaaagaaggttttgtgaattagcctggcaccatttaaaatatctgccagctcctcttcagctaactcctatgcatttgaacatattttctcagtgaggcttttgtgaccctccaaaccaggctgggcccattacccaaccctgcacttctcctccaaggcacttgtgctcttgcaatgatttacttaatcagattgaattattagtttagcgtgaccacactgaaagctccacttaggtaaggtctgagtctgttctattcgccagtatctcctgtagttggcacaatgtcgggcacatcatagggactcaataagtgtttgtggattcccctacagtgtagagaatcagaagacccaagttctagtcttggctttggccctaattggcagtgatttgggacaagcctcttaatctctttgatagcctataaaataagggaattggacactctaatgtctcttttatctatagctaagaagatgttctataatcttatgatgtgaaacaggaaaaaccaaacggcatataagcatccaaatattgggcttatgtatttcattctttctttctctcttttttttttttttttttttttgagacacagttttgctcttgttgcccaggctggagtgcaatggcgcaatctcggctcactgcaacctccgcctcccgggttcaagcaattctcctgcctcagccttccaagtagctaggattacagacatgtgccaccacacccagctaattttttgtatttagtacagataggttttcgccatgttggtcaggctggtctcgaacgcctgacctcaggtgatctacctcccttggcctcccaaagtgccgggattacaggcgtgagccactatggccggcctgggcttacatattttgtctgtaagtatggagacagtgcagagaagtaagctggaagagctgccaaggctttctgtagaaggacactgggatttgggtaggtgggaggtacagggaaggcctttctggttaaggggcaacgcttaaggcaggtttccccaggggtaagcaagatgttcttaggtgatacgatgcacattgttcactttagtggctatatgtttattttaacatgtattttaaaaaagtaattagcacatcaaagccatgatgtaacattttcttccaaaataaatctattttccaagaagtaagtctatttaagaaaaagtattgagtaaataaaagtaagtttattcttagggcaaaaatcatgcagttggcatgcaaatgattgacgtttaagatactctgtcttaagaaaacacgtggaggtctgtgagccaaggttgaggcaagcagccttgctccatatttctcagtgagaaattctggaccaaagtcatgtttagtctttctttccagaccctatgatgctgatgtattcagcaacacccaacaaacatgtattgattggtgactgcaggctaggcccaattctaggtgcttggtaccaagatccctgccattgtggaacatagattccaactgggagagatatgtaataaaaaataaagagaataattaagcaattagtcttggatctcagaaagtgataagagcaatgggaaaaagaaaaagcagactaaaggagactggtaatggtcaggggaggggttgcagttctaaatagggtggccaggtcagggtgggcttcaatgagaaggtgaaatttgagcaaagacttgaaggatgtgaaagagtgagccacatagctagccaaggggagagtgttcctggcactcttggtacatagtgtccggcctaaggcaggagcatgctggtgtgtcacaggaaaagcaaggaagcaggggtggcaggtgcagattatgaagccaatggaagaggctttggctttacttggaaggaaacaggagccattgcaaggctttgaaaagaagagtgacatggtctgtcttgcctttttaaaggactactgtaactgctgttgaaaataaggcaagggtaaagagaacggataggaggctactgtaataaactaggtgagggatgatggtgcctcagaccagagtggtagcagtggaggtattgaaaagtggttgaattctggatatactttaaaagtaaatgatacagtttggatatttgtcccccaaaatcacatgttgaaatgtgatccccagtgttggaagtgaggcgaggtggaagatgtttgggccatgggagtggatccctcgtgaatggcttggtgccctccccatggtaatgagagttcttactctgtgagttaccacgagatctgattgtttataaagagcctggcacctccttctagctggttgcttcctctctcaccatgtgccacttaggctcttttttcccttctaccatgactgtaagcttcctgaggcctcaccagaagcagatgctggcaccatgcttcccgtatagcctgcagaaccgtgcgccaaacaaatctcttttctttataaattatgcagcctcaggtattcctttatagcaatacaaaagggactaatacagtaggcttaattgaagggactaatattgtaggtttaactgaattccctgatagagtggaaataagtgtgagagaaagaaaggagtcaaggatgatgccaagacttttggcctgaacaactggaaagatggagttgcctgagattaggaaggctgcagatggagcaggttgtggggagttaggaatctgttcagttttggatgtgttgaattttagaagaaatctattaaacatccaagtgaaggagcctggaaggcaattggtcatatagttatctagttcaggagagagctctgggctgaaaaacataaatctgagaatcatcagcatactaaaaccattagactagttaagatcactaaggatgtgaatacagacagaggagtggaaaaaaagaagaccaaggatagacattttgagcattccaagatgaagttattagagaaaagagatagaggatccattgaattaggagaaaaaacaagagatgaggtcccctcaagccaaacaaaagaaagaggttctgggaggaagagtgttgaactgtatcaaatgcttcagagagaagtaagatgaagacttggctgttgggtttagcattggtgactttgacagggcaggttgggtggagtagtgggaagaatagcctgaatagagtgatttaagagtagataggaggagaggatttggagacagggagtatggacaactcattcaaggagcaaagaaatggattgaggggagtagagtgaaggaaagtttaagacggaagaaataacacatttgtgttctaaagggaatgactcagtaaagagtaaataattgacgatgcaggagagagaaaggagaactactagagtaatgtccttgaagaggtaagagtggataggatctggagcacaagtggaggacttggctttaaataagaacatgactagctcacctatgccaggggtcagcaaacttctgtaaagagccatgcattaaaataactgtaatattttaggctttgtgggccataattctcataagtctctattgcaactgctcaactctctcattgtagcacaaatgcagccatagataatgcagaaaagaatgggcatggactaggcaggctggatttagcccttgggcagcagcataccgatccctgatccatgacccatggttgtaggcagagaagctgagcacatgcagcagacgctggcaaggggtagatgtggtgagagtctgtggaagtccctttctcagagaagtaggatgaagatcatcacctgagatggaggatagggaggagcaattggaggtgtgacgggaggaaagaagggtgagacagttatctaaaagagagggaggctgaaccaactaaggacttgtaatatatttgcttcttcgtattaagggtccacttgaagtttctagtcatgaatttaaagtgggactgatcagcatgggttgtgggattttctccagccacatacacatccttttcagaatctaatgaaagctatagacttatcaattccctccaatcaagacaaccaggaatacctggaactgaacaagtttcagtttattgagtctttgcaacaagggagaacacacaccatggggaccataaggcttctcggtgagagtgcattagaaaagccttattataggatttgtacttgtgatagagtatttgggaggagcctcaaagaaatggaactttactctggattggatgctttcaggaagcaggggcaatcctatgacccagtatcttatttcttttctagctgggaggaaaagtagcagcacttactcactttagccaggaaaagggtgtgtgtggtcatttttgtggtttggacaatgttcttgtttttatatcctgctcaaacatgattatagagtagtcgtttttagtatggatccattttgtctgatgttg

SEQ ID NO: 10723 - DNA, 253860 bp, Homo sapiens
  misc_feature (1)...(253860): n = A,T,C or G, or insertion/deletion polymorphism (see Tables 1-2)
taaaatctatttctatcctgacattccacaaaggctgtgaggctcctagtgctacaaacaaatgctcagaagataaggtatttcaatgagagtaaattagtctaaaaacattttcttaaagcatgcggtgtttaaaataagccttgaaggataaatcaaatttggaaaaaatgctttagaaatgcaaagtgacccaataattatttttatggcatctggtggtaaggggtattaatgtttacagccacattcttagtattattgtttttcaaattaaggtcatctgtacgttggtttaaaaaaaaacgtaagctaccgaaacatagaaagaagaaaataaccctattacttgagtgagctaccattcacattttgatgtattcttttctgtgcattttttaaagttatggccatccatctacagaattttttatctaggctttttcagttaagatgtgaaattaactttttccatgttattaaaaaaaatctggccaggtgcggtgactcatgcctgtaatcccagcactttgggaggatgaggcaggcagatcacgaggtcaggagttcgagaccagcctgaccaaaatggtgaaaccccgtctctactaaaaatacaaaaaagagctgggcatggtggcacgtgcctgtaatcccagctactcaggaggctgaggtaggagaattgcttgaacctgggaggcggaggttgcagtgaaccaagatagggccactgcattccagcctgggtgacagagtaagacactgtctcaaaaaaaaaaaaaaaaaatctgtgcatatggttatctttaaaggctgcatagtattccactgtacagtcatactgatctatataccaatttccttattgtggtacatttacattgaagtttatagtttttcactattatatgcctgaggtgaacagggaaggtggtgtttttgtttccctctttccatttcaccctttttgtagtcaccagatcttgctctatcctcaatcagccatgtggtttggggaggattgacccagctccaggactgggagctgattggtttaagttagtcagtgtaacccaagcccctggccatggagtatggttcagagaatgggattacaaccatttttaaaagtcaatatgttcccatgacattatttactcaaaaacttcattttcagaggtagaattaccatatggggcaccagaatgtcttccaatgtatcagataaacacatagtacaaaattctggttggactcattaaagggcacagtgggagaaaaagagaaggagcctgaccttgtttgcagaataaaaaagaaaagaagggcattatttctctggacagatttcatgcccagagaaaaagctggtgaaataagcatctgtatatacaagcaaatttattgaagtttatgatacatacatgtcataattgtgtatttctttcatacactttaaatcctgtgaccaaaaaggctatacaatatgttaggaattatgctggattattaaatattagcagaactgaaatcctcaagagaaaccagattaccgaaggttgttctatgcttgtcttacatacaacctcagctcataaactcaaggactgatacagaaagagggtaatcactaaagaacttgaaatcaaggaaaagtatcaacttatgtcagaagaaggatgtctaatttaagctatccagaaccatatcaaaagctggaagatatggtcacactcttgcagagtttgaatggatgtagtgaatcatggaatcttcaagtctttgttgataaaaataaccctaaatgaataaaagtttttgaatctctgtccttttaccaagtgaccaacagtgcttgtgacggtaacatatacagatactccttgacttatggtggggttacataagtcaaaaatgcatttaaggccaagcacagtggctcacgcctgtaatcccagcactttgggaggccagggcgggtggatcacttgaagtcaggagtttgagaccagcctggccaaaatggtgaaaccctgtctctactaaaaatacaaaaattagccgggcatggtggtgggcgcctatagtcccagctactagggaggctgaggcaggagaatcgcttgaacccgggaggcagaggttgcagtgacccaagactgcaccactgtactccagcctgggcaacagagtgaggcactgacaaaaaaaaaaattaataccctgataagcccaaaagtaaggtcaaaaacttctaagtcgaaccatcataagacaggaaccgtctgtattggtatagtgtaggctgatggagtttgggacctcagagattaaactaaaggagattatctatgagccattgggagacatacttaagtttgccaataatatgaggttttatactggcatgcacggagactttaggtgcacatgcagtggtggttaaggctttactttaaacccaagtcacttggcacagtgtctatactattgttacctgcttcaatggttggcaggttgccagtgttttatttttagtgacatggtcttgctctatcacccaggcagaaatgctatggcacaattatagcttactgcagcctcaacctcctggattaaagcaatcctcccatctcagcctcccaagtagctaggactgcaggaattcgccaccatgcccactaatttttttttttttttgagagacgggggtcttactatgttgcccaagctggtcttgaactccccagcaatcctcccacgttggcctcccaaagtgctgggattacaggcatgagccaccatgcctggctgccagtattttatatactgcttcctgaaacacttgaatagcagtttcgaccctgttaacaggagaaggtggattggagtggtggattggagtgccttataagagatctactaaaaagaaaaacatcaataaagcaggcacaggaaatctataaatagaatagaacaagaccaaaggagggattaagacatggatctacatgccatatggatccactcatttcctacaatgatctgaaaatttggctttgagtttcctgccagcgaargcacagagtaacaagagcacttaagacaatgattcatgctatccagaagaaataggaatatgtgtttttcatgggggtgggggagggagggaaatttccacatatgaacatttggtaagtaattagttttggaggtctctaagctaccattataactaacaattattacctttctttatatggcactgaatactttgcagagaaatttcacataactttctttacacaaaaatcctgcgaggtaagattccaggatattattaaagcaataatgtaacccttattcatgcatctaagaacctagtctaactggaaaggcaacacaaaaagtagaaaataagcagaaagatctctgagatagcaaaccaaatggcaataagtgtatgcacagaaaagagcctctcactcagaacctatattctcttatttaacctgaaattctaacagggttcatttccttcctaaaaccgcagtggattaaaagtaacaaaacagaaactattacagagaagcactctgaaagcctcctagatgcgtacacaggagagcagaggcaagaactaaaaacaatcaaaagagcagttagtgcaaaaacagaaaaccctaaacactcactaagtaggataagctcagactctctccgccctggatcctgaccctccacgaatcagttcctcacaaaccacctcagccatctttcaggaacggaaatgtgatcctgcttgcctgctcccaactcttggcaacccttcattgactttccaggctcataagacaaaatcattatttaaaaacggtccacaaagtctgcctgcctctccagtctcatctcacttcggccccacctgcttgggccttttcacatttccttccctttacctggaagtgtctcaatgctgcctctcctgggggatctgaaatgtcatttccttagaaagccttacctagtcccagagtccacattaggttttcccgtgcaccttagcgcctttgcagttgagaatttatcacagttgcacttagtctgattgttttatttgtttgtttgttttttgagacaccaaggctggagtgcagtagcgcgatctcggctcactgcaacctccgcctcccggttcaagcattctcgtgcctcagcttcccgagtagctaggattacaggcgtgcaccaacacgcccggctaatttttgtgtttttagtagagacagggtttcgccatgttgaccaggctgatctcaaacttttggcctaaagtgatctgctggactcagcctcccaaagtgctgggattacaggcgtgagccaccgcgcctggccagtctgatagttgaatacctatttccttcagcgtactgtgagctctggtggaaaaggaccatgtctggctcgtacatatgccaaataagtattcaccggaaaaaatatgagtaatgtcacaggacaagcagacatcttcctagtatataattttaaattttactaaaatctttttgagaaggtagctattgttttattaaagcaaaaaaaaattacaaagtacaatgcaaaattcatatgaattttaaagctaaaacaagactttcagaatgctttaggctacacccccagacttctctagagacgtgcttaaaataatatggaaacacggtgtggtaaaagatccatttcccaagggatctggataaccagcgcttatcttcattttactggagaatacatgtgcggagagggctttgcaaactacaaggctttgtgcattataacattattatggaaaaatctgtgtttctaagagggggaatgatttagctattgcattgccaattacaggtggggctggcgccagagcccaggcctcccggggcctgtctagcccacagcttttcattaatgcacagcacttgccacctggtccctgccgcaaagggtggcctctcgagttaggagccatatctagggcggatggcctgtgctaggctcaaagacacttaagttccgatcaaccagaactgaggagcgggtaggaaaaccaagccgagccttcctcggcttcacaatccgcaggctctccgctgtccccggcgggactcggcagttcccctggagggctgcagcccggctgtcttcgctcaggcccaagcccgcgcggctctccccctggcggagaactcgcaggactgcgacgcattccggagacgccgtcaatctccgaatttgaagcgcaggcgatatctaaggggcctgggaagcgggaaagctcgggagtcactccggagagaacaccctgcaggagtcgacgcggctgcctggcttcgtggtcctgcagcgtggcccgttgcttcgcgcagaggttggccacagctgctggctaggaaactggggaccacctgggttgccaccgaggagggtggaggcccccgtcagtcccctcggggatgcagctgcattttcccctccttgcgtccggccgggagccagaggatggggctgtggaacccattccgaaaggcagggcgggcccttcggaacccggacgcgagggaaggcgagaggcgcgggtgtgccgcacgcccaccggcgccggggcaggggcgctgcagccggcggcccacggaggacatcagcggtgccgccgccgccgccgcgggctcgcgggccgcgcgcgcacgcgagtgggcgagggaggcaggggcgctactagcaggcggcgtgcgcgcgcgcgctcccccgcgccctccctcgcaggcccgcccggccccagcgcgcgtcacgaggggccagcgagctagctggagggcgggagggagggtggggaaagggggtggggccgcgagaccggaggggtccgagcagcggctgcggagccggagctgggcgagggcggctgcggtcccggcggcggcggcggcggcggcagctgcggcgggagaagatggtggcgctggaggcagcagcggctggagcggagctttattcccaggcttggcaccagcgctgtcactagcgccgcctgctcccgcgggcccgcggacccagctgtcaggcaaggtaccacagccagggaggggtgggtgagaaggggtgcccggcgctgatgcggcccccgacggagcccgggtcctcgccaaagggcgcccccggacgcgagaggggctgcctggaacaatagtgcggaggagcggaggcagcaggcgacatccaggaggcagtgcctggaaccatcagctagcgaggcgggggaaggcggcgttgcgagcgagacgcctggggtccggtgcccgctgagatgccgggcttcgggcgcagcaggcgggcctgatgacagtcatggcaggagtgagtgtgtgagagtgtgtgtgtaaaaggtacagcagaggggatggggtggcggacggaggtgttggggggtgacatttccaggaatccccgctaggaccccctcatctctcggctgactctcctggagaaagaatgtgatgatggaaacggtgaggtgggcaggatgcacttggtgtgtgaagtgtggagggaggcagtgggataggggccggtttgtaaaatcctgtatatgtgtgtgtacgcgtgtggttgcatccacgttccccaaactgcgccccaaatccagagatctgccgctgcccttacttgatgtcaccggctaagactgtgggacagtgtttgttattttgaccctgcaactctgagcacagtgtctgttctgctcctgcgtgtggatggcccagtgtagggattctcgcttccccttcctctggcctcatgacatggggatgtggaagtgagcatgttgctttgaggcacatggcagggaaataggataaccgttacacattctgggcttgctantgtacctggttttgaaggggccttccatcctgtgatactacttctctccttagcacctgttccataagggtcttgtactccctgactgtgcagtttctattgtttttctcttgtctgaccagaaggagaaggatgttgaatgatcagattcctcttcctgtccccacaactttcaatgctagctagaccttctccttccacatttaagcactgaaaaccttatggctagaggatggatggtctttgtgttggttcttttagaatgaactctggaggtgtatacgtatagagagatgcggtggggcggggggcggtcttttaaaaagaagaaaaatatcacacggagaaatrtttggtgcccacttggtcagcatcacacagccagggcgttttcctcaggaaacaggatactttatttctactgctggtgacatccactctcccagctgtcacaatagctaggtggtgccgtgtatcatttggaaactgaaatctcctgagacccacagcgatggggtcccaggtcagtaaagtccctgctttcctacctgatagagcccactagtagggaatttggaaaaatgtcaggctggcaacaactcacccagtgggaacaaggacacagaaatgcatccagagtctatggctgtttaattgtctctgcgtggtaaagataggtgtgtgtaggtagggttgggtagaggtaggcagggagatggcatattcatgtgtatccagggcagtgtgattccccctcacctatgtttctcctgcggtattcataggaatgagtgcactttacacttaatatctcgacacttctttattaaaatgttgtatgactagcttaatctgcttaggacatgttttagtcataacaccttaaattctactgcattgtcggaatccaaactggctgcccggttctcttcgaaaagcccgtagcagtcatggctacacaagtaaatatacaacatgttggcaccagagatttatttttcttttttaaaatttttgttttgctttcttttatgggcaaagattgcatgatatcgttgtgaaaataataaaactagggctatccacatatgcttttttttcttcccatgtatcttatttaatgatatatagacaaggtgctcttgaagctgtctatgtaaagtaaatttccccatgttcttcaagtcaagccttctaagattttaatgtgaggttggttgttggctgtcatccaagatttaaggatagatttataaaaatgaattttgaatcttagttctttactctcttatttgttatgccaaatgtctttctgagaaaagtacttagggaatttaaaagccattctaagagattttggtttaaaaaaaagtcatcatcctttatatttgcaagtaagaccagggatgtaaatgtctcacaagaaagtttaataatatgaggaattaccaggtaaataccctgtttagagaaagaggaattacacagcagcaaaatcgatgactcaggaatcagttcttttctaatgtaaatgtgatcatttttatttttatttgtctttttgagacaggatcttcctctgtcgcccaggctggagtgcagtagtgtgatcatagctcactgcagcctcaaactcctagctcaagcaatcctcctgcctcagcctcctgagtagctgggacaataggcacatggcaccacacccagatatttgtttatttttttcagagatagagtctcgctatgctgcccaggctgatagttttaaaaatgcaatatctggcttttctaaagatcggactggtataaggttaatgagacagctctaataaatggtggtaccttttgctgtggcctgcagcaagccattttttgtgcatggatgcctttccttcacttaaagtagcatcagtgcttttctcttccattattgagcctcttaaggttttttgttgttgttgttttgttttgttttgttgttattgtgtttgtttgtttcggaagacttaggggtaagagatatttgaaaattgacctctggggccaaaaggaattaactgtagtaccttggggagataggacttttatcctagaaagaagaagtaattgttgctaaaattgagagaatttcaagccgtaaaatctgaagttaactctctgggttacaataattaatttgcaaacatttgttaattgcctcccgcatctcagatccactgtacctttggataggggacagggaatgttgagaagrgttggaggttcaaagaatgctaagtcttagatcctggccagaggtggatcatgatctagaaggagaaaagaggaaatatgttactaactgtaaaaatagtgaaaaatgattaagtgctgaaaaagcagtattcctgcagagctgtgggagttcacagggtacaaagtgacttctgatggaagaattagggaaggttacatgggatatagcatttgagctgtgattaaggtggcatttgggttggcagagaaggaagggcatgcttgggggaggaacagtgtagcacaggcctggcagtggaaggtgtatgcctacacaggaaacaaaaaaatggtgtgctttggctgaagcrctaggaatgccaagagatgtaatgagggataaagcaagaaagagaggtttgttcaaggtggtggagcaacttgtacgccaagctaaggagtgtggattttgttcagtaaggactggggaactatagaagatttgtgaggagaaagattgacagtatcagaactgtgctttggggcaatacttttgtagtattatgttggatggaatgacatgggaaaaggctggcaggagggagaccagatagactctattgtcaaagtaggggaaagatgnaaagaggcagtgggaggcaagaagggaacacacctaagaggtggtgtgcgggaattatctgaggagcttgaacagtcactggaaagtgaggaagggaaaagggaggccaaaagatcattgtcaggcttagctgagagagcagttgggtcattttcagaaagaagatataacagaggataaggaagaggagagaagtttctttttgagcatgacaggcttgtccaagttaagggactagaatacagagggaggttagagctaccaggagatttgtaggtcatctgcttaggagcgattttcatatcccaggaatcactgataaagaaaatgaagaaagaagaagcaaaagtaaggataggatccttgagggatgtctgtatgttggaggggaaagagaaagaagaggacaggaaccacgttaaacaaggggcaattggagaaaaatgatggaagtgaagtggtacagtgtcatggaagctggaaggggtgaggagagcccctgtcactcacacagcacaccccatgggtgacggtgcaaccaaggcaaagccattggatttgactcttggatttccttgattgtctttgtggtaggtggaagtggcagccaggggcaagggttgaagggaggcgtgggggaagggaaatggaaagcagtgaaaacagacttcattttcaataagttgggagataaaagagaaggagagagagtatgatatatcacaacaatggtgtagtagagggaaagtggtatttttagtataggaagacttgagcctgctttataagctgaggagaacaatccattgagggaaaaagagattgaaaatgtaagggagaggctcaattgagggaattaagtcttcaagaagatgggaggatactagatgaaagcaaaggaaggattcttttgagacagaagcataggaattttgaggtggaaagaaaggaatttggccacagtcttttaagtgaggtcaaagagaggtgggcaggttgaagccaggagtagaatgacaaagacttgtgggcattgtggaaacagagcagtgagtcaattaggagtgaataaaagatcattacccaaccatgaggacctcatgtgtttgaaaagcaggaatttgtagtgaaaccaattaacgctatataattggagtttgacaactacttaagtaatttttgtatagtgagcatttaatctcgctaaatacagtggttcttcattcccttaaatgcagtaaaaagaggagaatgtttacctttaaaattatccaaataaaagactccacttgtatttcctgtaaatattctctctcagagatctgagctaaattttaagaagtttatagtaaaacaatggggaaaaatgtaagtgtttttttaaaggatgagctttttctatctgtaatggtagaatatggttttacagtgacgtacatgtaaagtcagttttcaaaagaaaaatcaaatatagcacctcgcccaataccatacccatcatatgcattcaatatacatttgtcacatgaatacatgaataaactttttttaagtaagctagcaacagtatctaaaattttaaatttcaggatttcattcttacacaatggacatcgaatgagttgccttttatggcctgtgcaagtttatgatagcattaaaactatttattcatacctgatatatacattgaagctttatttttaaaaaccccacatttttcacaaaatgattgtgaaccctttagatccttgagttatgggattatgtcatgattccaggtgagtttatggaacttcaactgtaatgagtggtgattttgaggttttaatgatgaaatttattcattccttcaacatacactcattgaacactttctctgggccagaaactattctaggtgcaaggaatatggggtggggggaggcatgtccttaatatcacagaacttttagtggaaggagattaaaaataaataaataagtaattacataatatgccaggtggtaagtgctatgacgaagaataaaagagagagagcaatggactgatgatagtgggtgggtggggggtgacattagtttatatagtatggtcagggaagaccttaagcagaaagagctgaaagatgtgaagtagtgagccctgcagatatttgggggaagggtcttctaggcagagaggatatcaaaaatgaaaaggctggataagaacatgtttggcatcctcaagggacagcagggaaaccttattggtttccttggtttacctggagcagtcacttagggaattcacaataaaatgctttgcctttcattttcaattgtttgcccataaggctgtattaccatctactgtatttgggctgacctatgaatcagtactgggtttatataaagatgaatatcctcaatcaaatgtatttaagttagaaaacaatcatgcctgtaatcccagcactttgggaggctgaggcaggcagatcacttgaggtcaggagttcgagagcagcctggccaacatggcgaaatgctgtctctactaaaaatacaagaattagccgggcatggtggcgcatgcttgtagtcccagctatttgggaggctgaggcaggagaattgcttgaacctgggaggcagaggttgcagtgagccgagatcacatcagaaaacaaagcgtgattctgtctgggtagtgatgaaatactagtcagctggaagtagttctgctccttggaacttacatctcttctgtgtcctgaatcttctttaaatattgctctcttttcttcttccttgtttcatgttccattctcaagtataagatccttgaggctagaactttgttttgttcatctgggtatactctataacacagactgactctctgcattagtaagggtttatcaaatacttacggagaggaattgatgagaaatttccaaagatttaagtaactcaggtgtaaagaatgagggtaaagctcgtttaccttgatttctgcagataggtagctgtttttcaaacaggacacagaattgccataggatgctaaagcagtttatgcatgcagaccctgagatgaggacttgagttcagaatagtttatctgagagacaacctcaagaagcacaagtgagagaatggagaaaatgacacaggagagggaagaaagcccattaagaggtgagttaatgagcaggttaccacggtgggcagctgaggcttggctctgctggcattatatagactgcacattaggattgtccaccaagcagtggagaaagtggggtctttatccaccatttccctagggatattaaatcttcagtactttagggctgctaagattagcctgagcaagctccagagacaccaaagaaagctcttgagcagagaagcagagaggcagagccaggtggaagtgggaaactgtcagtgtatttggagactgtcgatacagctatagctgaactcagaagtggacatgggacccctgtttaacacagcacagaggtatcataaagaatttttaacagataataattggtttgatggcagttattttaatttagggattttaatgtattgtgacaactgcctgcagttctgttcactcacaagccaactattggccaccctcagttatctgaggtgcagagtactatatatgctcatgtgtaagatacgctctgttatagggtggccctcagttttccaacaagagcatttataaaaagactttatgtcaatttgaatatgcatattctaggaatataggcaaagagtgaagtatctacttatgtttaatttattagtttactttcatataattgaagtcacattatataaaattattaatttagaaatatgacatccttccattctcacattttatgaaatcatttattcaaatacttcacatacttttttgactttagagtctttgtcatgattaggccacttttgtcatgttcatttctatctaacttttttgagatatagtacttcttgagtttctgtatgatgctaccaccacaaactttattccaaaccctgtgtgctcattcacttaatgtaagaacgtttgttttatcctttcttcctaaaggagtatatttatgatctctgcaacccagcacttctgtatgtcttgtgtaaagacatccaagacaagcaattgtaaagctcctncccaggaatatttacttcaattggtgttaaaatcatggcctcctttactctgtattcattcagtcatttatcttctttcaattgcatagccttcagaagtatccctatcttgtgttgattgagtttatttccggctatcttctccaaatagttcttaagtaacctctgaaacacacaactccttttcatgaaatctgcagtcttaccaggtaatatgttttttcatggtttctctctttaaaatcagttgccgtcacatccagcattagtgaattacatggctttcaatttctgttatcttggaggtaacagggtttttggcattcagaagaaggtaattaagagaataccccacaatatgggagactttgtaagcatttatacataaggcaactttctcttttctgaaatacacattttggaggacagaatctcatctttttgtatatgtaaagtgatcacaggaggttgtcaaggtrtggtggcaaaaccaatccctacacamtaagtttccttttcagcctcctcttctgttccatgtggattaattagcatacaatytgtatgaaaaatacagcaaatacagcaatgatttatttcctaatggaattaattggccaccattccaaataatgtaatcgttatgtttctgactattgataaattttgtatctcgagatcaattctgcatttattaacaggcacactttattttaaagaaggataattgccaaagtatgtataaattcctttttcttgtaaattgtagcatattttaaaagcagaggacgagcttagagtcatttaaggaaattccacttaacaagaataattaccccctacattggctattcagtgaatttggacttttatactggactttactaaagtgggttgcattctgttgcagtggcttttacacacttttggccatgattcctggtgagaacacaatttagatgataggctagcaacatagatgaatgtgtgtaaacacatatacacacacacatacatcactgaaacaagtttcactcaacaatacttgtcctttattatgtgtaatccaccctgatgcttcctatcctattctcttctgttctgtatgtttgccaacccactgaagtaatctctgcattggtgaaccctaatatgcagtttagaaaacactgctgtattgtattacatttatcagaagagtgtttattttcttatagtatgaaataatttcatgtcaaaagttgttttttygttttttgaattgttagcatatttggatatttggtggtatggacaaatgatgcagtaatcacagagagaaactttatttttgagtagacattttgtttccaaaagaagaaattacattagtgtggaaaagggaaagtggagtaagaagaatagatttgttcttagatctgtggctttcttgggttgtggggaccgtgtcaagtcactgggccacaacctccttgctgagctggttcctcacgattctttcctgtccttcactcttcctgcccctcttcctagctgctgtctcttagcctctagagttctggatgtttagttaaattacttaattctaaattttaacctaatattatttcttcccagatgtgaaaatagtttctacgcccacttcccttccaaataacttgaaaatataagaatcatttttccctgagctagtacctggaagagttctctcctaaaggagctagaatttgttctacagatgaaatgtttccatagtattaggtcatatgaaagcttaacctaatcttatgttcaggtatgattgtgttctttatggcaggctagctatcaaagtacacataaattccttttttaaaagctcagcagattccccatccagtgactaaaaacaagttacaaagtgtcaggcattgcgctaagtactgtacacagctaactcatttacttctcataatgacctaatttactcttcataaccacatcaggagagaacttatattgcagattggactttgaggttctcagaggttcctcagtggctacaaaacaggacaaaggggatttgcctcaggtctaggcacaggaatgggcccagacagttgctggtcctggagtctattctgtcctctgggcccagcagtagcttcccatccccactgccccatcttgactctcttgtttatgatgccttcatcctacttgggatgtctgtgtgtgtgtgtgtgtgtgtgtgtgtgtgtgtgttactgtttgtcttagtccattcagtgttgctataacagagtacctgaggctgggtaacttacaaagaaaagaagtttatttggctcacaattctggtggctggagagtttaagaccaggcagctgcatctggtaagggtctcatgctgcttccactcatagtggaaagtggaaagacagcgagtgtgtgcgaagagataacatggtgaaagaggaaasgagagaaaaaccaaggaagccagattctttttaacaatccactgtctaggaaactattccatccttgcaagagtgagaactcattcatcactgcaggaggacattcatctgttcataagagattcaccccccatgacccatgcacctcccaatactgccacattggggattaaatgtcaacatgaattttggtggggatgaaccacattcagaccatagtactgttgcaccgacatctctccattcttggccctgtggggtggcaaggactcagaatgagctggaatacagtgctgccataattagccatcaacagtgaacaagtctccaggttggtctgagcctcagcttctccagctacaaaaggggaaatgatgaaacctgcccttcccatctcttcctgcacagggccgctggggtcaaataaaatatgaaagggtacagaaaagtaaggtagatgtctcacttccttcatcatgacattgaacgaaagtgactccctacctagttctaatagctagtgtctctttcctctaaaccagaagttgacaaactttctctgtttagggctagtagtaaataggttttgtgggccatatggtctctgccacaactcctccactctgcccttgtagtgcaaaagcaactgtacacaatatgtaaacctattagtgtgactgtatttcaaccaaagtttgtttatggatgctaaaattcaaatttcatatcatttttgcttcacaaaatgttgatttctcatttaactttttgcaaccatctaaaaacataaaaaacattctcagctccaaggcagtacacaaacaggcagtgggatggatttgtcccacggacctcagtttactgacccctgatctaaactctcacagtgctttgtaccactctggattccagcagctcatgctcatcttttccatctctcttgtcctttcaaaatatgcacccacccacacactcattttttcatctcccttaacactgagaaagataatagcatatgtatagtatgccccccacatgtatattctatatgcccaagaaatatttattgagtaaatcaggattaaaaatctgttgcttttgtatgtttcctgttttttcatctttaaaggaaattccacctattctctagtaaagctttgggaatgattgagttaagattttgtgattaaatataaggctttgagattcttgccttaaagtatttcccccctctgttattaaccataaaaggaaaagaatgtcagggaggacagagaggaaaagcaaacagacaaacaaaaccaacatttcagcatgaaaagcgcttgttagatgataactaaagtggccagatgtttagctttgctcccttgggtatcctgccactatagggaactctgaaccggctgaagtgtttcatgcctcagctgccagcagcccttggtgatatgctttccccaaaatttaacatgggggccagaactccatgcatttgactataaataaagaggacctcatagaatgtactttatctttgtatttccctaccatgtattgaggaatcatgcacatctctctaagagcaaagccttgaacatacctcctgtttttcttcttaataagtatagacttggaagtggaattattataacatatgtaaattgacatttcttctcaaaatggacagaaactgtatgctggaattatggcagggctgtttgtggtattccacatagtctatgatcaatatgttactctataataaggattgtgtgtaagtgtgtgcacgtgggtatgtagttaaggggtgggaagaaataaatatattaaaagcttgggaccaaaatcactaacagtatctactccttattaaaatttgttaaggaaaggaacaattaagtcagctttctgttgagtgcttaagtattttagcctgccaaaatatattaattttccataacctggaagagagatccatgacacatgtaaaataaattataaagtatactttgacttgacataaattgttactgctatggtagatgatgtctagtcctaaagacagaattttaagccagtgttaaaagtgcatatcattatacatttaagtcatgtgaggtatttgaaacctgcttggggaagagtggaggatgagaggctcaggattttgtttgctattatgtctaagctgctccctgtgaaacacaacatggtacttactggcagtgcaaagactgttttcaaaattacctttagtggatggatgcagaggcgatggggtgatgtggagagggcaggcttagagaggactgcatggtgatgtgatgggtaggcaattatcaacccgtctgcagcttctcatgtggaatgtggctccccttgatgaagtagagagaatgtgcatatgaaagtggatgattcaggtgtcatttattatgatatctgtacagtgaatcttttactctttctgagtttaatttttccctctcctatcacatctcctgcttctcccacttggggaattacagtgtttacatctttttgtttatgttgatcactcccttccctgctggaggtttttagcacagtctgcttatcgttgattgtcttttcatatgtaggactgtgacactgaagctggccagaaggtctgtataagttggtgtgctttgcagatgtcttaggtcagaatcctcagaagcagacaccaagaagagggtttgtgtgtatatgtgctgctctattaaggagatgctcctaggaaaaactgggaagggaaggggaagaagtcaagtaagggtatgctctcattcaaacaaaatactgcaaagaggggcttcagcctgatcctgtgtggggtgggggagctctggagtgtaagtcagcctcagagttgtccctgcctgaatctatggggttggtgtttcatactccatacctgtcagtcttcagttaagagagggggtctgttgggtggggacataaattctcaggtatttctggctcttgacatgaaagggtgaagcaagtgcagccctcccaaaaagagccataggtgctggctgttgggtgggaaagcacattgaaagtagggacttgaggacaggtgcagtggctcatgcctgtaatcctagcattttaggaggccaaggcaggtggatcacctgaggtcaggagtttgagaccaacttggccaacatggtgaaaccctgtcttaactgaaaaaaaaaaaaaaattagctgggcatggtggtgcacgcctgtaatcccagctactcaggaggctgaggtaggagaattgcttgaacccaggaggtggaggttgcagtgagccaagatcgtggcagcctgggtgacaaagcaagtctctgtctcaaaaaggaaagaaagaaagaaagagagagggaaagagagaaagaaagagagaaagagagacagagaaacacagaaagaaagaaagaaagaaagaaagaaagaaagaaagagagagagagagaaagagagagaaagaaagaaagaaagaaagaaaaagaaagaaagaaagaaagaaagaaagaaagaaagaaagaaagaaagaaagaaagaaagagagaaaggacttgagtaggacaacattgtccatcagcaggcctctctacagggtaaccaagggagctattaggttgttccactgggaatctccacattccagtctttttcctgagaagtagctgctggctcctagtgatacatgtgtgtggtgtggagcagagggctggggatcctgctgttctggatcagtgaacctcctgtttccagagccttctccaccccatcctttggtaggcctgcatccctggggttctacagttcagtcatctcaaagaaaaatgtgttgtaatcttttgtttgtgaatattctctcttccattctctgtggatttatacctgatgtatacctttatactctttaagaggaaaagaagaggaaaagattaaaaatatataattgatggtattaaggtggtaaatttgtcacgttaaaccaggagtcacccaaaataaaagctagagtagaatctaaagtaaagctaaagtagtaaaatgtttaaatatatatgtatacacacatatgcatatatatgtaagtatattcctataacttcataaaaaataggcttaatagttggtaattagccaatctaagtattatctagcaaagtgctatgttagtcagaatgaatagttacagtctgttgtaatcattagttggataatgtcagccagtggctaatgttgatctcattgggctaagcagggggacttctgtctttcacaatgtttttggatattaacactagacacaggtcaataaactgctgatgtcagtgtgaaccatggttcccatgtcatcacatcagagttaatctttggaactgaatagtaaacagaaacctaagtaataactggcaggctcagaaaacactatttgttgttcaaggaatctcaagcaaaatccactgccttctatatataacacatttattgaatgggctggactcaatgggatgcaaatagccatcatctcttgttcttctcttacagcttctttctacccacttaacagacttgtcttctcttccccatgggaataaaattttaggcaggtctcttagatctcccggttaggccgggcgcggtggctcacgcctgtaatcccagcaccttgggaggccgaggcgggtggatcatgaggtcaggagatcgagaccatcctggctaacacggtgaaaccccgtctctactaaaaatacaaaaaattagccgggcgcggtggcgggcgcctgtagtcccagctactcgggaggctgaggcaggagaatggcrtgaacccgggaagcggagcttgcagtgagccaagactgcgccactgcagtccgcagtccggcctgggcgacagagcgagactccgtctcaaaaaaaaaaaaaaaaaagatctcccggttattcttaagtggtgaaaagtttgactactagtcacataatacatccaatgtgataataaataactcaaattctcatctaatatttgatgtttttaaattgcgatgtaacttgaatagtgaagaaacagaaatatcaagcgtagagcttgctaaattttcacatatctgaaaaactatataactagcacttgaatcaagacatagaacattttctggcccctgggaggctccctcatatgccttctcagtcagtcaatatcaaccactttcagaaaggtaaccactactctgacctctgtcaccatagagcagttttgcctgttcttaacttcatctgcgtggaatcatatagtatgtagccttttgcatctgacttcttgtttaatattgtagagattaattcatgattcattccttttttgctgtttaatccattgtgtgaatatactgagtttatcaattcttttgttgaaggacattagggttgttttactgtgaatattattatatgtttattttggtttacatatacactgatttctgtagggtatatactcaggaatggaattgtggggtcatagaacaggtatacatttagctttagagatattgccggttttccaaagtggggactactttgtccaatttatactcccaacagcagtttatgagaatcgtagttggttccacgttggtgatagcacctggtttcctaccatttgtttagcttgaggtattctgctaagtgtgtagtagtgttaaagttgtgttatttttattaatgttgttaaaattgacacataaaaattgtacatgtatgggatacagtgtgaggctttaatacatgtgcacattgtataatcatcaaatcagagtagttagcatgtcagtcactgaaacttttatgatttctttgtggcgataactttcaagatcctcttttctacttatcttaaaatatataataccttgctattagctgtaatcaccctgctaatgtaacagaacttattcctcctatctaactgtaattttgttctagcttagttctttttctcaagatcgctttggttacttggagtcttttgtggttccatatgaattttaggattgtttttctatttctgtgaagaatgccatgggtgtttctatagggattgtgttggatctgtagatacagtcattttaatgatattaattcttccaatttatgaacatgagatatcttttcattcatttgtgtcttctatttctttcatcagtgttttatagttttcattgtagagatcttttacatccttgctaaaatttagacctaggtaatttattattttgtagctattgtaaatggatttgctttcttgattttttttcgaatagtttgttattggtatatagaaatgctactaattttccatgttgattttgtatactacaactttcctgaatttacttactcattctaatagtttttggggagatctttgagaatatacatatatatatacacacatacatatgtgtatatatgtgtatatatattcatatctgccagtaggggcaatatgacttcttccttcccaatgtggatgccctttatttctttgactaattgctctagctaggacttccagcatgatgttgaataagagtggtgaaaatggactttcttatatttttccagatcttagaggagaagctttaaacattttcccattcagcatgatgttagctgtgggtttgtcatacgtggcctttgtcatgttgtgttgaaatatattccttctgtacctaatttgttgagcatttttatcatcaaggatgttacattttatcaaacacttcttctgtatctattaaaatgatcatacggtttttacccttgattctgttaatgtgacgtatcatgttaattgatttgcctatattgaaccatcctttcacccctgggatgaatcccacttgatcatgatgaatgaactttttaatgtgtttttggatttggtttactagtgttcggttgaagattattgcatctatattcattaggaatattggcctgtagttttctttttggtcgttgtatccttgtgtggttttagtattaaggtaatactggccttgtagaatgattttggaagtattcccttctcttcaatgttttggaatagtttttgaagaatcggtattagttcttctttaaatgttatgtagaatttagtggtggagccatcagttcctgggcttttccttgatgggggacattttattactgcttcaatctcattacttattattggtctattcaggttttctattcttttcttttctttctttgctttcttttgagacagggtcttgctctgtcaccaaggctggagtgctcctaactggagtattcctggagtgatcctagctccctgaaactttgaactcctggtctcaagcgatcctcccacctcagcctcccaaagtgccgggattacaggaatgagccaccgcacctgatcttctctctctttttcttagtaagtctagctaaggatttgtttatttctgctcagatatttgttatttcttttcttgtactaattttgggtttagttcctatttttctagttccttgaggtggcttgcttatttgagatctttctacttttttgatatagacatttattactataaacttccctctttttttttttttttttttttgagatggagtttcgctctcgttgccgaggctggagtgcaatggtgtgatctcggctcaccgcaactgcctcccagattccagcatttctcctgcctcagcttcccatgtagccaggattacaggcatgcaggcatgcrcccggctacacgggagatgcctggcttttactagagacagggtttctccatgttcgtcaggctggtctcaaactcctcacctcaagtgatccacctgcctcggcctcccaaagtgctgggattacaggtgtgagccaccacacctggtctaaacttccctcttagaactgcttttgctgtatcccgtaggttttggtatgttctatttccattttcatttgtctcaaggaatttttaagtttctatttacgtttcttcattgactcatttattattcagtagcatgttgtttaatttccatgattttgcatactttccaaggttccttctgttattgatttctagttttgttccattgtgatcagaaaagattattgatatgactgattttttaaatttaagatttgttttgtgacttaacatgtggtctatcctggaaaatacttcatgtggtgttgaggaaaatgtgtattctgtagctgttggatggaacgttctgtaaatgtttgttaggtccatttggcctagagtgcagcttaactctgatgtttctctgttgatttactgtctggatgatctgttcactgctgaaagtgggggtgttgaactcttctgctattattgtattgtagtcaacctctccctttaggtctatgaatatttgctttatatatttgggtgccctggtgttgagtgcatatatatttagaattgttatatcctcttgctgtactggccactttatcattatataatggccttttttttgtctttaagccattcttaactttaaaataatctactttctctaacataggtataactactcctgctcttttttagtttccatttgcatggaatatatttttccattccttcactttcagtctatgcatgtctttataggtgaagtgagtttcttgtagccaacacagagtcttgtttttttgttttttttttgcttgtttttgttttcctgagttggagtctcactctgtcacccaggctggagtgtagcggtgcaatctcagctcactgcaaccttcatctcccgggttctagcaattctcctccctcagcctcccaagtagctaggactacaggcgcgcataccaccacacccagctaattttttgtatttttagtagagacagggtttcatttcactgtgttagccagaatggtctccatctcctgaccttatgatccacccgccttggcctcccaaaatgctgggatcacaggcatgagccactgcgcccagccagggtcttgtttttgaaatccattcagccactctatgtcttttaattggaaaatttaattaatttatattcaaggttattattgacagataaggatttactactgccctttggttacttattttctggttgttttgcagatcctttcttcttttatttcttttttactgtctttgtggctaagtgacagttgtctcattttaaacttcacttcctccagcttagacaggctgcttctgtgcagccacattgtgaccagaggaaacacacacacacttatttggttggcagtagacatgccttttgctcccaacatatccccctccctgtacccctattttgccctgctcactctgactagcccttagatttctcccagcgagagtcagatatcaacacctgggttccataaaaaccagagggcctgtgtctagttcctgaagtttctcttggagctttctttacctggtatattagtctgttgaggctgccataacaaataccatagactgggtggcttaaacaacagacgtttattttctcccagttctggtggctagaagtccaagatcaaggtgttagcaggtctggtttctcctgaagcctttctctttggctggcaggtggctgccctcttgctgtgtcctcacgtggccttttctctgtgtgtacatccctggtgtctcttcttctaaaaagaacaccagtcatgttggattagggccccatccatatgagttcatgtaaccttaattacttctttgtaggccctgtcttcaaatgcagtcacattgggggtttgggcttcaacatgtgacttttgtgggagacttaatatttggtttggtgtgtatgtgggtggagcactctgccaactcttcaacaacacacaaagtaatcaattggcagtcaattttgttaaagtacagtcagagaccaggcgtggtggctcacgccggtaatctcagcgctctgggaggcccaggcaggtggatcacctgaggtcaggagtttgagaccagcctggccaacatggcgaaaccccgtctctactaaaaatacaaaaattagctgggcatggtggtgggtgcctggaatcccagctacttgggaggctaaggcaggagaatcgcttgaacccaggaggcggaggttgcagtgagcctagatcacaccattacactctagcctgggcaacaagagtgaaactcagtctcaagaaaaaaaaaaatacagtcagtcattatttaaattactggtcgggaagattgttttataatagaagtaaaacacatacagtaaagtgtataaactacacaaatctttaagtgtacagcttgatgaattttacatctgtataaacctgtgtaaccaccacccagatcaagatctagaacattgccagcactcactgagatcctctcacgctccctcccattctgtgcctgtgctccccagaggtaaccacgattgctgcttctgtcattattgatcatttttgatgattcttaaacttcatataaagagaaccatatatacattttttttggtccagattcttcgactttacaaaatatctgtaagatacatacatgttattacacgtatcagtagtttgttcattctcattgctatatggtattcagttgtataaacatacaacaatttgtttatccattctcctattgatagaaatctaggttattttcagtttttggctattataaacaaaactactatgaacaatgttatatatgtctttctgtctttgtatttcttcagtatatatttaggagtgaaactatttcgtcatagggatgggcatgtgtttagttggagacattttagtcaactgtttttataataagtacctttctgtttggtgtaatctgagcatatattcttcacaattcaaggatagatgtatgtatacatgctctgttttaatgcagtgatttatttttgttaatttccttctgattttgttgtccagctcagttaactgaatgtgattttgttactttatctatcaaagggaaatgaggcatatgcttctgaattcactggatactgaacaggtatactgaattcaggttattcgtgcatatttgaggaaggtttttgtcacactctgttaagaagccaacaaccattcactaacagatattttgtttgttttatctgagttcaacaaggttaagcattcagactattttcattaaaaatagtttcgtgtataacaaaacaagacagtacacattttaattttaacatcttcattttaaacattgagttccattctaaccaaaacataacacttttagccagaatgctgttaaacatctttaaaacaccaagtaacaataacatggcaaatgtttgtgtattgcttactataagcagcataagacattgctcaaagcacttaacctacattaactcatttaatcctcacaacaacactataaggcatgctgttgttatcctcattttgcagatgaggacactgaagcagagaggttaagtgacttgcccaagatagcacagccagtaggtgacagagccagaatttgaatgcagctagccagagtccagagtgtgtgcacatataaccagtataccacactgcctgtaactctgtctctcatcttcctgtttattcatgggggaggaggcagtgggagagagcattcctgctttctcatttcttagacattttctcagtttggattaaagctgtagcagttaaaatctttattattactttaatatattccattaatcagatgtttaaaggatgccaaccggctgtcactatctttaaaaaccacattaacagaatactttccccaccctacccccacttttaagcccagacatcatactggggagatttgttaaggggagagatgagttattcctccagaccctctgaggccctgaaaaactgactcttgtttggcaagaggatgatgctgtccgagttgggccttactcactgtgatgtgagtgctgtgcattctacatgtgtttgcactgtatcaactgtgtgtcagccccatgcaaggccccgggggtggatgggagcagagcacatggagcccttctcttcagggggctttagagttaagcacaggagacaggcacttgcacaaaaccacacatgtgtcatcacccaccgataagtgccatggagaagtgagggtactagcatgtggcaggaagacctggtcctgtggggccagtgggaaagtgactctagggggtaagtgactctgggcagaagggagagggtgtgtctgaagcagacagtgtgggttagctggctggagactgagccagggtctggtcaggcaggagctccaggctgccttagggatttgttctttattctgagaataatgggatgccatttttgcatttcaagtaaaggaaagacatgatcagatttgtgcttttctaggatctttgattggaaaaggggcaaaagagaagacactcttacgtgcattttacaagatggaaagtgatagccactaagaagctattatagagcttcaagagggaggtgatggtttggaatgttgctggcagaaggctggagagaaatggacagactggaaagatattcagcaggtaaagtcatcaggacttggggataggttggatatgggaggtgaggaaatagcaagaatcaaggatgactcccaggttctgttttgtgcttctggagggatggagttccagttactgaaataaggagtggaagatgaacaatgactcgtttgggagcgtgaaagggaaacagataagacattgactttaaggtgtctgtgagacctgcagggaggaatggaggtgggcccttagatataggatctcaaattcaaaggggagttctggatgagagattatgctaaccaagcatagatttggaaatgagattcactaatccatatggatgcttaaaaaaggtggcatggatgagggatagagcagggaaccaggagttagagtgcttggatttgcccttgttcaaaggttcagaccatccctgaactgcatctgggactcaccttcgagggctaaactatagagctctataatagctgggtggtctgtgctcttaaattggaaacctttaaaaataatgatttttgcccactggtgaaatgaacaactaggttgaaaagagaattggctctatggcttaccaaagtataagtattttatcaatttttgtctttaatatataactgagtagtgtgtgtaaaatgttcataaatgtaaacttggctaatagtaaggtttatgggatcaactcctgattcaatgggaaagttacttctgtgcccagtgctttccgtgtatcagggtggcttattcaagtgcaccttgtcactttattgcgaagttaaacccattatgtattctgacctggtctctaggagagagttttattcctaacccctttctcatccctgtttagtttttccccaaggacactgctcttggtgagaaatgttgtagccaagagtctagtagctggtgactgtgacaacctagcatagaggactcttaaccacgctcttcacttcctgacaggtaaccagcccttcatctgtccaatgctataagcaaagatatcgaggtaccttccagttctgatccagagagtgcagtggtgggggcggctgcagcatggcccaacctaggcagcaacagccaaagcttgccagtcatgcagtcctgcctttaaggcctgtctttatcaaccccatgttcctatcccccacagaccacccaccaaaaccccagtcaacagtctgcctattttattaaaaaggacttatcacagtttcactgttcattaagcaccttttgtttgatttcctagaaaacagtgctgttgaaaacattttagctgaagacttttaaatactcaatagtattattctgtctttgtgtgctcatgtctttatatttctatagcatacattctggcgcactaaggaagcaacttttaagagttatgtgtttgatgaggtttgctttctgtttaatggcatgcatatcctaagctgttgttttgtgaccttgaataataacttaataagttagaggaaaatatagtcaggaaacttnactttggttgttgtctaccctgaaagctgtcagatagcaattatgtgtaagatttggaagtcggcttgcactttactgtggcttttaaagtacttgctgtatccagctactttgcaaaatgctgataaactcttaggaagatgggtgtgtttttatggcttgaatttaagagtaatgacttctgagacttagatactttatctgaaggaggtaaggaataataaaatagcagaggtagaactgcagatttgagagtccatgatttgctttcttttcatatattttgtgaaggaaaaggttaacatcaatgaataagctttccaggcttgaacagtgtctgctttctgaacaacaacaacaaaaagctataatcccaataaaatgtcttgccactaatgaaacctcagggtccagtctgggatattttattagataatcgaggttttatattgctgttattaaggcactgaatcctggtagggagttcctgaatattaagcaatgatgcacttcccaacaaggcagtgaaaagggaaaatgcaggcagtattggcagcatactggggcttgagcgttttctccccagggttataggcaattgaaaatccattcagcagcctgcgttcccctgtgtctcaggacttattcatggagggcactgagaggcctaagaaaatagtgttaatcacagttcctttggtgcctgggtgtgtctatattaccttcttcaattcccctcccattttaggaaccaaatgagaaataaaatgcaagagacaaatggagctctgttattaataaagccagttggaaactgtggcttagatgtgtggccactaaagactgcctggaattagtgtcactcatgctctcagccctggtgcagggggacagttcttgcctggtaacttacctgcaggagagcagaccagaatgcccccttctgtgggcagacagaggtgaaaaagagcaaggaaggcttgaagccaggcttgtctaggacttcctccgaagctctccagaaggggtggatgttgaggagtagggtgggagtggggtgggagtagagaaacctggagtgttactctctgcaaatcccttctgagaacatcagaccaaggcaaggaagttgctcctaaaatgctccaacagagatgaaaagtaacgatcagcacaattacagaagaaaacagacctgttttctatatgttttaaaaatattttatcatacaagaatgacacatgcatggcagaaaatttttgaactgtatatgagcagaatggaggaaatcagtaattcctcattacccactaccccaagataatggctgttaacatttgggcatattcttttcttgtgggtgcaacaaatacagcatatttactattttgtagcctgcctctataaaaaaacttgatattataaatgagttttaataaatctagaaaatgactcctgggtgcttatcaaaataaaacttttcctattttcattttgcttatatgtcacaggacttactttcaactggtgttaagattggtgagtatgtctatccatgtgatatttaaagtaaaacaaaacatttatggttttaaggtgtatcagtcagagttcttagacactagcaacagaaaatgactctggctaagcagagacgtgattgggcagctggagaattgggagaactggagagtctgaatgaaggctgagcttcctggagcagcacccaacaccaaaccccagaactggtctgacgagaaagtgccacctctagggagctctcgatgccacgtgacctgtctgccaggaccttaatcgcagctgctggccctgccatcctcaaagctacctctgtgtcgagtgtgcagctacaaggccacccttctcctgccactgctgaagagagcacgagctcccccctccctttcataatgtaagctcccagtccgcctccgtgcaggctgcctggttggcagagctcacttctccctcagccttttctctagctgcaagggaaactgggcaagcaagtctctagctttttttctctcacttcaggtagacgatcttgcctcgcccaacctggactcacaaagtggtgaacttgccaaacacataactcggttcaggcagtgagtggccaaatgaaagaaaaatgttttgcttgtgtcatgttgttatgagatcttgccttaactgatgttttcaaataactaaacagcttcctgttcaatcatgttagagaaattgacctcaattctgttggcctctgtggcttggacaaagttacagcctttcttacttacctatcccatgagccagtaaggatcaagtaagatgaaaatgctttggaggtaataaaaaacatacaagttatacttattcaacccctcgactaatttctcagtatctcctttcccttccaacatcgatcttaaactgtcatcttgaggattatcgtggatatcctaataaactatccagtgacttctggcttgacaccttggcagcatctgacacctctcccacccccagtcccccactcccatccccacacatacttctactcactttccaaattctatagattcttcccaccatgtttttttctgcagcagtctctgtttccagagccctatctaggccataatcatcttctaccctgaataatcacaggtcactatcattctacccattgctaccagacatcttcttgaagcacatcttttattacctactcctgctgagaaaccatcagtggccccccactactcacagaataaagtctgcttccaaggggtgtcaccattaggaccctggctttccatccagcatgagttcacagttttccacagacatccccaactccctctactcaaaccagttatttgtgggtgagttcaaagaagcttaagctcttggggtcccatctgagacatggccaagttggaaagagaagaacaggtttgctgggactctgtagggcttcttacaaatgggactctgtaatgagagcatttaggttttttgaatggggaaagccattcatggagctgccagaatgtgaatgggctaaagaggaatttaattaaatcacttattgagaactaacagaagaattttgggggatgagaaaaatagtgtcaacattgaaagagtacaaaatactggcatgaacatggtaggaaatgcccctccatgggacattatcagtggagatatatggactgtggtggtggtcattcaattagtagacatgtaaaacaggcatgtaaaattaatactctatccaacaaacatttatggaacatctattctgtacctgatactaagagttctggtgatacagtagagaagatagcagttcttattctcatgaattttacattctagtgggaaagacagatagcaagcagattaataagtaaatatacatgatcatgtcatgtttttacaatgttctgaggaaaaataaagcagagtaatggcaaagagtgtgacatcgggttgtagtggtcaaggaaggcctggccatttgaaccaaggcctgatgaagtgagggaacaagccctgcatatatttgtgggaagagccttctaggcaaaaggaacagcaaacacaaaaacagaccttgaggcaagagcatgcttggagtccttggataatagcaagaagctgagagacagtgggtactacaatggtattaaggatggcagtcagggatcagcccaggtagggtcttgtaggccaggagactgatcatttcttctctgctccatattcctttcccatagagttgtctcctaagctagtcctgcactgggctttgggatatcagctctgaagccatagccaatggacctcaagacgaatccgtcggattctttatcctgagaatttgaatgtgaagctttataaagtgatagagtccaggcagggctgggctgcatgggccgtgtttggctcatgtgcatagagaagtatcctgaaacaagaaggagggagaggaatgaggcagacatagaggaaaagaaacataaatgagagcccatgggtccatgaggaggagagatgtgccagtcttggtcccaaagcttcctgaggcccagctacacttcatgctcttgaattctatatattatccatgtccttgttagcaaattcacatatacttaagcctaagtgacttctatttctttcaaccaaattgtcactgactctgaccccattgtatgccaggagagaggtgtggaaaagaggttattgaccttgaggacagcaaagttactgagactcggcaggtgaagaaagtcttcatggggagcttgtgtagacatatatttgttttgtctacacaaacaattttgggttgtagggggtaaacacttatgagtaggattgctggatcaaatgtaagtgcagagtatttgtttaatttgatttaaaaactgcctatattagtagtcagagttctccagagaaacagaaccaacaggctgtgtgtggaggggggaggaggggtgtgtgtgtgtgtgtgtgtgtgtttgtggcgggggtgtgtgtgtatacacatatatgtatatatagagatcagctggttgatttagctgaaggaattggttcgtgtgattgtggaggtttggtaagtccaaaatccacagagcaagctggaaggctggagacccagggaagagttgcagttcaaattcaaaggcagtctgctgggagaattccttcttgttcaggcggtagtcagtctgttctcgtaatgccttcaactgattgtatgaagcccacttatattatagtgggcaatctgctttactcaaagtctaccatttaaatgttaatctcctcaaaaaaaaaccttcatctgcaaatgaagaaaccaactttatttctctctatctctctctatctctctctctctctttcacaaaaacatatagaatratatttgaccaagtatctgggcactgtggctctgccaatttaattcataaaattaaccactagattgccaaactgttttccaaagtggttcttccattttgatttcccaccagcaacttatgagatttccagttgttctgcatccttgtcaacacttggaattttcaggctttttagttttaggtattctagttaagtggtagagataatgcattgcatttccctgatgactaatgatgttgagtgtctttttatgggcttattgtccaatcatatcttttctgtactaaagcatctgtttaaatcttttggttatattttcagtggcttgtttgtcatcttattgagttgtaagggttgtttatgtattccaggtataagtcttttatcacataggtgttttgcaaatattatctctagtcaatgactcatcttattttcctaacactgtctttcaaaggatggaagcttttaattttggtgatgtgcaaattattaacttctgcttttatagtttgtacattttttgtgtcctgtttaagaagtcttcatgcctgggcaacatggtgaaaccccatctctactaaaatacaaaaaattagccaggtgtggtggcgtgtgcctgtagtcccaactacttgggaggctgaagcaggagaatcggttgaatccgggaggcggaagttgcagtgagccgagatcacgccacggcactccagcctggatgacagagcgagagactctgtcaaaaaataaataaataaaaaataaaaggaaatcttcacctagcccaaagttacaaagatttttctgctatgttttcttctggaacttttatagctttagctcttaaatttaagtctctggcccattttaagttaatttttgtgaatagtgagagggaacgattgatttttttcacatatgaatattcagttctaataccccttttttgaaaagattatcatttccatattgaattaccttaacagttttgttgaaaatcatcttaccatatatggtgggtctgtttctggacttcattttgtttctttgatttatatgtctatcctgtgttaatatcacactgtcttgattactgtagctttatactaagttttgtaatcaggtagtatgagtcctccaactttgcattttcttgtagattttagaatcagattttagcatttccatataacttttataatctacttgtcagtttctacagagaagtctgctgggattttgattggtattatgttgaatctatggatcatttggggcataattgatgccttaataatactgaattttccaacccatgaacatggtatatctttccatttctttagatcttccttaatttctctcagcaatgttttttttcctaagtatgtcacgtttttagtattttctttttaatttcaacttccagctgttcattgctagtatattaaaatgtcattgcatttcatatattgacgttgtatcttgtgaccttgttaaactcagttattagttttatcactttggtatattcctcggtattttctacatagattatgtcatctgcagattatgtcatctgcaaatgaagaaaccaactttatttctctctctctttctctttctttctttctctctctctctctctttctctttctccctctcctttcccctctcccctctcccctctcccctctcctctttccttattacatgggctaggaccaccaatattgaattgaaataattgaaatgatgagagaagtggtctttcaccattaagtgcggtgttagctacaggttttttgcagatgctcttcatcaactttccttctatttctagtttgttgagagtttttattatgaatgggagttgagttttgtgaaatgctttttctgaacgtattgagatggtgagtgtatatgtttatttttactagctatatagccttggaaaggtcagtttctgtcttctgagaaatagggatactaataccttttcctgtggctgttatgtaatatatataacattcagcataggctctggtggttggttgactctgtaatattattatatggataattattaatattacagagtcaaaatgttgactctgtaatattattatatacattaatttttttaattttccaaatgtgaacgtattattaaccaagcttttgcaaattatatgactcccagcaattctaaacttctcccaaggaatacttgtgccccagatgagcattcgtgtcctaagctttccagatttgctttatttcccgggagtgagggctcacactattttatagtttcctaatcataagacactgtattctaaaactgtcattgtttcctagtaagttttaaagcaacattttttgtttaaatatgcayatataatgtgtgagtgtgtgtgtaagtaatggctttaggagttgtacatatgcaaaatagatgggcattacacctggataacgcttattttattaatcttttctgttatctgtcttttcccttagtaatttatttgttgaggaaaaaatggttgatttttcctgtaggatgttctttatccctaaagtttagtctgggttttgctgattgtcccctgtactgtcatttcatatgctctctgttctctgtgttttatataaattagtagacagatgtagaagcttcaatggactccatttagatgatttttggcaatattatttcataagtgctttttctaagtgtattaatttattgggatttaaaaatgatgacattcagattttactattccctcatttattagctggacttctataaggagaaacacttgtcaactctctggttacttgacatataatttatactagcaaggcagagtaaatgtttgattctttctttttatttaccagttttcaaaataaggagttggtttgctcacaccctccagggggtaaccagtgagaaaggcaagttttattgttactattgactttagtactgtgaatttaagcacatttgatatattttaatccatttcattttggacagtaggagcctattaaaggtggccctgattccttttgacatactccttgtgctctttgatagctcctttgcttctggtgtgatgagatgttccaggttcatcctttatattttctacttttgacctggaatcagctacttcccctgagaggttctcttagtttctttaagtgagaaatggtatttaatgacctcaatctattgggactactaggttgctcattatttctaggccaatttaatgggcagagtaagataaaatgcttcacaagttcatattgatccttcccattcaaattcagtacaacaggattacaactcccttttaaaagagaaaaattcacatagactaatacaacttcagtgagccacagaactcagttgagaatagatggatgaaaataatgccgaaaaaatgtcttttaactgtaaactatctctgtaaaatagaagtttttctatttctaaataataatttagtgaacatgatgggagctgaggattaggttatcataaaaatcaaaacctatataaattctcttatagttttagggaccctgagaatggggcatggaccctgttttttgagaagctctgtccctgtctatatatttctgttattttcatgtgacttcatggatttatattttttaatttttagttttcaaaatttaactttgaaattttaatcttcaaaaatttgattttcaaaattcaaaatttcaaaaacatacacctcatatgttttttccatcaatcttctgaatgggcactgaggcatctgaaagaaaaagattttgcatatacttgcctagacagacaccaactttatcttgtcttagtaaaaattttatgtgatttttaatcacttctgattcatttgctgacttgatacctgagtggttctttaaactatttaaacatgcacatgcctgcatgcaaacacaaaccatctgtttaatcttgtacacataaatgaagagagggtcagggcaagggctgtattattcactttataaagtatgcacttgatggctcacacctgtaatcccagcactttgggaggtcgaggtggacagatcacctgaggtctggagttcgagatcagcctggccaacatggtgaaaccccgtctctactaaaaatacaaaaattagctgggcatggtggcgcatgcctgtaatcccagctacttgggaagctgaggtaggagaattgcttgaacccaggaggcggatgttgcggtgagctgaggttttgccactgcaatccagcctggatgacagagtaaaactccatctcaaaacaaaaacaaaaacaaaaacaaaaacaaaatatgcacttgagcatttcattcataaagctagacaccctagtgcatttaaaatatgttacctgtacaaaaatctgtatacagctctttagcaacatatctcttgagtaaataaaattactgttcatcagatgtgttgtcttttgaaagaaagaaacaacaccatattcagaggttgccaatgctgctcagttgtgaattctgcaagaaggcattcatggtaatgtcytgactcatgaattatgtgctatatttgagcagtgaggtcagctgttgtagcacataattcattatctcacattcatgatttttcttcctttctctatttcatatgtcctgccttccttttttctatgtagaatttctcctgtctggcccagtgttgggcatgatccagctttcctattaaaatgtaacttcaacatttatttttcataattgtcattttaaaaagtatgacagttttgaagatattattttatagcacttttatgtgttttaggtccacattaaactggcagaaactgttatacaagacaagtacatcttctctgcattagaagttgtgcttgttattcaaactgcttctcagcctgtgtctgctgtgccacggtatggaagcgtatttcatctgttttacctatttgggccaatggtttatccctaaagcagcctacaaggatttatattttttaatttttaattttcaatttttatgggtacatagtggtataaatatttatggggtacatgagatattttgatacagccatacaatgagtcataattacatcacagtaaatgggctatccatcacctcaggcatgtatcttttctttctgttacaaacaatccaattatagtgtctttgttactttaaaaggcataataaattattgttgactgtagtcaccctgttgtactrtcaaacactagatcttatttattctatctaactatatttttgtgtccattaatcatccctacttcatcctccccaacccttcccagcctcttgcagctttcattctattctctatctctatgaattccatggttttaatttttatctcccagaaaaaagtgagaacatgtgaagtttatctttctgtgtctggcttatttcacttaacgtaaatacctccagtgccatccctgctgttgcagatgacaggatttcatttaggatctcattcttttatatggctgaatagtactccactgtgtatatgtatcacatctttctttctttctttctttctttctttctttctttctttctttctttctttctttctttctttcttccttccttccttccttccttccttccttccttccttccttccttccttctttccttccttctttctttctctctccctccctccctccctccctccctctctctctctctctctctctctctcttctttttttgagacaggctctcactctgtcacccaggcttgggtgcagtggtgccatcatggctcattgcagcctcaacttctccaggctcaggtgatcctcccacctaagcctcccaggtagttgggactacagacacatgccaccatgtccaggatttttgtactttttgtagagrtggggtttcactgtgttgcccaggctggtctcaaattcctgggctccagtgatcagctcgcctcagcctcccaaagtgctgtgattacagaatgtattttctttatccattcatctgttgatggacatgtaagttgcttccagatcttgactattgtgaatggtgctgcaacaaacatgggagtgcagatagctctttgatatgccaatttcctttttgggagtatatacctagcagtggaattgctgaatcatatggtaagtatatttttagttttttgaggaacctccaaactgttctccatagtggctgtattaatttacagtcccctcaacaggacataagggttcccatttgtccacatcctcagcagcatttgctattgcctgtcttttggataaaagtcattttaactggggtgggatgctacctcattgtagttttcacttacatttatctgataatcagtgatgttgagcatcttttcataaacctgtttgccatttgtatgtcttcttttgagaaatgtcagatcctttgcctgtttttaaaccagattattagatatttttcctatagagttgttttagctctggttatttatctgccatcatatgggtagtttgcaaatattttccctcattctgtggcttgtctcctcactttgttgattgttgcctttgctgtacagaagctttttaacttgatgtgatcacatttgtccatttttgctttggtttcctgtgcttgtggaatattactcaagaagtttttgcctagccaatgtctcagagagttttcagtgttgggtgcatatatatttacagttgttatattgtcttgctgaattgacccctttatcattatatagtgacctttgtttcctcttacagtttttgtcttgaaatatatgttgtctcatgtaagtatagctactcctgcttttttttggtttccatttacatggagtatctttttccattcctttattttcagtctgtgtgtgtttttataggtgaagtgtatttcttttaggcaacagatcattgggtcttgtttttttcatccattcagccattctaagtttttttattgaattgtgtccatttacattaaatgttattattgataagtaagaactcactcctaccattttgttgtttttttctggctgtattgtggtctttccttcctatcttccttttagtgaaggttatttttatctggtggtgtgttttaatttcttgctttttttgtgtgtatatgttttatgttttttgatttggggttaccatgaggcttgtagataatacactcattattttaaactgatcacaacttaacaccaattgcataaacaaacaagtaaagagaaaagtaataacarctgtatgctttaacttcatcccctgattttaaactttttcttttctgtttatatcttattgtactatgtcttgaaaagttgttatagtttttttgactagtttatcttttagtctttctactcaagatatacttatacaccacaattataatgttataatattctgtgtttttctgtgcacttactatcactagtgagttttgtgccttcagatgatttcttattgttcattagcatacttttctttcagactgaagtactttctttatcatttcttataggataggcctggtgctgatgaaatcccttagcttttgtttgtctaggaacatctttatttctccctcatgtttgaaggatattttcaccagatatgctattctagaataatttttttccttctgcactttaaatatgttatgccactctctcctggcctgtgaggtttccactgaaaagtctgctgccagatgtattagagttccattgtatgttgtttgtttcttttatcgtgctgcttttaggatcctttctttattcttgacctttgggagtttgattattatatgtcttgagatagtcttatttgggttaagtctccttggtgttttttaccttcttatacttgaatattgatatctttctctaggtttgggaagttctctgttattatccctttgaataaactttctacctctatctctctctccacctcctattttaagccaattactcttagatttgcctttctgagcttgttttccagatattataggcatgtttcattccttcaagtttatttaggacctcagaacactttaatccgcagtggcaagacttgcaggaactcaagttgcaacgaccagaatgggcaattcccctctggctagggctggtctaaatgctccctccatgggtgccacctgagttctgcctggtattgctttctgctgcaacaaggcagcactgagtttcaatgcaaagttcttcagtcactgtgttctccctctcctaagctcagattctctctccacaccacatggtcgttgccaggggatggaggaggggtggtgttggcaattcaagactgtctttcctaccctcttcagtgcctctttcactgatatgaagttataaccagatattttgattgctcgtctgatttttggttcttatgaaggtgctttattgtgtggatagttgttcaatttggtgttcctgcagggaggatgatcagtgaaggcttctattcagccatcttgctctgcttcctcttctcatttactgaataactttcttacagagtttgacctaaagatgcaattaatgattagttcagattgtgaagctgaaagctgatgctggtgtcaccttctaaaattaagcttctggttataattaagagctgcagccttggagcattgagtattatctgtggcttggttgctaacagggagaacttcaggatgctccttttaactctggttctgctagaccagcttagaaaaggagcagtagtattagagaaacttgtatttgaacttgttctcaagggcatggtagcaaatatctcagtggattgaatgcagatggagaggaaactttgatcatttgagagatggagtaccagcaagtcctctcatccttcaagttgtcagaggaaataacatttacctgaatgaaaggtcagttgggatggcaaatactgagaagattagagtccctcactttgccctccatgtgagctacccagctccaatgacaaaagagtttgaagtggagtgctttgggagagagtctcagccttctggctcaactgctgctttctgcttatagaaagtattccaggtgctacctttccttcatgttttgcacggctgtatgttgaaaagcatgacctatgtgtcagtctgggttccagcaggaaagaatcaggtaatttagaagagtttaatgaagcgactctttaaaaagatatgttcaggactacataaaacaacaagagattgtgagacatcctgaggtttgcaacagtggggagctttaaccctatgtaggcctgaaggggccaagagatttaaaaaaataataaaaaaataaaaataaaataaaataaaataaaagacacagttactggtggaaaaaaaaaaaaggagggaagattctcaaaccctgcacagagtagctatagctgttagggagggcagcctggcaggagctgtggcctgtaggagaggctgatgaccatcatgacccagcagggggggagctagaggaatcgatactctgacctcactttcctgcctctctcctatctcctgccaatgtgtcccattggcttaacccaaccagaagtgaaaggacgaggaagcccaatgatacagaatatcattcgtttggatcacagaattgagaggcagtagatccagagaggcaaatggaaagaaaatacccaaaaacatctatttcctttaaaatatggattgttcwatacagcaaaatgataagtatgaacaagtgacttcatgtatctgattccaaatcactgaatgggtgtgaagtgagaaccccaagggtagttgaactaataatagtagtggtcattattgttgtgatcttcatctttgttgagagcttacattgtaccaggaactgttgtaaacactacatctatattaagtcgtttagtttctaaaacaatcccataagtactataattagtctcatattatatagttgaggaaactgcagcacaggaagcttaggtcctccatacacagtctcgaagctcagaagcagaagaggcaggatttaaatccaggctgtaggaatacactcctaccctgtactgactctctctcaataaaggaaaaagtaaataagacacctttgggggagggaagttggagcattcagtaatgattaatatttgcttcctgttgataattagatatttgaagagatttaatgtgtttgaaatctctttccaactgaagaattttrggtttataaggcaaagaaagttaatttgtttgtgggtcattaacagtgactccacccagaacagtttaatgatagcttttctttctcttccctttaatattatttttctttcctgtgttattcagasaaaaggtgctttttcttttttctatttttttattgtatttattttttatttttattttttattatactttaagttctagggtacatgtgcacaacatgcaggtttgttacatatgtatacatgtgccatgttggtttgctgcacccgttaactcatcatttacattaggtatatctcctaatactatccctccccaaccccacgacaggtcccagtgtgtgatgttccccaccctgtgtccaagtgttctcattgttcaattcccacctatgagtgagaacatgcggcatttggttttctgtccttgagatagtttgctgagaatgatggtttccagcttcatccatgttcctacaaaggacatgaactcatccttttttatggctgcatagtattccrtggtgcatatgtgtcacattttcttaatccagtctatcattgatggacatttggattggttccaagtctttgctattgtgaatagtgccgcaataaacatgcgtatgcatgtgtctttatagcagcatgatttataatcctttggatatacacccagtaatgggatggctgggtcaaatggtatttctagtcctagatccttgaggaatcgccacactgtcttccagaatggttgaactagtttacagtcccaccaacagtgtaaaagtgttcgtatttctccacatcctctctagcacctgttgtttcctgactttgtaatgattgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatggggttgtttgattttttcttgtaaatttgtttaagttctttgtagattctggatatcagccaaaaggtgctttttctgagcttcaggaggacactaacagcagagtagcatctaccaagtaccaggcattggccagagaacttgggaaggataaatcgtttaatcttaataatagtcttgcaaggctgctgttaaaaatccctattttacaggtgagaagactgagtcctggagatatgtgtcttgctcaaggtcattcagttaaaaagcataagccctgacaggtctcacttgttctgaggctctatcttctttactgactgtagtgtcccctggagactaagtgatttgccctgggccaaggccatcagggctgatgaatgagctttcagttaaccaaagccttcacgtatttttttcacatgaacacctatgtttatttatgggttactcctaagaagagaagctgaagaaaggccacagatacaggagaaaatgaggatggtggtattgtcatggagagaggggagtgtttctagaaagagagccgtgtgccagaggagcagagagcctgataagttaaggacaagtgtcctttgcatttggacatgtggagatcattggtgaccttcaagagaagtgttggggagtgatccaattggagtaaacttcagggtaaataggagggccaggaggtagaggcagcacatctggacccttccttggagaaatgtagctgagaaggaaggtagatattcagtggcgaccaggagggtggaatggttttctaaagacagaagatattagaatgtgtttgaaactgatgagcagagtccatagacaggaagaggataacaatgtagcagagagggggagcaattagggatcaaagttggcctgttgactcaattctgtgcgatctggtccctgcccatgttgctggccccgtcccctgatcgttatgcccagtcattcttctttctgttcctccatgctgaactcagtcttgctttagcacctttgcatttttggttccctccttcaagtctgctctgatgtcacttgcttactggtgcctaccctgactgccccattttgaattgtgacccactgccccttcacatacatacttccactcgcctttttcctgcttttttttttaatatagcacatattaccttttttacatggtatataagttaatacttattatgacttgtgatattatctcttttccctagtagaatgtgatctccatgatgttgggaatctatatctgctttgttcgctaatgtatttcaagcacctggacactgtgtggccgggagtaggacctcactaatatgttcgtttgaattgacttaactctccactatctgaaattaccttaatcagttgtttgcttgcttattaattatttgtcccctaaacagaatgcgagcagggaaagcagggaccctgatagtctcatttactggggtaaccccagcactagaactgggtcaatacatagcagtgctcaatgaatatgtaatatgttgagtgactgatggttatatcccctaactcgactgaactcccaggctctagacctttggcttgcctgaagcacagctgactgtcaatctggactgtcagtttccagacctttgccatgctttgtccctctggaaatttctggaacttcaatattttaccataacacagaatgtggattctgacttcatcttatgcaacttgttgtcatcatttcatagatattatgcctgtttttacttcatgtgaattcttaatgcctgtagatatttaataaatattgctcagaaatgaggttaatcatgaactattagtgctaaaaggaagtttagatagtatttaaacctgtagcatatataatggttaatatcaggcatgagttaacattaacatcagctgtctaatcataatgtgaagttaaaatttgagaattaaatattctaaatattaatcttgtcattaattaaatacttgatgctggcattggataaattaaggagaagattgatggaatcctgaacatttattggatatgtttaaaagttataattggtttcaattcagactttagctcccttattataggggtcacatattctgaagttaccttttgtatagttttctacaaggaatcttacgtggttaatttttgaaattgtcattctataaaaagatatgaagaaatcgttaaaagcctaaaaaatataattgtgggttaatataagaggagattaacacatgaaatatcacagccctgtaacaatgcctttaagaaggtcatattaggcattctttctttttaactcacttttactccagaactattacatgagttcacaggtatggagatttaatagaaacttatttgcaaaaacatgatttataggaagatgaagacaaattgattgtctctcactgttctgcactcctaggaattttaagtcaagctacttagaagtttcctgtatagtataataagattttagaacatgtcactatgcccattatttttcattatctgcttaagaagttcttctggttaataagcttttcatcgcagaacctagatcctctagaaagctaatagatattctttggaatggttgccatggcactcaggtgactctgcctgtcactgtctgaatatttcttcccgtgattattttcagagcggggttagcccagaactctccagccagacatagactggctccaattcactttaaggatgggcagtttaaattagacttttgacctttatttcttctcatagtgtattagtcttctatttctgcataacacatcaccacaaatttagcagcttaaaacaatacacattctttatctcacagtttccatggggcaagagtctgggcacaggtcagggtcacaatcaaggtgtctgccctgggctgcattctcatcttgnggcttggctggggaagaagctacttgcatgctcattagtttgttggtagaaattatattttttgtggctgtatgactgaggacttagctttctgctaactgtagacaggagtctacctacagctctttgctgtgtggctgcttacctcatcaagccagcaagaagatcctctcactccaacccaccaaaccatgtcttatatggtagttatgggggtgacttcccatcatctttgttctattctattgattagaaacaagtcacaggtcacacctgccatcaaaggaaggggattacacaaaagcatacacaggaggagggagggtcactgggtcaccttagggtgtgtctaccatgttcaggtatctcattcccccaccagtgcctgttagccgttgcatcacaccttttaatatagttaatggtgactacaaagggaggaatttcagacttattttttctagttgtgggaccaatttgtgtttcattctcaagcttctttctgtgttctgggatctctcttggttactttgggtgtgggagagagtccctgaggataatggagttaaacagagaatttggtcttgagaaagggaaagttcgattctagagtttttgagtagccatcgtatttgtttcatggcattaacactatttccacttggtttcttgttatgtcacccaggaaagtcgtttaggttatcacaacaaattgacacccagatggcacacacacaccatcagaggagtcctacagtcagggtgggaactggtccagatgaactcagtgagcatgtcctacccacaaattatccttttttgctataaaattagaaagtctgccttcccatgcaagccagctgggggaggatatattctctagagatctagttaatggaagaactatttttcaccatctgactgagagagagaaggagaaataaaaaccctagggtgaatcttactgcattgaactataatgaacctcaagacaatcaaataagatgacaacaacaacaaaaaggcaacccttcacagttgaaaaaacagtgtaattttttgggtatttaaaaacttctctctcacatttagagtgcccatattcttggaaattattatgtagcatgtttctgtttatattctttctaatgacctgcttttgaagtgccttaagaaatgcccacagagtgcattagtttcagaataaagagtaggtcagcattgtatgaggtttttgaatagtgactggaaggcacttttaagcattgacagccaaaattactgaggtagaaatctgcaaaagtaaaggtattatttaaaataataactcggaaattgtccaagttttttttttttttctgtaggtgctactcttctcccactggcctcaggattataagtttgagggcttactggctgacattagtaggtaaataaatatgggccaagatgccattggcttttgtggatagcaatgtgccttaggacatgaacataaaatcataatagttctttcttttcttagggtttgaaagcttatgtttccatttcattctctccaagagatttggccaagtcttaaagagtaaatttatataaatggacaaaagtgccaggtgcttctcagaaattcattgacagataaagggggcagcatgttttgtttttttctattccatatttttcaggagatgtttgtttatgcagtttagcttacagttctttcttattcttgtatattgcgatacacacgatgagtatgtgactcttcatttttaatgggaagagtgattacattaaaatggagaatactgacttgaattttatttaatggattcccccgttggcttttatatcatcctttaaaagtactaacagttcctaatgtacatttgtggggaaaaaaaagccaaaaacaaacaaacaaacaaacaamaataacaacaacaagacagtttatttccatgcaatagaaagacccctgtggccaaaatctgaggcactgctgtttactttttggtccatgcttgtggctgaagctcagtttgtcttcagcatagccacatctatcaccaatatgcttgctgctcttcactgaccttataagcttgtgaaccacatttagaatctagcagctgattctagaaaaatagtaacctcatctaaaggcttgaacaaaaatttggcatgacctgtacttaacaaattgctttttcctaaacctagaatgacatttaaatggtagttaatgtttgagtctcccccagtatccaagttaatccccttatcaagtaactcagataaagcctttttggaccatcagggtagcactggatatactgcccaaagaatgtgcttaagaattaatctgctgaatttattaacagagagtaatttaggcagtgatgaactcaagcccagtgacatatgttgctctcttgtatattcaagttgatggttgtgcattgagtcaaaacctcttaaagtcgttgggatatgtttcaaattttagtaatgcttttctaataatatgcttaatattaaattttacaaagaacaaatgaaaagcttgagatatattttaactaaattagcccagcagaggacagtgatttaaactaattgagtctgtgagtggcatatctctaagcctaattaatgcttgaaccctaagatttcttcaagattgaacattaatcaggcaacctcagtgttctccatattcaccgagccagcaaatctttttgggcctcctatgtgctaggaacagttctagggacaagggatgctgcaatgctcagttcagacaagatccctcttcctgtgaagcttgtatttcatttgaggaagaaaataatgagcaaaaatgtaaatgttcaataaaactatcagctgcagttaaatcctatgcagagaattaattagggcatcatgacaaagagtgatcatacagctacattaaactgggtgggacaagaaggtctcagtgaaatatacagactttgaacaaagatcccattgtcaaaaaggagcagtcctgggaaaacattccagaaggaacagtggtgcaagctcgatgtgtttgaagacaggtacaggcttttgtggccaatgtactaggaatggggaaagtggtcccaaataaagaccatgttgtgcagagccctataagacagaggaaggaatttgaatttatcttaagcacagataaaatccaaagatctctggaatgtgagctccatgaaggaactatggaggcaagaaacctattagcaggctgttgctgtgggttggttgttagcaattaaatatctgtaacaaaggctggtcatgccctatttttccttttcaataggaataaaaaccaggaaaaacatgtctcagtttgacagtggagaaagagaatttgatgcacttttaatttattgttgatgtctatctaaactcacctttgcacctgggtttctctgcatttgtgagaacttgaactgtaaatcatcatgctttgttttaaaatccttgctcaagaaccaagttttggtcatgccattgtaaatttgttgcaaagactgatgtaatttcttggaaacttgacttcaatggattgccctctaaaattaggacatatttgaatgtcttcaaatgaggcaggtctaattcaggtgagagtgagaaaccagtcattttgacctgctgggcacctcacccaagctctgtggagtcatggtggaggtgactatattcaatacctagtgaggataccagcagggactgagcatagcccctcatgctttcaaagaaaaatgctgttttgtgggcactttctttaataattaataatagaagaaaattaaatttttgtaactataaaatttgtttcaaaattgaatgtgtttttcatttgggatcttgcttgggtctgagcaaactgcctggcacagtaagaatgaacattacttgctctgtaagtgtgtaggatgttttaatcttaggcatatttctgcccatccttatgttggtcttatgcagtgtggctgcctatttaaaactcactgtattgtaaattcgtgctgctctttattatatttagagactgtttgattttcactgaaagctgtcccaaactgcacagtatcataatctgaacctctgggaactttttatttcatattcggaatcctcagaagcaatttgccagcatgttctaaagataggttaaaaatgaatgaaaatggaaaaaaatggattatgatgatttatgttttaaattttatgttgcttttacatttctaaaaatacacttatacctacctcatgtatatccatgtcagagaggtattacagcaagataagagaggtattacaacacacaaagggagaattagacgttaagatgacctactcaaggtcataaagctaaaagcaacaagcaatccaccagttttgttttgaacatcctcaagagtgtcaactgtgttctccagtgttggggtcaaatatgtgcatccacatggccagggagcctgttagaatgtgggttcctggactccaccccaagcctcccaaaccagactcccaaagtttggagtttaggaatctgcatttttacacaccctcccgagctggtttttatatgcattaaaattgagaacaattggtgtaaagaacaattagatctagtcagggccagctcttgcaaaattgtgaggttggggagsattttctttgacccatccacttcctgctttaaatcgtcttcttccctctgtgacttcaagcttgtccccagctgtcttctatcaaaccctctttgagaagaggatatgcaaaagctaaaagtaccactcgtccataagttttctgctttttaacagagagcaagtctttaaaaaaaaaaagaaaaaaaagaaaatctataggagaagtggaggaggcaccatttgggaataaaggaaaatgaggctctccttgaacctgcagaatcacccttatctatttcattgcagcctcaggtcagtaaaccagagtaaatgaaagcgcagtagactcccagcactctcccccaagatccatgtttcaaaacaactgtagattgataatgtaggtttttgggtggggtgcctatgagctgctcttaaacttgctgttttccagagttttcaagtacaattttgccatttgagccaaagatcatgtcagatctttctagtgggacccctggacagrctttggagaggacccctagctctgccaagagtgtggacacttgaattatgaagtcattcttgcagattctgttgctgcctgtgctaatcatgaagacaatgcatgctgtttctatgtgctgtgattgccaaaaccacagctgataatgagctgctttccaaacatcagaagggtttgtcatgagaagttgggaaattataccaatcatccctaccaaaatttccagggaaaaatctttagcttgacaggaatttagttcacaggctctgaataagttgttcttggacgtacagaagtacagacacattgcaaggcccgaggctgcaatgacatagatgacgtgagggtgactctgtaggttcaaataaggccttatttccctttattcccaaatgcctcctctacttctccaatagattttcttttctttctttgtttcttttttttttcttatgacttggtctctattaaaaagccacttggaataaaaaggtataaaaacagactttgatttaatttgcactggccttagatgctcttgttactgaatgacttcaaagaccaggaacattttccaacagcacttccctctgctaatggaagaacccatgaaacctagccagacctacctgctcctataaggaactagacasagacatgctcatatttaatcacctttggagattaagcccttggtgtaggattcatttctttgtttcactttctagagatgattttgctggaggagatgtgtggcacacctgagctttgctctgcctcttacacactgtgagtcatagggcaagtgggcttattctgctggttcttatttttatcatctttgacaggaggagaatggatttaatccatagatctcacatatgggtgacatccccagattcctggggcccatcccagaccaattgagataatttcagagtctgggcttaaggagtctgtgttttttggaaagctccccagttgattttgatgctcctcaggtttggtggccactatcaggtgatctttaagatccttctggctctgatggactgggaggcaacatctatgctatttatcagtttgccatctgggacgggagaacatggtttgttgctaatcatagccaacactgcgttccaattaactgctttatttctgccaaatgctatggtttattcactagtaggaagcagattaaagatcacaaaacatttgccttaggaggcttctgagcctgactcgcttgtatttttctgttatattcataaagaagagttgtaatgatggccaatacccacttagtgccttgtgccaggaactgttcttctattaataagtacttgatatatatatgaatttatttgatcccacaactgctgttgtgaatattgtgaagctgttattgtacatgttttacagatgtggaaactgaggcacaaagagaataaataacttgctcatagacycacagttaataagtgatgggccaggacttgaaccggagcagtctgactcaagagccatgcactcagccactgcaccatacagtttctccatggataagaagttgtcattggcttttatgcttttactctggatttctaggctggttgactggaaaggtggttggacatcactcaacatagggccacagagaggccacaggtttggcaggaatttcagtggtgttgaagtaccagaaaacaaggtaatgaagtcattattgtgctacatttaatataattcacgtaatcttacatgaagtgatacctgtggagctagcactttaagaaatcccactggcatcaagatgactagatggccaggcagccagcacctttaggtttccgtatttttagttaaattcccttcactggtgataataacagctaccattttatgaatgcttactttgtgccaatctctgatttttaccaaaagtcctatccaactccattttacagatcaggaaactgaagcactgagaggttgtgtaacttgcccaccatgctacagttaataraaggcagagcccaggttcagtctcagctcccgggcctttggatttaagcccacatgcaggaccgccgcatgctgctacccaagccttgctgctgctgcttcatttctggagcttcactgtcgtccaactgtgcagctccttcgtgtgaccgcaccagcccgagcctgcacactgtaacacctccctccatggcatctccatgcagagatggagtgaatttaaatgactgggaaaggaccctgcagccactttcggaccccttgggtttctccttgctatctgtagaaggaagaggtggcactctgtctctcagttttgttttgttttttttgagatggagtctcgckctgtcgcccaggctggagtgcagtggtacgatctcggctcactgcaacctccgcctcccgggttcaagcaattctcctgcctcagcctcccaagtagctaggactacaggcacatgccaccatgcccagctaatttttgtattttagtagagacagggtttcaccatgctggctaggctggtcttgaactcctgacctcagatctgcctgcctcggcctcccaaagtgctgggattacaggtgtgagccaccatgcctggccggcactctgtctctctgaccatcagtctctagggataagctcaacctcactggcatgctggccacaacccattttcctagcttagtgtgtaccttatatcctctcattttcttgctgaagactggtaataccaatttgcagggggaaaatgcggctagaatttatttcagactttgccctggctttgagaattaaaaaaagaaaacgactagaccgtcctcaggagaaattggaagctaccagtactaactgccagatctaacgtggtgagggaggaagaggcaatgctgggagcaaggacctagttttccagaagacagacagggctttgagaccaagatgttaagggaagactgttttcagttcagtatttaattgcttgttttgggtattgggaatcttttgttccctcatgttctagagatttcaggtaacttttcacgtagaaaccgagaatacaaatttttatttttatcagaaaatgctggctgtgcgaacatggaatggaaaagttgcagtttatgtcattcagcagaacataatgtgtgtgtatgtgcatctctgttacatatgtgggggcagtctgactgcctctgtcaatgcgaataattaatttagaccacatgcatgaaactccagaatttaagacatgactctgtgttatgctcaaactttctcataaggcaggttttattgtttaagcagggaaaaattcaacttggcttctctgtttttcccaatccaagcacaagtgagttggggagggagcctgtgtctgaataactgattttttgtgtgctctttgagacaatggtaataatgatgccctgcctttgtatggctcttgatagttggcagagcccatctgcatactttgagttttaaaacacccatgtgagataagcaggagagagattcatttgttctttatggctgagggaatagagattcagagaggttaagcagtttgcacaaggtcacacagctagtaaatagtagggccgaaatagcaaatgtgtttatagtatttatgtgtctcatatttccttccctaatttacaaagacctttccagttgcttctatagttctgtcagtcttcatgaatgactcagagtgtgttttcaaagtaatctgtatattatggggtcattttcatgaatgtaatttcttttattatggctttttaagatatctgtttccttctctccactcctagataacttccttgagagtggggacttaaatttcctttcaattgcctcaaaataacaaatactctgtttcattaaacagagttgactgatgtggttttgtagtccacaatgctacttagaacccccttaaatgaaaagaaccaaaatatgttaggtacctgccatatgccaaatacttcactagctgctctgcagactgcatctccattaacttttcacacagcccatggggtagatattgtccttattttgaagataagaggtttggaaaagttgagagacttagacctaagataccccagctagtagggggcagggttacgatgtaaatccatttcttctgcctctaacaagtttttacccttttcctctatgtaatgtatctttaaaaacaaaggctgaaaatatattgctaagaatttcttatgacaaatcttgagccctcacctctctttgtttcagtgaattcactctcaggctgggttcttttctggcctgagccatgatggctccttgtctctatctggttctgccctacctggtgcccttgtctgattctacttgtcataaccgtctgatttttcatagccacatcagccttggttgagtatgactggccgccatcttgatttacttcatacctccgtttcattggtctctttccatggaaagtatcatatccttcctcatagaacaattattcaagtacttgccttcattagcatccttccatattgtgagctttgagttggttggaaattattctacttacactttaatcattccagcatctagaacagtgtctcttgtgcatcgcgcaaacacactaaatgttgagtgaattaaattgagtcaagagaagctgagtggttcctagaaaagtcactggtgtcaatgcatggcttctgtagggagccmatgaagagtctgagaagacctggggatgttccaccaagttagtgtctattgtgtgtgtttaccagagtgcctgagctgtgttcaatttctatggacctgtactaaaatgactagctcggaaatgataaatatgcaacttgcatggcgccattatcccatcccacacctgaggcaaacaacactattcagtcatggtactgttcctacacagtattccaggcatacattaccaagcaattaaagttgagatttaagaaaatgtatttgctgctcttaggttagtctacctaggagggctgtgtgtgtgtktttaagcttgatgatgaagcatggggaggccagaactttagcactgctagctttatgtccataaacacccaaacttgatcttctgattggcaagaaagtaagatttaaaaggagggaaagtcgcacaacagtgtgagtgtacataatgccattgtatatctaaatatggttaaatcggtaaatttcatattatatattaccacaatttttaaaaaatgagatataaatctcaaaaatttggtgttgacagttgtctggctgaacagtaggaatgagtagagatctggggagaatgaaggtgtagttcccgttttttttccccatgacattcccatattctcaacaatttcctaagcctacagcaaatctgtatcatgatctggggtgaatttattaaactgaatttctggctcttaaggtggaggtgtacagggaatagtcaataaatatttgttggtgttggtaatggtcaaatctaggctggatacacacattctactagatttgccattattgattatccaggataaatatagttgcctagtttctacactatgccatgttggtagtatatattttctcctccatgtgatattcagcttatggaagtcaccactacaatattaatcttgtcaacctaaagagcaagcagagaggtatactctctaaaagaaaatgatatttatttggtaataggcattgcagtgggaacacacatgccatagtaagctatgtgcatattcagggaagtgaaggaagacaaagattcttaaaggaaaagtgaggagggttatatacttgttttgagatgattatccttggctacaagaatcaacaacaaggatggcaccagtctgaggttggacaggcagttgctgggcagatgtcctcacagaagtctttttatgtgtatatgtgtgtgtgtgtgtaaggttacaatggcccttgtgcaaggttgcattgttttcagattcttttgtgatagttcttgttatcaggcatttgtgcatgtccctcccttcatggccttccccagctccacttgtcagggtcttaaacatcttaaaatrtgactccattttgattctgataactttcacattccccscttttgaccaagatctttctccaraagcattgctgatcagtcatccttgggttttgattttccctcagtgctgcaatggacctgtcctggtgtggtctaatctggtcccacatcagagggaagtgattggtgactagtagtcagtgtcaagatccttttagctacatttgagcaacaagggaggtttggagggagtgtttttcaggataggtctacctggagttcattgttaagttcaattttatctgttctgtaggcattagctctcatttcaaagtgctgggtcagtatcatcctgttagaagttgtacttctgaagacacttaacaggtaacaggtacaaagtttaaaaaggaaaatacaaagtaaaattaatagtactatgacaatcccagttcgcatggttttgagccgtgaacctaggcttaaaggtattgcatcaatcaaatgaccatgggcaattagatgagacatgttgtaaccctgtggcctgttttcttattttgtatatatggatctcaactttcccagaagaatttatccagttacagcatatggtattagcaatagcacaggtgttttcttatttaaccaataatatagagcaacaagaaatatagagtgatttttttccatctggtattctatgattgggttgaattaaagcagagagtaatcaacagttgccttagggttgttgctacagtcactcactgcgtggactaaaagatctcctagatcaggtggttaagttaccaggggaagctactggttgtgaaactgcaattacgtcattatcctgctaagtgaaaaaggtagcattaaggggggaaagagtctcattattatattgggtcttgttctgacatctagggaaaagctgcccacagcataaagttatcaatttcttgtcctggtttgcagtccgaatgtctctgtttatggtattgagcagtttgatgaatgcttgctgtggcccatacatcaggcatgagatttgtcccttaaaatttatttagtttcagcttataggacttcaggaacagagcagcttctgtttttaataattctatggaagagttagattggaggattctagaagaattcaggatctagtctgatctataggtggagaataagaacttgaaaacaatgcacaggactgtattctaataacaggtgtattatagcatttccttggaaatataaccttttatctttacattgatgacataggaagctcagatttaaaatctattgaggctaggaagccagatcaaggcatacttcagattttacctatggtttctatcatgaaatggcatttttactcactcactctaaggctgggaacccttgaagccaggcattttaagcacgttctcaaatatgatattccagtcaaagccttggtagtataaccaatgtttccaattgtatcctgttataaagacagagaaaattctttttgaacttatggaaataactgcattgtcataagaacactcacagatagcttctgaattttggaaggaattagtagggcaaaaaagcaaatgcttccatatttgtttacaaaaatatactttataaaattgctgtaaactatagaaggcttaagagaaaaattgtctcttattttattttttgagccagggtctcactctgtcgcccaggccggaacgcagtggcgtgatctcggctcactgcaaccactgctttctgggttcacgcaattctcccatctcagcctcccgagtagctgggactacaggtgtacaccaccacgcccagctaatttttgtattttttgatagagaaggggtttcaccatgttggccaggctggttttgaattcctgacctcaagcgatctgccagcctcagccctccaacgtgctgggattacaagtgtgaaccaacaagcccagccttccttaaaagagaaaattttcttaaatctggaaaacaaaacatttaaagaactaacaatatttcaaataaaagtcatgcaaacattacctttatcagttacttaatttcatgtaattaattttgttctgcttcatcttgattagtagtttcatgaattcatcagtttcttcattagagctctgaaacattttcatttagtccatcgaccttaaagttatttaaacctatatttaagaatatttgttagtcttttccatgaatctgattgcaaatgcttttagaaaagtatcataatggtggatgacagagacttagaatatctatagttaaaaatctgatggaagtttattataatttgcaattgacaaggaatttggttatttctgtagcatataagattttaacataataaccaaaattatgactgataccatantagacttctatgaatttacatactttttaacatttgtatatataacatacccataaatgtaatttaaggaaggtctagcatcacttatcatttgacaatgtttctcatacaatttaccatagagcttaatcatttaatatctccacaagatgagagaagcatccgttgatactctccacgggcctgactagaaagtctcaaagttaattctaggtcaaaaaagacttaatttagaattttgatgctggggaagcccatcaaagatgccaaaaggtttagaatacctgataaaagcagggtcacaggtcaccatgaaataatagttattcgtttaactacagtgataatcaaaaacttcaaaagctatacagaaagttacatggatgtaaaaagcaaacaaacaaaaaccttaaccctttcaaagctcactttaagaatcaaaaacctaataaagactacaaaggaaattattttgataaaactcaaaatctttacgtcttaggtcagttaacaaaaaggtaaaaaaaaatattttgcaatgtgattgcttctccttacgggaagacagtttaaataacctggaagtcaaacctgatgaaaaatacttgaatttaatcagacacaggaagagtgtgtgtccaaagattatgaatgtataccgtattatagagaaatgtaaacaagaaaactatatcttgagcaggggaatatgtggttattagtaaaatcatgggaagtttcctggttacatggagcaattcagacccatgtagaaatcacattatgttggagggtaactgcctttctaggccttcaaggaggaacatcccagtgtcaggccatgtcaacagagttagagctagataaaaaaattacaggagctggttaaaaagttgaaagagttatcacctcagccaagcaaaagatatatcctctcaaggggaaaaagcttaaggcaatgatgtataacctataaatctcgtgcagcaagatacagcaaaagtggaacttccgagacaagaacctgaaaagcttcaagaggaaagctgtacctggagaaatttaaatgaagaagatagcatttccggccttaaaccagggaaattaaatggcttaggaaaaaaaatgtggcaggaatagaaactattaaacaggaataagttgcagcttagaagatggctgttaaacagatttcagaattaaaaatcaaaacctcttacaattttactaagagcagatcagtacttcaggaaaactttgttgttctaacagggagatcaaagttttagttatgtagcagtgtatttttaatatcaaagctcaatatttagaaagacataaataatttccttctaattataaccaacttgatcacacacacaaatttttttcataaattcatccttcacaaacctttcatgacttacacagatgttcgacaacaggctagacttttagttttatcctatacattttctttcttaaataaccagtcattttacgttaggacaaaaatctaccacacaacattttcttatacaaaattattcacttttctttttaacctgctttaccacaaatacatcttaatacttataactttcttcacgtatctcctgcttactggttcatttctatcctctttcttcttccttcctaaatccatattttgaagtaacctttaatgacctctgaatttagacaaaattattctttttttctcaataaagaacatagtttttcttacaatttttctcaccaaaacacatctttttggtacattttgtatacataattttatgttaattagaattttaaactcttagtaacctgaatttctagtgaaaacctaggaagcaaaacgttttgaactgtcacctcatcaatattttaaagatgagagcaatttcataatttttagcaacatttcctataacataatttttatgtttaatacacccaatatatttagtctttgtataaaatttgagaatccaagaacaatcctgaatttatgttcagcaatttatgttttagtattttattaggaatttacccagacatttaatgagtatctatcacttagtttaacataactttaagatttcagatcacaggaaaagttcatttttaaatgtttatcccacttacatttccctaatttatttttaaaaattatacctagattacttataaaaactgagatattatacaaaactagtcatcattttaagttatatccctgttaaccatttttatagtctgtgaatatctggagttcacctatataagaaccttaaatatatgggtattttgtgggtaaatcagatgataaagatgttttcattaaactaacaatattagtcttacttatcaaagaattacacaaaaattgttctgtttttaggttggatttatagttgtatgaccttaaaatatatagagacacaaatataatcccatctgattagcaaaaccagacaaaagtggatgccaacaattctgaagacattttaatttttattttatcaacaaatttaaaactagcttatttgttaattatttacttaactaatgtgaactaaacagcatttgagttcattactatatagttaatatagcactcattaagccaatctgaatagaattacttaagtgatttatggccaactatgccaggttttaccatgtagacacaacatgtgtgaacacacaatgcacatacccacacacaaataaataccttatagctttccttttagaattttagtcatgaggaagtaaaacatagcaatagaaactgattagttgataagacagttggatccaaattatatttctgacaaaatggaacgtgttcccatggctaaattttatttgttccaatgggtaatctaatgaagagtgcggaccaaaattttgaataaaccagtttggtttttaaaaaatcttttaacttcccaccacccccttttttcagtttcaaatgagtttaaggttagatattcaaatatttgtgttttagctaggactggctgaattgcatcagaaaaacagtctcccagtgggtttgaatattttagtaacaacactatattttgtttgttgatctggtttgcctgactagtcagtgtgagcagggaagcattttagccggtttgggttttttttttgtttttttttttttttttttccttttctggtccctgcatgtcagacagagcaatttttatcccggacagagataccttatattactgctctgagctcaagattttgacctgtttgatatgaaagtctaagcagttgttagacaaacctgaatttacacttccaaaaggtgtctacattgttggttgccatgaagctgttgtgatttgtaaagccattaatttgaaagcccttccagacttaaaacaacaacaacaaaaaacttcaactggcatcccataagcagtgagtttacctcaacaccagcagaaaagtcagcagattcaaagtagaaagaaaaaaaaaaagaacttagaaggctctacctttaactgtatagttgattgcattttttaattcagttctaagaaaaaacaagcttggggagtttgaatgatccacattatgaccattgattttaaaatgtgcctgaggaaaagccttgtagctggcaggagtcctggagaacctggcatgccttaatgtttgagaatctcattctgtttcttattaatctcttgagagcaaagaaaatctgataatttctattagggagtttggaccagtgttttagatgatggtgactgccttagtagtttttcattggccatgtagcacccaccatttgtaatgtttattttttgctctcaagagatgttcagaaaaaagcaaaggaaaaatgagtcagatcattgacagacatgtaacaaaaccaaaacaaaaccaaaatcagagtgcccataaaaattttaactcaggtgtgaagatcaagcaaaatattaaactaggcatacagaacctgacaaaatgtaaattctgtggaacctagaatactcaaaccagaaggacattgttcgtataccagaaagggcttactccccaacaacaacaacaaaaatacttttatagtcccaagaaggatacaatgtactttatttatttatttttagagacagagtgttactctgtcacccaggctggactgcagtaacaggatcctagcccactgtagactcaaactcctaggctcaagtaatcctccagcctcagcctcaaaagcagctaggactataggcatggaccaccacacttagctaattaaaaaaatttttttgtggagacagagtctcactatgtttctcatgctgatcttgaactcctggcctcaagtgatcctcttgctttggcctcccaaagtgctggaattacatgcatcagccactgcacctggccccaaggttctttatttaaggtggcattataatcagatcggatcccaagttaagtcaataaggactcaccaaaggtccaatgtggtggctcatacctgtaatctcagcactttaggagaccagggcgggagaatcacttgagcccgggaatttgaggttgcagtgagttatgactgtgccgctgcacgccagcctgggtgacagagggagaccctgtctcaaacaacaacaacaacaacaacaaactcaccaaagggaaggagaccaagaatctgaaaggagactcagcagggcagaaaaggtgactcacagaaatggacattgcaaagggcttagctggtggtactgcactcaattctaggggctgcacatttgtctgaagtgagctcactttgatcccatttctgatatcattttcatcaatctaaatagcagagaggtggactctaaaagaaaatgtttatttggtattaggcattgcaatgggaatacatgtgccatagtaaaccatgtgcatattcatggaggtaaaggaaaataaaggtttttaaaggaaatgtaagagaattacataattgttttgagataactattcttggctacaaggatcagtaacaaaggtagcaccagtccaaggctgatgggaagttgctgggcagatgtccttgcagaaggattttgtgtatggcctttgtgcaaagttgtgttttttcagggtcttttatgatagctctttttattaggcatttgcacatgaaaaccctcccttcatgtcctcccctggctctatttgtcaggttcttaaacataagtgactccattttgatcctgaaaastttcacwatcttatgattcttttatttagcatcttctccccaccccattcccaagtacaatgcccagaaggaatcagtgtgagcatttaaaaatcgtgttaatgaataagtagaattgacatctaatttggttttgtagtcattatagtgcctagcccagtctgtcacatatacagcacacagttattggttaaactgatgttttaggttaaaagcagattatgtaccatgttagatatcacctacttacacataatatgagataattaaataccagtgatggttattagattatgtctagaaaatattaaagctaacaagacggcacagggtggaaaaaagccacacctactacagaggagggacagaggttgatggaaacatcagaaaattagggctcaaagttgggaaagtgtacttgataggaatgtgaccaaaaccarcttctcagtatgggtgccctttaattcagtttgctttagataattgcntataattaccctctaagactttatcaccacttcgagggagaaggggactcaaaggggggcctcttaaaggcaacagtatttacagatgttcctttgtgccctcttttatgttgaagtagcatgtcataaatactgtttttttgggagcaagtgccttcaataaggcttatccaagcagtggtccctcttccctcctcagtctaccatcattcttgtctttgaattttccttttaggccttttcatatctgggtaacaacagtgaatattcgttataggtctgctgcttcacctactccccctttccttttgagtaatttgatgatggtatagactcaaaaattcctttcaatcaaataaatagtaaaccagatggattaagatgtacctaatctggtacgggtgcattagtttatcactgtggccatttccaccttagtaaacacttctatatgttatgactgagtttgcagtcaacagtgttcatcattgtaattaagaagattctgtgatttctttgccaaatatgggactaagtgttcttgggggaataccactgcatataaaaagaattagctgtaggatattttacagtatcatgcacttccaattaagtaaacgtgataatctattgtgatcagagtagtgtaaaaatagtagatgtggcttgtttccatcctgtgccaccttgttagcgctaatattttctaggcataatctaataataataactggcatttattttgctgttattatgtgacaggcactgagctaagtgctttacatgcatgatttcacaaagaccctctgagagaggtactggtaatatctcccattttatagataaggaaactaaggcttaaccaacctaagaaacctatcaaacagccagtaagacaaccctgagattccagcccaagtaatctgactctggagccacagctggatctaaacactagttagtcttacctcccatcagccatttattggcccaaacggactggtttttgcccattaatattttactttagtaagtcaaaagttaatacaaagtatttgggaaaaatgtaagaaaatatgtggttttatttatgaatgagtactacagcgtgttattcaaagtgcatagggtaaagcttagctttgaaagttagaggaagcttgaattaaaaaaactgtaaatgtgctaatctgccagtcctagcagtaatggtagatgctgcttgatatggtttgtctgtgtccccgcccaaatctcgtattgaattgtagttcgcataattcccatgtgtcatgggagggacctggtgggaggtaattgaatcatgggggcgggtccttcccatgctgttctcatgatagtgaataagtctcacaagatctgacggtttgataaaagggagtttccctgcacaagctctcttgcctgccaccatgtaagacatccctttgctcttccttcatcttctgccatgaccgtgaggccttctcagccatgtgagctgagagtcaattaaacctctttcctttatatattacccagtcttgggtatgtctttattggcagtgtgagaacaaacgaatacactgctgcttctcttctttcaacccaaagagataataacagacaaactaaaggctgaacttctcatttgtgaagcaaatacaattctggccagaattatgggggtttctttaaaagaacttctgctgtatctcttagaaataaatgggacaatatgattgtattttttaatgtatccagttacctgcaggacaggaaatgtcttcatctgcctttttattacctgctttcttgccctcttattgccatgtgtcacttcttttaggaagcagcatggcctgagaatagtatacagactttaactggagagggcaaggttaaaaagccagctcccggccaggcacggtggctcaagcctgtaatcccagcactttgggaggccgaggcgtgcgcatcacgaggtcaggaggttgagaccatcctggctaacacggtgaaaccctgtctctactaaaaatacaaaaaaattagccgggcgtggtggtgggcgcctgtagtcccagctactcgggaggctgaggcaggagaatggtgtgaacctgggaggcagagcttgcagtgagccgagatcgtgccactgcactccagcctgggcgacagagcgagactccatttcaaaaaaaaaaaaaaaaaaaaaaaaaaaaaagctagctccctcactcactgtgtcaaccttgtttaacttctctgagcatcagtttctttctctgtaaaaaagtaggcgatacaataaagcctacctcgtaaagttcttgtgaagttcaaactaggcagcagatatcaagttcctatcaccacgcctgctggcctgcagtaggtgctaatgtcacatattctagttcccttcttgcccctctaccttctctgttgctccattgcaccgccatttgccatagttgggtttcgttatcaaaagcaattctctgctaatggacagagggcaaggagccctctttggctgcactgatattcttgaggaagaacagtatttgcttgcatactagtgctcttttcagagtgatttgggtataaaatctagtgagtatgagagtggattctttttgtgtgtatattcacttgttaagcctgttggcaggactctgcctatattcttccttcaggttctaggagactggggaccagggatgtgtttcttatgtttacatgagttttctttgagaattttccatgcattaattcaatcattaattcattggataaatacatgttgattgcttactatttacaggtactctgctaagtgctgggaataccacagtcaataaaacaaacccacatctgtgacctcatggaacttgtaactagtgaaattcagtttgatgatttaaaaataaatttaatgtaagcgtgttctggactctctgggtgaccacaaatgctgctgtgaggtttcagtgtctacagtgacatgtggctgttagtgcctggcatcaaatggctttcccttaatagtcagcagctcaaagggcacaggtgaatctaattataaatgatgccttacagccaagaccaaatgacaacrtaagctaacatttgtgacaataaaagctgcacgtagagtttgaatagaagagagtggctggagcattgagtcatcacacgatatgccatagactagggaggccactcttggaagaaccaggctatggtgtgaaaagctaatttcaacaatatgttgcatggcagattattggctttgtaggtttgttggtattatcagttataaatttatattgattttatagctgtataagagcttgaaacaaggtatttataatcttatgcataatttctttttagtttgctctggggaggcctgagataatttttttttttactgtaaaggaggttagtaccatcgttcaagtgcagaaacattgttccagagaaaaattctctacaggggtaaaattctatataaatatgagctgtttggcaaaaactagttatggctttgatttattgaaaatatttttaaagggcaggagaaaggttataactcttgtttttaccccccaaatcattctgttttatgttttgtagtcgtgagctattgtttttgtgtgagtcataaccgaattggcatgtttaagaatttctcattaattcttgtaaaagaatgaaattattccaacctcttccttccttgtcatgcctctccacttaccctcacgtgtgtgcatgtgtgcccatacccgtgtgcctctcctcttaccctcatgtgcgtacatgtgtgcccatgctcatatgcctctcctcttaccctcatgtgtgcatgtgtgcccacactcatgtgcctctccacttaccctcatgtgtgtgcccacacccatgtgcttctccgcttaccctcatgtgtgtgcatgtgtgcccacactcgtgtgcctctccacttaccctcatgtgcgtgcatgtgtgcccatgctcatatgcctctcctcttaccctcatgtgtgcatgtgtgcccgcactcatgtgcctctccacttaccctcatgtgtgtgcccacacccgtgtgcctctccacttaccctcatgtgtgtgcatgtgtgcccacactcgtgtgcctctcctgttaccctcatgtgtgcatgtgcccacactcatgtgcctctccacttaccctcatgtgtgtgcatgtgtgcccgcactcatttgcctctccacttactctcatatatgtgtgcccacactcatgtgcctctccacttaccctcaagtgtgtgcatgtgtgcccacactcatgtgcctctccacttaccctcatgtgtgtgcatgtgtgcccacactcatgtgcctctccacttaccctcatgtgtgtgcatgcgtgcccacacccgtgtgcctctccacttaccctcatatgcgtgcccacactcatgtgcctctccacttaccctcaagtgtgtgcatgcgtgcccacactcatgtgcacacccccccacaaacgctgtctaacaacttcttttgacctattatactcacacttactgatttgagacttgtcctcactatacactgctttgtacagcgtttccagatttgtttttaaaaagcttttagaattcaagcttacttgagcttacccggggaatattaaacaacaatcataagtgattctctttttgtaatagttagcattttctactatgtaatattgcagtatctgatctctcctctagactctagaatctggggcagactgaagaggccgttctctgttagagagggcatgatgttcgttcatagggtgaccgtccgtctattcccatttgtctggcactgtccaggtttatgtctgctctctcagcataattgttaatgatgcctgctttcactctcaagagtatttcatttggatgataaattataaggttattctagttacccaaaacactttggccttatggcctactagagccaaacaaagaagctgtttcacagattcactttaatcactaattctctttcttcatttacttttagctgtagacctatgtttgaatttataaaattgggaagtatttatgtataaagatatggcaatatccatgtactttttgtactatctctcttagggattatagcaagtttataacagaaaaagcagggattggtcactttggagcagtgattgtctgagcttcagcaaaaattttgaagtgtgagctgatcaggatatttcacatccaagaggtcaaagcctgcaaagcctgttacagtgagcttctaagatttacacacattctttcttccaaaaattcaaagcgaaattgcattatcctgttctgcctaaaataaaggtatcattgactggggctcagaagttttggttgtaacctgccattttggatgacggttttgcctttgtcagaaatttattattttggttttaaatctgaggtcttcagccagtgattgggctcagatggtggtttgtggcataaggcatgtgaatgcaagatgagaagacaccttttgattcttctggagctaactgtcccgtttgcccctggttccagccatgcatcacttgtctttttctctttagctatttagtttcatccttactaccctcccagaggaccaggagaaggaaagaaaggggaaaattccacatgttgatttgctgccaaaagtcttttgataagaaagatgattgactctgttttgcatattttcatggtcatgtgtgtgtatgtatttttttgtttgccagattaagcatattctttttcttgcatgtatttctatatttctaaatatgtaatgtttttcattttgtgaaatgtaggcagtcactagaataaaaactccactggggagactcatagcctattttgtttcccaatctctcccccagggcctaaagtggtgcctggtgccaagtaggtgctcaaaaataacaagaatgaagaatgctatagagacagaaagtagattagtttttgctggggtggaagatagaagaatgagagtgactgctaataggtctgtgatttcttttttcttcttcttcttctttttttttaatgagacagagtctctctccgtcacccaggctggaatgcagtggcgcgatcttggcaaactgcacgctccacctcccaggttcatgccattctcctgcctcagcctcccaagtagctgggactataggcggctgccaccatgcccagctaattgtttgtatttttagtagagacggggtttcaccatgttaggcaggatggtcttgatctcctgacctcatgatccgcccgcctcgtcctcccaaagtgctgggattacaggcttgagcaaccgcgccccgccaggtatgtgttttcttttggaggtgatgaagatgtgctggattgagttagtggtgatggttgcaaaaccatgtgatcatactaaaaaccactgaattatacattttaaaaggtttaatctgatggaatgttaattatatctcacttttttaaattgcaaaaagagaatacatgaaaaaagaagggattaataaattatatgccttatccattgtcatagttggtgcttaaaaaatatatcttttgaatgaatgaatggttgtttttctataccaaatcatctgagtaaatgtttctctcaaagcatggtctgtgtgtcactcattgtgtggcttggtagttatctggttaaaaatctttgagtttaggaagttgaggttgcccatggagcctgagcattgtttggtattagaaggggttggaatacaggggaaaatgtagtagactctcttcgggaaagtagttttgtttctgagtcagaaataaaagtaagttcctgtctattgagattgtttgattcaagcactgccaaaggagactgcaatgtgatgctttttgaacatttttttaaatatggaggagatacctctgtcacaggcagtctcggttccaatctttccaactctttcattctatgctcttgttaaatcagtttaaagtccctatgaatctgttactctgcagagagcaaactttgtcaaaacagattaatgccatctcttgaaacatttagctacactatgacaactaatctgcaaggatttgtcagaattcatgtaatttacccacttaatagttgccaacaagtagttttatggtccttcaagtcagcaaaggcaggttatggtggtgggaatggttttacatcctctttagcacaagttcatgtagacttctaaaaatatatcttcctatatttcaggcaattttcttgtattttctctcaaatgatagatatgaaattagtttgaaaagagtgtttactattacatgaatactaattaatattatctttattgtatctcaactatgttgagagaaataaaaaactgacctcctgatcaaaaagggagtttaaggctctttcggctttggaatagattaacttcttgtgtttgaaacttttcctggaaagtaattattctatcttgttcacaataaacaaatgatctcaatagcctgcatcttgtttgttattaaaatatgtgaatctgctgcacatactcttgtattatcaacttttctttttgtattctaaaattatactagggatacctgatagttatatagctataagctttattactactaccattaaacatttgtgaattttttattgtgtgttagcaagtatgttatgctgtttatttatattatctcatttaagcctcccaggtggaggatgagttaacatccctattttatttttatattttatttattttttattttattttatttatttatttatttatttatttattattwttttttgagacgaagtcttctctgttgcccaggcgggagtgcagtgacacatcttggctcactgcaacctccacctcccaggtccaaacgattctcctgcctcagccccccgagtagctgggattacaggtgtgtacctccacactcagctaatttttctatttttagtagagacagggtttcaccatgttggccaggctgatctcaaactcctgacctcaggtgatccacccacctccctcccaaagctgaggttacagatgtgagccaccacacccagccaacatccctattttaaaaacgaagagactcgcctaaagttacacatagctgataagtggttgagctagacttgggctgtcaccatggggctgctttctcataaagagcttctgcttacatcttttcaaactctcacaaaaaccataccactcccattttacagatgaggaagcaaaggttcggggtcacacagctactaagagacagaagctggacttgaagtaaggtcatctggtcctaaaccatggtgctgtttctgcagaatcgccatcaccatagtcagcggaaatygtttttggccacagcctatgctctccctgccttctttgcatttccttgaaggcagagagaggggagttaacaggagtcccaatttttatgggaggcacagttttgaaatagcctctcttcctggtcattaccagggaggcaacagattagaaagaagggagtatagcagctgctccccttagacaaaacagcaagttagtgtgggcagctttggtcatgtttctgggtgtgagatgagggctgtattcagatcagatatttgcagaaacgctaccgggcaaagtgaacctttgacttgttttgaatcagtcttgtaaaaacgcatgaagccccagaaagaaacttactttggcctcctgatcgtcctctcccttcgagcgaatgtgctggttcttaacatttggcagccatagactccttagagtagtggttctcacactttagtctgcatcggaatcctctagaagacttgggaaaacacagacctctggctgtgattcaggaggtctgcatagtgtctgagaattcacactttcaacacattcctgggtactgctggtgctactggtccaggggccacactttgagaaccactgtttcagagaattttggtgaaagttctataatccctacttcagtagatactaggttgatgaattactaatttttgaattatcaaactttggcaagcttgtttaaatgtgctggtgagtggtttggcattggagggagtatgtgagagtgttttaccgaacaatttgaaattggtttggtgagtcagttaggaacagcacctagaacattgtgggaactcctcagtcccattgaggacccagagggaacactgactattgtgaatgagtaataagaaatgcttaaaaccacttctagtatttgcaaagttgttaaaggcaatgactaaaacactttttcaaatattgacagttggaatgaaatgcagttctctaatatatgcaattaaaatttagactagtttttaaaattgcggtaaatatatgtaatataaaatttaccattttagccattattaagtgcacagctcacattgtcatgcagccatctgcactatcrgaccttagagctcttcatcttgtaaccttgagactccaaactcgttaaacaacttcccctttccctctcttcccagcccctggctaccaccaattctactttntgctctatgaatttgactactctagcttcctcatataggtggaatcatacaatatttgtccttttgtgactggcttagactaatttttgaagatactttgagacagttataaaatgcagtaaaaataccctaacaatgaatgaaatataaactaaaaaaagcacttgaaaacaaaatcaagttagaaagcttgatccttggactttcaagaatcttccttcatggcggactataacttgaaacccatttcctggtgtattccaggcccaaggctagtctggataccttttccatctccccacaggtggatcttgcttcctattcctacaagaaccttgtcctcttgtaggcccttaggcagagctggatcttgagcccccaaccttgtctatttattcattcagtagatacaggttctgttcaagatgcagggacctagaggagagccaccttccctctgcttcctatcaccaccacccccaccttaaagagtctactggggacccagaaggaccacacctgtcattacctgcccacctggagtgaggtgtgctgtgtcaagtagatttctcttttttttttttaatttttttactttttaattatactttaagttttagggtacatgtgcacattgtgcaggttagttacatatgtatacatgtgccatgctggtgcgctgcacccactaactcgtcacctagcattaggtatatctcccaatgctatccctcccccgtgcccccaccccaccacagtccccagagtgtgatattccccttcctgtgtccatgtgatctcattgttcaattcccacctatgagtgagaatttgcagtgtttggtttttgttcttgtgatagcttactgagaatggtgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggccaaatggtatttctagttctagatccctgaggaatcgccacactgacttccacaagggttgaactagtttacagtcccaccaacagtgtaaaagtgttcctatcttcgacaaacctgagaaaaacaagcaatgcggaaaggattccctatttaataaatggtgctgggaaaactggctagccatatgtagaaagctgaaactggatcccttccttacaacttatacaaaaatcaattcaagatggattaaagacttaaacgttagacctaaaaccataaaaaccctagaagaaaacctaggcattaccattcaagacataggcatgggcaaggacttcatgtctaaaacaccaaaagcaatggcagcaaaagccaaaattgacaaatgggatctaattaaactaaagagcttctgcacagcaaaagaaactaccatcagagtgaacaggcaacctacaaaatgggagacaattttcgcaacctacccatctgacaaagggctaatatccagaatctacaatgaactcaaacaaatttacaagaaaaaaacaaccccatcaaaaagtgggagaaggacatgaacagacacttctcaaaagaagacatttatgcagccaaaagacacgtgaaaacatgcttatcatcactggccatcagagaaatgcaaatcaaaaccacaatgagatactatctcacaccagttagaatggcaatcattaaaaagtcaggaaacaacaggtgctggagaggatgtggagaaataagtagatttctcagttgataaagcatgcaactttaaatgtcttttaaaacttttacccatgtcaatgggaatctttctgtaatgtattagtcccttcagcctcaagcagaatgtgccaaacataatttaacctttcctccataaccaaggtcagtgttgcactgtaaatattgatttgcacccccactaaatggctgggagctgctgcatgtaattcagtagccactaccatttcagctgtcacttttcaaggtgtcttcacatccacttctaatctgctagttttaggaagacctatgcagaaaatcagataatccaagccttcaaccagttgactgggctgaagatagactgcaacagaagatagatcgtgtcctttagtatctgccctctgcttctagatgtatagaattcccaatatttagttggatatgtggcaccagaatagggaagattgcctaagtactagtcaatgaaatgtaaacagaatgcaacatctgtggaggagagggggtgtcttcttaaaggatgatgtgcacccttctttctattaataacatgctcggaacatgggtgtgatggctgcagctccagcttggatgcaaggataagctgtctgctctcatatagctggcactattatgctagccataatctggatttttatataaaagagaaacaaacatatatcttgttcattcgccatgagcctgtgtcttggttacttgtagctaaatctcatcataatgaatacacagataaatcagatgaaaggatttagatgcctggaaagaataaaagttccatatcagtgggtaaaagaaaaatatcagcagaatcccaacatataaatagataaaaagtgccaggcacagtggctcacacctataatctcaggggtttgggagaccaaggcaggaggattacttgagcccaggagttcaatgccagcatgggcaacataccgagactgtctctacagaaaaatttaaaaattagcagggtgtggctctgcatgcctgtagtactagctacttgggaggctgaaatgggaagatcccttgagccaaagagttaaagattacagtgagctatgatcacaccactgcacaccagcctggatgacagaactagaccttgtctcccaaaaggggtgggggggatgcaaaaaaacaaaacaatcaatcaataaagaagttgctctgattgtgtgggggtgtctagagtctcactggttcagccttccctcccctctgaagcatcactgatcgtgaattgctgtagaacacagtttgaaaaccggtgtgcctgacctgaaggtctcttcagagcttagagcttagatactgaaagagctaccctcagactgcaattaggataattgttgagttccctcagggtgtttccttagacatcctgctactatcgtttactaccatcccaagagatccagggtntttagcctcactgtggatatagctagattgagcaacttcgaacatctgaaaaatcatstatgaacccacaaataaaaaatattctatccttgaatgcaaaaggaaacagttatcacgaagatcatacccttttctgcatgggagatgtggagccagattgacaataatggatataaaatgggctatgagttagagatccgctagaatatttcttgaagtgtgacatagtccgaagccatggagagcagggggcaccagacaatctcagaggtgtgtgccattctattaactacaattccattaataagcaggaaggcacacattgggaactaggtggattttcttcagtatgcttttgatgttgcccctaagcacagattcccatggaaactaaactagaagataagtcaaaggagattgaaaatattaaatatcaggtatttctttgacttattgactgcttggtgtttagcattaggcttcagacagcaatattacagatattacccaggcactcgggcagctttcatataaagtttatttgagcctcactttttcatctccttgttgccagtatcatcaccttgaaagtgaactgtaacaatacatgtatgtagaacctgtattttgtttttaataatatttataatagtttatatgaattgatggtttactttgtgccaatctttgtattaagtacttcataccacatttctcatttaattcataccactacattgtagttgttaatatctcatttgacagatgagaaaatttatgtccagagagctttggtaacttgcctaacactagtaacagtaacaagaggattctgacctcttgtcagactccaaaacattattcttaaccaccacttcttcaccagaaagtgttgtatgattggcttgggtaatgtctactcatcagaaaagaactacaaatgttggatggaaagtagttcagaactctttgggcagtcaatcacgtgtgccttttttgttagggttttgttcatattctcaccaagaatcctcaatcaggttatttctatatattattataatccccaatcataatcatataatcatgttgtacccaagaatattatattcaccacaacctcccttcctctataatgtcatccaaatcttatgtcatccttcctttccctcactccctgattctcttcacattccttagtttacctttcttctgatcacctgtttcatgggaaatagtaacctggatagataagaagtcctgtttgtccaagagctggtttgacatgttggctcaccagaggagactggggcccaagaacttgattaaacaacctggttccttgtcactcaagtgagctgtgcagaacagcagcatcagcgacacttggcagactcttggrccccatccaaacctactgcatcataatctgcattttaaagacaccccctacccccgtgattttaggcacattgaagtttgagcagcatggctcttgtctgttgctgcagccatgatatgacatagatggtcccagagcctgtttacaaggggaaaagttggacagaaccagcaggaagacccagagcctgtggcccaactcagcgatatgataagtcaagaggaggaaagagccaagacttgttcccagcataaataaagaagacctacggaatctaacgccagaagatccaacgcctctgctgttatgcaaatgtaataaaaatgcattcagtccaacttggaatctatagaaagttaagtaaaagttgagtaatcaaggtcacaaaagtcatttaagggcagtcatttaagagagcttcactgaacaaatttcacaaataacaaatctttcagggatgaaaaacgctaataaaaggtttcctttttgaaaagtgattttgtgtatttgcttaattttattttaatcctggacctcttatctactttgattttcattggcatcaatgggaatgtgaaagaattgacctcatttgaaacttcctttcagcaaatggtcaaagctttgttttctgcttcattgttttctaaactggtgcataaaaataatacttgtgcttcaggcatgtgctggcaactttagcctcctgtaatttcctgagccacatattacatctgttttctgcttacagatgaacctcagctctcactccctcagggtcttcttcatgttcttttagccccttgttgacggttgtttggtaattcttacggttataattctttgaatatcttttcagttatgattggaggaggtctaagcaagtgaaatatgacacattgcctttttcctgtcaaancaaccccgtatcatatatgcatgatagtgtggttgctgctttaaaaaccaattctagaaggaaaaatgtcatgtttcctagagattataaataactagacacagataagcacaagtgtatttatatcagcctccaaatattctgataagaagaaagaaatacagtctgttgtttgactttcaaagggcaaattttaaaaatgtaacagaaatgcaacttttgactttgtattttaaatgcattatcttcggaagatatgatagaatgaggtatagacactgtaaagccacttctaacagtgataattactctgcagtatttgaatgactagcaagtttcttatatggcattttataatactgttttgttgcagaagcctttatcattttacgtcatttaatttggtaaaatgatataacattcctatgtatacagaaaacctcagttcctattaatgtattgagtcttgtttatagttcagttttcaggttcaggacaattttattcctaatgatatgaagaaaagctcacataagaaactacttctttttttgtttgtttgttttaataaagaaaagaggtttagttgactcagagttccgcatggctggggaagcctcaggaaacttacaatcacggtggaaggggaagcaagcatgtcttacatggtagcagacaagagaagagtgagcacgtgagagcataggaaagactgtcatttataaaaccatcagatctcatcagaaaccactatttatttctttatttatttttaaagagatagggtcttgctctgttgcccagactggaatgtagtggcgtgatcatagctcactttaactttgaactcctggctcaagggatccacccgtctcagcctcccaagttgctaggaatacaggtgctcaacacgacaacctgctgatttttaaatgttttgtagcgacagcgcctcactatgttacccaggctggcttcaaactcctggccttcagcaagcctcctgccttgggctcccaaagcactgggatcacaagcagagccactgcttctgtctggtccagaaagcacttcctttggtacagaaaccatgagctttgtgatccataagaatgaagacatcgtaaaatattatgactataagatatggagggacttcaatttcctgttcagcattctaatgagggtaatttaggtaaatgactttctaattattgaaaatgatgaatgtatctgtagaaaaaatcacttttattatacaagcaagaaaacataataacccagttaaatggatttcagcaatgataagtaaggagaggaccaatctttgtgagtaaaagcacccatcctatcaaagtcagcttaggaaacgagcatgtcttgaagacctggtttgttgatgttggatagatatatttaggggagaaaacagactttttttccccttttttaaagttcttagctgagwcacttttctgaaaacaaaaatcagattaacaaaagaaaagcatgcaaaagtttattaacatgcactgtacctatcacatgggaaaggcctcggttcaaaagcatttctctctcaaggcagtggcttaggggccttgctttaaaagtattttaacggatctgtaaatcctacatagtgacaagacaaaagagagaacagttgcggtgttttaaaaggcgggaaaatgagggaagatgctaaaatctgttcccagattcctctggtgccagcttggtgcctcctctgggccgagaagtgccatctccaggaaggaaggattcgtgccctgccatcaggtggttacaggctgaggcagagtgttaccctgcattttcaatgtctttaacttaacaactgtctttgaagggaattttggttcccttcatattgttgacaagcttctatgttgagcattcagaagaagtggcagacatggttcttggctttcagatgtgtacttaatcgaagagactggatatcttatacattaagacatttaggaatatttgtcaaccatctgtatttgaaagtataaactactattccactggaagagctctgtattgattgtggattcaggaatccacaggggaaggctagattcagaaaagacagagaactaaagagaaggggaaaagaggcacctggagagagggggaaatgcagttaactggacatcatcaggacctcacatcggaagttctgccttgaaagcatttggaaaaatggggcctcataggcagtgcctctctcctccctcggctgccttgcctctgcttcaggagggaagcatcacatgcagtttttcacctcctcccacagtttgggaccatggtacgggggacctcttggagtcatggcaacagtgggaaaggattttcttcacgggtctattcagatttgcacttggcagaaaactttcagcagaaagccattagctttctcttaggactttggttttcaagttgagtttggaaccagaactgaagattaaaacatgcagaatattctctatgccatttagctgtctgcagaaacccactgttgctgggtacccagccatgtcccctgcccacccccaccctggcgaasstgggagtgagaagccaggggaagcacagtgtatgcacatggccagaaaaagactgacacaattcgtgggcattagagcacggttctctttctggaaattgagggtgattatttctccttcattgtgtgcagcatccttttgagatcgtttggggagggattttgtcagattggagaattgtgattaatggtgaaggccttcgagagccagcccatgtgaatgcattattctcagctgctttcccatctgcacacacagattgctcagtgccagtgctgtgaggcctccagagctgagctggtccagcctcattattttggctgatgaacaaatagacccagggagggtaaggagcttaccctgcagcacataaggagccggcccaaagccaggactagaaccaaagtctcccatgtccacaggatactgtttcctcgcctaacacaatgccactctgttcaccattcaattcaacagctatttatttgaacctcgctggatctgccaggaactgggctaagccctggggtttctaaaataggtaaagcatgttcccaccccaagaggaactcatagtctaggagggagggagaaacattgatagtacatcttgttatttttaaaaaaygaagagaggaatgagcacagggatagaaactcagaggaagagcatgtggaccatcccaggagtgctgaagcaggtgtcattggagctgaggcttaaaggactggcaagggtgagttttgggaaggagggtgaaaagagcagctcagaggaggagcggcatgagccccacctgctgtgcttccactaccaaaccaagtcctcatgctcctccatagagaagcaggaggggcttcacctttaattcagtaccatcatttctcttaaaattgcaggtagaatatacagtgagtattttggatttttctttttctatttcatcaagtagaagatggacctaaaatgtttggccagagagaaatagaaaagccaatcccagtttaaattgtttgaatctgattcaatcaggatctcagatcttccggttcacgatttcagcttgttttgaaagctanctgaattgaggagggggcagggcacagaatgagttttggctttaatacactaaagactaccccaataacctgaaagacccagtagaaaaccatgggctaaatgagatactgaatgaaagctgggtactgagacccccacccttccttgtttctggtgatttcatgctccaaatcttgtcatgatacactgcacacatccctctgtatagtgctttaagtggttgtgagagaggaaggggagcccatgggtcagaaaccccttgttacatggaaagagcagagaaagaagaattagagtggatgccttctctgtctgggcctagcatcacgtcatttggtcttttcccatgagcaatggaatcaagcaacagtgattgattatcttctaagtacaaagcattttgctaagtgctttgaggatatcaagaatgagacacaccgggagcagtggctcatgcctatagtcccagcactttgggaggccaaggcaggtggatcgcttgagcccaggagtttgagaccagcctgggcaacatggtaaaaccccatctttaaaaaaaattacaaaaattagctgggcatggtggtgtgtgcctgtagttccagctactcaggaggctgaggtggaaggatggcttgattctgggaggcagaggttgcagtgagctgagattgtgccactgcattccaacctaggcaacagagccagaccctgtctcgaaaacaaacaaaaaagcatgagaagatactattcttcccctcaagccccttatagagagcaaggtctcatgctatataaggtagaactgtactgcttatttacttagtagccttgttaatgttggcaaggaagtatgagcttcaatttcatctgtaaattggaggcactagttacagggatgtggtgagattaaatgagataatctatgtaaagctcctagcataatgcctgccatatgatacgtactcagttaatattagttgccataatcgtgatcatcattgtggtgcagaggaactaagctctgacttgtaagctctgatgtctatgttgacatctccacatggatctttaacaagcagatcaaacttaacatgtccaaaaaatggaagtgctgattattttcctctccaaactgttttttttttctcatcttcacaactgattaaatggcatcaccatgttattgctaaaaccaaagacttgggggacatcattgatttcctccctttttcttttccttgatttccaaccaacaaacaagttttgtctttgctgcttcttaaaaaaaaaaatcatgaacttgcctatttctctcccatctctgctgctaccactctggtccaaggcaccattgtctgttgcgtttcatttgtagctctttaattctcccactgtcaataagctttttaatgacattgcccccttttctgtttctccaatatgccaacccctttcttacctgagggcctttgcactagatatttcatctaatgggaacgttctttctttctccccagtagcttcattatttgcttgcctttgcatatcaggtatctgttcaaatgtcattcccacaaagaggtcttccctgacactgcttctttcacctacctcacccaccacccagtttctttctttttctttctttttttttttttttttttgagacagagtcttgttctgtcacccaggctgcagtacgatggcacaatctcaattcactgcaacctccacctcccgggttcaaacgattctcctgcctcagcctcctgagtagctgagattacaggcacccaacaccatgcccagctaactttttgtatttttggtagagacggggtttcactatgtttgtcaaactggtcgcaaacttctgacctcaaatgatccggctacctcagcctcccaaagtgctgggattacaggcttgagccaccacyccgggccaatatcacagtacattcttttattttttctggaacatctccatggctgctaccaaaggtgggtcgtggggaagtactggagaatcttattggatgttttttggagagggcttggaagtggtttacatcacttctactcataattcttagacagacttcagtctcatataccgaacctacttgcaagggatgccgagaaatgtcattttctcatgtgctcaggaagatgaaacagtgtggcaaacacatctttgacttccacagctcatgtaactgaaagtccaagtgtgtggcttacagatacaccaatgacaccaatctccagtttttctctctccaactctggattctctttcagtttggccacattctcagataggctgtcctcttgcttacagtggcaaataaacaatgaggctctttcctggaagccccagtggaagtcttctagactctggggcacctgcccatcacagaaccaattactgtgatgaaaggaatgtgacccattgattaccttggaccactattgtgttctccatcactgaatttggaggatggggaggcaattgaaccatagtgagttgagactgggaatggatgaagctttaaaaagctcttgtgggaagtaggatgaatggatgccagtggcaaaaaaaggacaaaaatgttcactacaacagcatataagatttatcaaccaacaatatacaattctaaacactctgatcaatggaccatattttcttcttgaattacctttagtgacaatggtctctaccagaagcacatacagccaaactattttttaaagtatatggaactcttggttctttgcttcatcatactttaggctgaatttttttgttgactaaggagagagctaagtggcttcattctagtaaaaartacttatttggggttgttagttgtaatgggcagccaggtcttcccttatatttcccrcctctacagagttcttagaaaatgcagatatagytcattttttaggcaacaaggagaggatgatctggaagcagcattgggaattaaggaagacaccaactgttcctcctagtccaggaaaacaagggctgtgtaaagaaaccaccaccatttgagacctttacaagggaagcagtgtcctcatgagagcaccaaactgtggctagagaaagaaaatgaagaatgttccacaaagaggttggctttaaaaatcccctgcccaaaagccaggttatcatgatttcagctcaggtatgggctgaatcaaggaaaacctcagaggtcagtcaactggaggccagccgttgttgagttatggtcactcaacaaatatatgtgttgagaccgtgatgtgctagccctcaggttcagcatcaaatacatatcaaaaaaatagaaactctgataataagagatgtayaaacaatcacagcataatatagggagatctgattctgagctgcttgtatacagtaaggggcaaggagatgccaatagtcaatctggacacaacattcagcaygtagagttagttgctgtaaaggccaagccctagaagcatactgatctgtttttatagtggttattatgtatggatgggtgttgagtgatggctctagctgcttgccccagcagaaatcctgttgagcagctgcagtaagggttcaggagttctatgacagcagagtaaaatccatgggccagacaattggtcattgcaacaggttccatcatgaagtgacgaggcaaacatattcataggtgggcagtctagaataaggctcaacttaaaaatgccaggacaggttgccagcaggtcgcagagcccaccccagggccatatgagaggctggatttgggttttggggatgagataagcaggagaaaggcagatggtcccaagtcctaggagtacaggaatgctcagcaggtgagcagatgggctttggtacagggaataaatagaaattccatcaccagaaatgagtcactgcttaggatataagtcttatgaacagggagagagtccacttttcataccgtgagtacagatcagaaacagtcaaggggatctggacactgggcccygtatgttagaccagagctccagaaatcccaccagcagcaggtcaggactgaattgtggggacctgggtggcctgagcctacagctggagtcagatggtacccctgggccaagggagagatgcagaagctgggactcaaagccacagctttgtctggcccatgaggcatcccccttctctccagggcacattgggctaggccagcctttggccctggcaagaatgaaggaagcgggcacacacccctttccttgagcctcagtctcttcttatcatctcttctgttgtcatttagaggatcctggcagaggttttgggtcagtagctaagttgactcaccttacagattattgtggttcagcaacttttttagtctttaagtctttctcctctgcttttagtattttaaggagcagataatttttcaaatgcaaatttcctaattagatatagcattctcactacctgacatattatgtatttatttgtttgctgtttatatcacctaaaaggattgtcagctccccaagggcagggcctttgttttgttcactactgggttcccagtgccaagaacagtgtctgtcacataatagatgctcagcatgtttgttgagtgaacaaatgtgaataaatgaataagcaagtcaacattccattcttgtgggcttggctggctctaatctgtccacagacacattatacccaaatgagataattcatgggtttgtgctaagtaatcagaagttttctctggatatggtaggcaaattatgactaattcatcctggacataatgaaatgatcattcctttgttttgttagttactctaagagtaatttggatttttatgtcattcaaactttgacccttctcattttcctacaagaatataagctttgcttgtttgtatttataatcagtgggatggatttcacttcattgaaagggcattatttccccttttaaaatggacctatgttaaagtttgctataatttactgaatgcttactctgtacttggcactgttctaagtgtatcagctcatctttgtaatagttgtacgtggcatgattcttcttcccattttgcctgtggagaagttggagcacagagaggttaagtaacttgcctaaggtcatactgctaataagtaaaggatctgggagcatccttagccatcagactacacagcctataatggtacattagtaaacatcacttatgtcttcatttattgagtgaatagaggatagatatgttgactgcttcataggcttaatgtgaggataaaatgagttaatacagccaaaacacttaaaacattgaacaaatgttaacctttttcatccactaccaccctctaggaactcacagtcttatagaggagacagtatgataaatatacttttacacacacacacacacggagatgtacacatatggatggaaacatacatatctatctcattatatttttatttgggattaatcaatattttctttcactggcagaagttgggagagaaaagctggagccagggacatgaagtttattttgaaacacacaagaagggagtgtggctcacagctggagagattactaatcttagccattcctcagttgcctgatagaaaagcatttacacatagaaaacggctggcntttattctgcactcactatgtgctggacactgtgctaagcactttacatggattacgcccttgaatcctcatctcwtgccttcacattaggtaccattatccacattcaagagatgaagagatagaagcctgggaggctaagtacttgcctggggttccccagctggctcgtgcatgctacaaagccagagcttttaatgattccgcagtatcacaagatccctaattggggcagaggaggtcagccatgaaaactgctgctatctaaggcttctcatgaaatgcagggcatggttagggtagaaactctggtaatttttaaaattgtataattagaaatctcttttaagatgatttttaacattttaaatcccattcatttgctggataattttcttgagttagctctaataacatcattttagtataatcatttgagatacaggagcttaagatagaattcttaagaacagtgtctgattgctgacaggtaattttgtggttcagtactagatttaagataagtcccagttgtcacagctatgaacactcaggatttctgtacagggttgtggtgttgaacccctattaacctcaatagggaaggcactaggttcaaggggctgaagaagagaccgagagccagcaaaggagacctggggtttttttaggggctcacatagagcggacagagtccagtggtggtgggctggactagataaccaacagtggtggtggactgggtgggaaagccacaactgcttgcaagcagcatgcagtctatntagcatttccacttaataccttccccctaatgacctccacctggcaattcatttaatccaaatcacaggggtcaatcgcctgtactgcgcctgttccacaggacagcctgggggctcagatgttcctcatagacaaagaacagatctctgggttggccataccagattccttagctcagaacacacattcagatacagcttccatacaggatcattctaagggtatgctcaagtgattgctgacaagtgcatttaccctacaaagctggttgtatttttcttcattcatttgtttcattcattcatccactcactcaacaaatacatagtgagtctacacaggatttgttctatgtgaacatgacagcttccagcttgatggatctcctctcactttcatagcggaaggaactgggcaaacaagctcaggcaggaaatgagcaagtaatggggaagaataagtccccattagaaggaggagccaccaggagtgggtggggctggtgaagtgggaccaaaatgggaacagcctgaatgggaagataaagccagtagggtagaagcagagaggatgccaaaggagcaagcaggacaaatcagtggtatttcccccattttgacagagtcagaagcaggtaccaggctagaagaaactggggaggtggaatggsaagtaatattgagccagaggaaagagtagcagacaacttgcctaaaatctgcaagaatacccagtttgcacattcctttgtctgtggtttggtttgataggctgttgcatcactatctcattatctaattgtccagggtggagaaagcgacccgtcccgcagtagaagcaggtaggaaagtgtgagatttcacttctttgtttggactcctggagtgcctaaaaggggaacttacttatgagcgagcctcccactgtttgtttatcttactttgtatctgatcatttaaatcagaaaacaaattatgactcactttgatgtgttaagtgctcggttagatgcccaaagccacttagaataggtgtatctattgactgaaaatgtagcttctcttttcagaagagaagtaaataattgtaaattgtgtaaataaatttgtgtaaataacttggtaatcactaaaaaaggtcttcagaccttttggaagaatcaacacagcaacacacagtttagctgcctgtgaaaagctattgcagtcccatgaggacacttaacacattggccttggatctgggactctatcaacccactagaccatactgggctgtggtcactcttttacagagtgccttcagcctccacagtgtgccctcacaaaatgtctcagagggaagccaggcccttgtccttatcctcaaattaccctcaaagagactaaaactcagctcagcagctgaggtgacttgaccggggycacatagctgggaggtaactgaggtgggatttgaattcagatctgctcttcctcagtgcaatagtccttcccccatgccccgcttattccctagggcattgtcagtggggaatattcttcctgaagactccttccttcactcattagttatttagtgcctactgtgtgccgatactgttctaggctagtcatgtctctgccttcttatcctgaaaccaaagttcaaaagacaaaatatgagagtacttgaagtgtgaatgattcacgtagtcaactctctgcccccgcaaacacacctgaaggcagtatatttccctcacaaaataatttatccccttgtactatgtgacttttccaaaggaggcagaacttcttttttttctaccttcagagaaatgtagtgagctaatatttctgaatacactaaggtaaatgtcaaggatgttttatcagtgaatctcaggggctgctcttacttttcacttgcaacagaaataatagtagtggccatgcaaacatataatcccaaggtgaagaaattgcagggcagggtgaggggaaaatgcattttgacacccttgctttgactgataccatttaagtggcctatattgagcctgaatttgatttaggtcagatgtaccagtaaattacaatgccagaaaagggtgtctggagatgacgccgtttgtggggtgtatccatggtatctctgattggggccatctttgatctgtgtcccctgctgctcaggaaatgactggctataaatgatataagatatcagaggctcacagaggcatggcaaagatggatccaggtcagaatacccatcaggggccttcaaaagcaattcagctattcagtttagggatagctctttagctcctaatgggtcttcattttagctgcttgagaacaaccctgtcaagctgccaaggtgacatggagagggatatgcgaagtttatgtagtggggagctgaaggtactttatatagccacaggattctgtaggctcaatcagtatgtgtcatgtggaacaccgttcagtggagtgaaaagcatttcacgcttttggtttttcaaaggaagcctgtcagcaagtttcctacagcaaaaaataactgtgctgtggttgaacttcactaagagtcctagccaatcagataatgtcataccaccatgaggagatatttagggctttgccagaataatagggtactaatcactgctaataggatttgttgacacgggccaggagggttggtcatgaccattggaatattgatttttacccttcaggcaaagtccatcttcctttctcagtgtctgtcctctgtcctgagttcaggcagggtgaggaaaagctggtgcagtgaagctctgctcaatatgaaggttgctagggcttgatctgaagtaaaggaattaatatttaaatacccactcagtgttaaccctgaaaccacccatcctctgtgcccttggcagacactgctcatggacaacagcactcacccattaagcccagattcaggctccgaatcctcgatagaaggcttctggcagctgcaaccaatcaataacgtttggcaagcaaaacagcaccagtgggccatccaggtatttaaaatgatttcctcaaggacacagaccacagcttcccatctcctcacatgttcttggctgtctttgctgcccagtaaacatctgttgttaaattagaacttgcattttgagaactgtatccacagccagatgtagctacattttttttaaggaagtaggaaaatatccatatggggctacagataaccgcatctctgggtcaaaggctgactgatacagttaggtgtgtgcacagctataaaaaccactcctgtggctaagtgacttttgacaaatgggataaaatgagcaagaatcaaattagatctatttccaaattggcttttctcttttctgtcctctccttcctcttccttgacccacttgttttcctctttccatcttatttcaattataacatatttacaggaatccggcaacatgcattattgtgacctaccactttgtgagcaccaagacggttttggtgagatgcttaagaacattggcttaaaatccagactgcctgggtttgattccccagccccttccattactagctgtgtgaccttggccaaattacataatttcttataacctcaaagtcctcagcaataaaatggggctggtaacagcatcattttactktcacatagatgaatataaaatgtagctcctgccttcattgtaaatgaggaattggactggttaaaaaatgaaacagaaaaatacagacattcctcctatagttaaagtccgcataaagcaaatgaatatatgagagccaataccttgaggaacatgtcctttatgtagcctctgttgacaatgaccccatcttgctcggggattagcaacattcttagggggaaaagaaaagtgctgctcccggtgcaggccaggggcattcctcatgtggctgtgcacattgtgaccacagtggggctgcagtatgtagagtatagggtgctgatgctggctccatgcaggagagttaaaggttggggagacccttcatattgagtcacatgttaacaagcagaggtgcctcagtgaggtatgggttttttgttttaagctgtactcacttatcttaaaaaaaaaactcgttgaaatttctgtaggaaatagaacttggttgttgctggaactgcattcactaaccctcttttactcagtaaaagaatggcttcctgtagtgcagtttttgacaacccaaggtttcttatccatctgttcaacaacagttcagtgcctaatatatgctaacatggtgctgggtacaatggtgtccacaaaggcagagtcactgtccctacaatttgtgaagttgtgataaaattgcaattgttaaaatgcagacatactattgttgcagacagattttgtgtgctaagctagactgttaagactagaaggagaacagcagagatggcaccagttggtggccaggggagggggctccccactcctgtaaaatctgccacatcttccctggccacccttctacataatgacattcccaaagatagatcatttatttctcaatctttgtaaagtatgaataaaattgttttgagaaaccgtgattttttaatttaaagtctgtaaaacattgtttttaagtggcaaccagattgccacctcaaagccccttttatccagaaattcagggtggtatttagagaggagaaatgagtgaaggtgagaagacccagagaacccccagcagaggatgttctgcaagttgagcctcaaaagatgattgaaatcttgaccctagatgccctggccttcccatacctatcagcgcatgctcacaaagaaaaccaccatgtggccagctgtgctgtggcttggagaggcagggtctgtggggacatagaagcagctttagcagttggatccgtgctccagtgtaaagggctggcttcccagtgagcacagaaaaggcctggagtctgcttctcatgctgtgttgggctttgccaagggctcccttgccactacagctgggatgtcctaatttggcttggttgatttaacttctcactttagaggaagaaagtaagatcgatgttttctaatttgcctctaggctccttttacacttaccttcaacacagccaatcnagggtccttcattttaggtgagctgagaggtacagaagaaagtgtttgcagggtcccttgggatgataggctttctccagttgggccagtgctggtgattgcctgggttgctgccacactgggagcattgtggtggtgaagtccagacaggtgaattccagctgtgctaccttagataagtcccttcacctctctgggccttgtttttatcatctaaaatatgaagctcttaaaaaaaggttttctcagactggttagccagatgattttaagtggctaaaggatgagcattctttatatactaatatatgtatttatttttcattgtcatattccatttatatgaagtgataccagatttttatagtgatgattgcatttcttttgaagtaattttatttgagtaacatttccctcctgtggtttcttcactcacagctgacccaccacaactctttacttgccttgttcagatggtcctaaattgtaaaccctccagtctcctttccaaagctttctctcttggccatctattcaatggtggtcttgagggaaactgttccccttgtgtgctggtgtactggagtgggtcgccaatggaaaatcagaaaaccacctgggtttcccataatgtggggctggtccagtccagagcttcctagttttccctcagtctcatgtcaccatcacagctgttgccatgtctatgcaccctgtctactcatgatgactcaatattttcttcacatagaccnagttgattatttactcaataaaattattcacaaattacagctagatagggaagagtaaattctagtcttctataccattgtaggatgaccatagttaacaataatatatagtttccaatagctagaaggaggatattctgttttcccaacacaaagaaatgataaatgtttgagatgatggatatgctaattaccctgatctgatcactatactttatacatatcaaaacatcaccatgtaccccatagatatgtgcaactattgtcaatttttagaaagtgaaatcaaaaaataaaaattaaaagatttttatcatccctccaaaaataaaaaaatttgaaaattatttttaataattaaacaatattttatattttatagtaaattttatcacacaaataatgcataatttttttattatactttaagttttagggtacatgtgcacaacgtgcaggtttgttacatatgtatacatgtgccatgttggtgtgctgcacccattaacttatcatttaacattaggtatatctcctaatgctatccctccccgctccccctaccccacaacaggccccggtgtgtgatgttccccttcctgtgtccatgtgttctcattgttcaattcctacctatgagtgagaacatgaggtgtttggttttttgtccttgcgatagtttgctgagaatgatggtttccagcttcatccatgtccctacaaaagacatgaactcatcctttattatggctgcatagtattccatggtgtatatgtgccacattttcttaatccagtctgtcattgttggacatttgggttggttccaagtctttgctattgtgaatagtgccgcaataaacataagtgtgcatgtgtctttatagcagcatgttttgtaatcctttagtatatacccagtaatgggatggctgggtcaaatggtatttctagttctagatcctgaggaatcgccacactgacttccacaatggttgaactagtttacagtcccaccaacagtgtaaaagtgttcctatttctccacatcctctccagcacctattgtttcctgacattttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatccttcacccactttttgttgggattgtttgtttttttcttgtaaatttgtttgagttcattgtagattctggatattagccctttgtcagatgagtagcttgcaaaaattttctcttattctgtaggttgcctgttcactctgatggtaatttcttttgctgtgtagaagctctttagtttaattagatcccatttgtcaattttggcttttgttgccattgcctttggtgttttagacatgaagtccttgcccatgcttatgtcctgaatggtattgcctaggttttcctctagggtttttatggttttaggtctaagatttaagtctttaattcatcttgaattgatttttgtataaggtgtaaggaagggatccagtttcagctttctacatatggctagccanttttcccagcaccatttattaaatagggaattctttccctatttcttgtttttgtcaggtttgtcaaagatcagatagttgtagatatgcngcattatttctgaggactctgttctgttccattggtctatatctctgttttggtaccagtaccatgctgttttggttactgtagccttgtagtatagtttgaagtcaggtagcgtgacgcctccagctttgttctgttggcttaggattgacttggcaatgcaggctcttttttggttccatatgaactttaaagtagttttttccaattctgtgaagaaagtcattggtagcttgatggggatggcattgaatctataaattaccttgggcagtatggccattttcacgatattgataatattttatgcttaaataataatagtaataattgggccgggtgcagtggctcacacctgtaatcccagtactttgggaggctgaggccagtggattgcttgagcccaggagtttgcaaccagcctgggcaacatgttgaaaccctattgctacaaaaaaatacaaaaattagccaggagaggtggtgcacacctgtagtctgagctacttgggaggctgaggtgggaggatcacttgagcccaggaggttgaggggctgcaatgagctgagattgcaccactgcactccagcctaggcgacagaatgaaaccctgtcacaataataataattgtgtaaagttctatacactggacactcagagtaatgaatagaccgtgggcatttcatagtctccctgtgctgctctaccctgacttggcttccctcctgtctccagaggtgaccactatccataatattgcaaatagtctttttggcttattatttatcacgaagcagtatttttgcttgttttgctgctttttcactttctatgaaagaaaataaatggatccatgtttcaaaaaactacttgtaaagtttttgtgaatgctttttatattacctaaaataagagcaaaaccagcacaccaactacaaaaaattaggaggacccttatgctgtttaaacatttgttccctagaaacctcacaggatctctttctccagagttccaaaaagagatcagtacattcatttgctttatggggcaggctatgcatatatagagaggattttttttaatgtgaatttattaatccaagtctattctgctgaccaaaattttcagcctggagtgaagcaagtaaagttgtttgcgaagaaaggtccacagaaggaggggaaactggttggagaagcaatcactgcattagagataggacaaaatgaggctctgtcgtaatagttcacaaacttgggcatgctcagaactattctgggaactttttcaaaatacagatccctgtgcctgctcgtcagggcggtatggacccaggtgattcctatgcaaggccagggggatgcaccatgttttgaagttcaccatcttcatgtaaaagtttcctgtctgtcttaaatatatctaggggacttgttttattaattagacatttatctgaagatacataaatatgtatataagtacacacacatatacaaacataaataaattactatttttgtaggacaaaaatgtttgtgtatcaccaatttcgtattacctaataaggcaaagtttcaaagaaggtgtcataactggggttaaaggagaggaaatatcactgaacaggaatgtaatgatatcaaagtgctgtttctaagtcatcatgctgagtttcaggaactcccatttcacagccagctgtctggcctctgcaggcagaatgccaaggaaatggagctgagtcttccttttccacaggaccccagcagaggcccctccaagagtaatatgtgtgcatcaccagggacccaggcgctgcagcttggaaattgtcagaaactgctgaagctcttcgcaagaataccgttttgcaggggaagacatgaatactagctatttagtgggttcatttagagtaccgcagcagtaaatacaaaagactgggactagaatctaaagatatcacaccctacactttggcaatgtaaaatcaaaatcttaagatgttcaaagtcaacaattttgtgaattgtattctgtaaatacaacaatgctgtaaattgtattttattttactatttttgagacaggatcatattctgtcacccaggctggagtgttgtagcacaatcatggctcattgcagccttgaactcctgggctcaggtgatcctcctgcctcagtctcccaagtacctgggaccacaggtgcctgccaccacacccagctaatttttaaattagcttgttgcccaggctggtctcaaactcttgggcttaagcaatcctcccaccttggcctcccaaagtgctggggttacaagcaggagccactgygcccagccaaattgtattcttcttcttcttctttatttatttattttttttgagatggtcttgctctgtcgcgaggctggagtgcagtggtgcgatctcagctcattgcaacctctacctcctgggttcaagcgattcccctgcatcagcctcctgagcagctgggagtacaggtgcacaccaccacacccagctaattttttgtattcttaaaaaakatttatgtactgggatggtctctataaatacctctccccaccccaaaacaagggactgcataggaaagaaaatagttaaatcataaaacctataacagtgaaatattatgcaaccaccaaaagtcatattttttgaagatgagtaacatggcaaaaagccatccaggcacccaacagcttagtatctactgtttatgaaaccctgtggtaaataagcattcaggatggagatcacagctctcatgtggaggagttttcagtttagtggaagagagagggaaataaacaggcaaacaaaatgtggcaaatgctcagatggaggtgtgtactgggggctccaggactcccaaagacaggcacctagcccagacaagaggtctagaaagatcacaagaggataggtacttgaactgggtgggcgtgagttggccacagtagagatgaagtgagagggggtttctagaaagggaacaatacacatgaaggcagtgatagctgcaggggctagtatttggtcagcttcaaataattccttctgactggagcttcaggtgactggggaaggagtaggagtgagggagatgcaggggcatggatgcagctggaagccattatcctcagcaaactaacgcaggaacagaaaaccaaacactgcatgttttcacttagaagtgggagctgaacaatgagaacacatggacacacggaggggaaaacacacactggggcctgtcaggggggacggcacacgttgggagagcatcaggaaaaatagctaatgcattctgggcttaatacctaggtgatgggttgataggtgcagtaaaccaccatggcacacgtttacctatgtaacaaacctgcacatcctatacatgtaccctagaatttaaaaaataaatcaaattttaaaaagagataataacactagcagcactatcttggactgccctcaatgtgcaggagctcgttatccactgttgtgttttatttcatgattgtgcattgaagcagtggtaaagcaggattctgatcagaacatcccactcctatgcctgtgcccttagctctgccctgagattgcagcagtcggcagaggtcaaatcaatgacagcctcgttttccacataaagcagttaggatgtggagacagggagaagttcaaagcatgagttataatagcccaaaatgggaaatggcctacatttccttgcaagagagaattaagttaaaaagtgatgtccatttaatggaatattgtatgagcattaaaataatagttatcaacactagaaacagaaaaaaatttaatatgatatttagaactttttccattgtctaatgataaatatttgttatagaaatgtcaaaaaattcagaaaagtaataatttaaaaagtaatcctaccatccgaaaccactgttaatattttggtatatatctttccatctatgtgtatgtatgtgtgtgtgtgtgcaaatatatacacactcaaaaattagagtcatatattatttagttttgtacttagtatttgttatttaacattatattgaaagcatttccctatgcatattaaatgttctcagaaaacatacattttaatggctatttttatagagtaaataattatttaaatggataaaaaggccaggatcaaaaatactggatagacttttatgatacagcggtgtagaactggcacaggaaacagatgactaatgctgaggttatgggcaatttctccttttctctaatgtggttatttttataatttagttttttaaagattttcaacccttgtcatgcattcattcaacaggtaacattttttccttcattgtgcagtgtacagtgtgagcagttgataataaaagttgtgtttctgcttgacatcccaccctaggcttgggtttggaaaacatgcacgttggagagaaggaaaggagagctgggattagaatccaccatccacgcctatctgagagtgggagaattactttgtcaatgtaagaagtgataaaaaccggaatagacttgtcttattaggctgacgttgttcttgttgatttattaacttgaatttctttcttcagaacatagtcacaaacaaaccaagagggaaaatggaagttctaatcataggctttggtgatcaatcgccgtggggatgaaatgttatttaatttatagcctgttcatgtttgtatgtggcacttaccatgttatatggggagagagatacacaatctagcccataacagtgaagatataatgtgtttgttgggtgagaggtaacaaaaaaaagacaaagggggctattctctcaaagtgtctccaaaagttccttgaaaaagctgcaaactgattagaaggtaggttttttcctagtacaaaataatttacttagtcccttttcagaggatcattctatcatgttatatctgtttataaatctctaaatatcagaaaaagagatgcttaaagaggatcaaactattttgggagagtcactttgaattcaagagaaaggatatattacagtattaccagctgtctcaaatatgatcctatatgatcatgaggatccaaatagatccttaactcccccagattgtgacttctttgtattttctctgggaatctttgaacactgggcagctggcctctgcaatcacactgtcattcttttcttgcacatgtctccatcctcagccactggaggttgtgtctcactctcatgcatgtcatcactgcctggcacagagtcggcactcagtacactttatattaaagtgaatacttccatcgcataaagcaagtgactgttattaaaatgtgttcagtagcctttaggtcctaaactctgggcaagttctcattgctccagatgactcctgcaccacctctcttttgctagaaggagaagcaatgagttaagtgccttctcaagcttcttagatccckgattaatattctctgattctctgtcttggaatgcatttaaaatctctgcctcgattctgacctacctggcatgggaacaagaatttacaatgttactcacccacaatgaagattacatgcctggcaatttgatttaattatttgtggagcttaattcaggctgttcatatctgcctaggcaggaaaaaaaaaactctagcaagtttttgggccatttttgaatcagtattattgcagaagaaggcaagaaatttttttccattttaagcctggcattcacccctataacagagtttatttcacaagaagaatgttaagtcttgcagacaaagttttctgtttcttcatgttagtagaaatgtgtaacgttgcctcagtcaccttcaaccatatgcataagagaagtagatatttttttgagggtttctcagtctcggcaccattggcatttggggctggacaattctttgtgtgtgggacattgtagaatgtttagtagcattcctggcttctactcactagatgccagtaacacacacacacacacacacacacacacacacacactcacacgtgacaaccaaaaatgtctccatatatcaagggaagggtgcaggggagaggcaaaatagccctcctgtacactagaatgtatggaaataaatacatacaagacattctcacacactctctcaaatagctttggcaaattctgtttggctttcacttacgtgaaaatcacttcttttagaagactttttcagttcagggatgtgatgtggggtggggtgtgtgtgttggtgtgtgaaaaaccacacctgaatgaaaaatgcagcctccctaggaaggtgaccaagttaactttccttttcagggaagaagcaccacaggaggtcaaacggaaaccctagcggatgcctgttccatagctaagtgagccttgcaacaaggaattgttcaatattcattctttcacatttcacctctttttgctttgagcatccttttctgctgccagactttggggacctagcagcttgcaaagactcagctcttgtggaaagtccagtttttatatcctggctcacgtatacctctaaaaagcttagctggaagtaatagagccactgtttttgagtactttctcatgccagtcactatcctaaactttttccccacatcatttctcttattctttgcaataattctaccatgtagataccattaatgtcacagtttgagacatgaggacccaggcgtagaacactgggtacacacagttgttaaatggcagttccctttcttgaccactgtgctgtgttaccttccattgaacatgtggatttgcttatcaagaccctcagatgaccacatcataaatgatttatatgaatgagtttcacactttttatatgatctcttccattgctggttgaaaatgagaggagctggaagaagcacggaaatacttaaagttccagtagaggcaaccaaagcctgggggaaggttggttctcttcatggtggcgtaaatgtgatataatgcatgcattctggctgtatttttgtagtaattaaatggaagatgtaattagttctcttctattttgaataacagattaagtcataaaatgtagaatgcctggctaggttatttcttctcaaatttaaattttcaaaggagagaatgatgcatcctaaagtgaagagaaaactctggatctttcatgaagtgcccccaacccttgctgtgtttgttgaagtgtgatcacaggccaactctggttaggagctttgagaaatgagaaattctacatagggcatgggggacattctcaggaagcccttgtggctttctgttgctcttctctacgtggaaaacgttcctgtgtctcctacccaggyagtttagtagtccatactgcaaggaagtgtagactgaccttatcctatgtcatttctcatacttactgtgtttgttaagcatttttggcaaaaggtgtgactctactttttgggagtggtgatgggagttttctggggatgaagtctggaacattcctgggattctcaacacaagcccaagagttttcatcatttctcccacctcatcatacctgtgggaggcagcactctcctacacccctggggaacgagcttggaggcagagatgctcaaggtggagggtgggtgctgaggggaggggagtcccccacaggatgtcccggaccccagtgccatttgaagaaggcctgcacctcctcctgacaggcctgagctctgctggaaaccctgcattagtcagactgacatgagagcgtgaggcccagacctgggattcaaagttaatgagaaatgtagaaaacttgaagttgaacaatgagaacatttggacacaggaagggggacatcacacaccggggcctgttgtggggttgtggaggggggagggattgcattaggagatatacctaatgtaaatgacgagttaatgggtgcagcacaccaacatggcacatgtatacatatgtaacaaacctgcacgttgtggacatgtaccctagaacttaaagtataatacaaaataataataaataaaaaaataaaaaaattcacagaaaggaaaaaaaagaattccagttacatgaatgactctgtgttgcatggcggtgggggcggcaggaatttccttagcatttgaagaacctctcccatccttggccatcccctttgtgggtgcagttttctctgtgggaatcacccttctctctctggcaggtgtctgcccatctttcaggagctcgctctagcattgtttcttctgtgtggaaatgattgatcgcttctctgtgctctacggaattcaacaaatacttgttgaatgaatatataatgctatactagaatctacaggtttttgttataataagtgatcattgtaaaaaaaaattcaaacagtactgaagtgtatagaccattcagttttgagtatttctccattcattcaagaaatatttgttgcacatctaattggtgccagttgggatacaggaagaaataacatgaacagagtttcagccctcacagccctgacacacaagtagggtgaggccgactgtgaccaaacagcaagtgtataatgccagataataactgaagaaatataaagccaagcaggggagttgtgtgtgatggtgggtggggtggggcaggtaggggacagctgaggaaaggcctgcatgtagctggggagccagcattgaagacgcctcggggacagtgggttcatgtggagagggccgcaggtgcaaaggctstgaggagagaatgagcttggagtgcttgagaaaggagagttttaggagagcagatcagacaggaagccaggagccaaatcatgcaaagcttgaytggccatgaaaaggactttgaatttcattctgagatgcraaatcattgagcagaaaagtgacatgatcagatttatatttgtaagagtcactatcagagcattttcatcatcttttattcaaacagcatttaccaagcaccaataagcactaggccccatgccagataccagggagtggcagataaaagacccagtacatgccttcaagaaacttgcaatcaggtgtagaaacccacctacaaatagacacctacagcaccctgggttaatgtcatgatggtcagcgtggtgaagggctgcagacccaggacaaagggaccccagaccagggcatgggaggcaatcctccacatgagaatgttgttgatgatgtccctaatctgtgctataaaacaggagtgtatgttgctatggggatatgcagcacggagacctacctcagtttgggagagtcaagggaaggatctttgaggaaaggatttctagattttttggctgagttctggagaatgagcggaggctggccaggcaagggccctgcatgtgtgcaggagcagggcagggagttctgaagctgggaataggggtgggaacgtggtaagagatgaaactgggttggtcggtggggcctgagcaggcaggccttgaggccacggtcagggcttgctcctcactctgagagccgtagacgccatcaaagcgttctaaacagaggagggacgtgattccatttgcattttagaaagatcactctggctgcagagtgcagaatattctgagaaaaaagcaaagacaggggaggagaacggtaaggactcatgccaaggcctagctgaaagtggacattgtggacatggaggggagtggtggattgcatgacatggaggatgtagagccacaggactggacaattgactggacgcggagaataagaggggaggatgaaccattgacagctgccatggcactgcttttgaaatggtggaaatgggatttcttgggataaataatataatgtggaagagaaatgcgatgggagtagaagattatgaactcatttgtgggcagtgtgggactgccagtaggcagctgcctattggggtatgaagttccatggagaggtgtgatgcagggacacagtcgggagcactggtgcgtagatgattaaggtcataggagctgatgggctcgctggagactgctggcatttaaggactgcctaaggcctctcaccagccgtgtatgtaaatctcaggtccatcacagttttgctgaggcacagcactggctgtggcatgtggaggctggggtccgcacctacaccaaggcttttgggctcggacaggcacctggctaacaggagggtccttggaaaggtggcatcccagataacaaatgagtgcaggactctacctgacagcacttcacattttagatgtttggaggtttttgcaggtgaataatctgtcttgttttctgcctcttacttcaggactagaaaaagtattttagaacattttcttctcttagctttatgcccttgcttatatgaggagcaacaaagaaagatgtgccttctcttcttacatattgtgctgcctctttttcactaaattcacattagaaataattcacacacctcgaaaggattactgtactatcattcaaaatgagcttttcccatttgggtcgtttctactttttgactgttgtgaataatgctgctaagagcactgatatacaagtatctgcttgagtccctgctgtcaactcttttgggtacatgctggaattactggatcacatggtaattctgtgttgactttttctgagaaacagccatacagtcttccaagtggctgcatcattttactttcctgccagcaatgcaggaagggtgccaatttctccacagccttgccaacacttgctattttctgatttttagataatagccatcctaatgggtgtgaagtgatgtctcctacttctttactccccaaaattctggccccttctgagcatgtattgggtagttatttactagatttatttaaaaattgacagattgacagcatgagtttcacttttgtcagttaaggcatacggaggtcattttgtgacctcccaccccaaaagtaaaagcaatgtccagcctaccttattgaaatgcacctgtgaaaataacctgtgaaaatgaggcgaaagtgggccttttataattcagagatgttccagttgaaaatgaagacatactctttgtttttaaatattgctctgtgatcactacattaatattcataaagctcttgaaaggagattgtcatttggtattaaagccattacagttgtcactgggtttcaaagcattgctgcagagattaaattgcccctgctcttccagggctcttcagattaactgcatttgggtatgagttccatcagtcatctgtaagcctgtgatcctgaaaccgagaggtgcttattagaaatacagaagtcaggagagaatgctttggaaggtgcttctcgaatttggagtttggggagttgcatcttatgtgcaccttatggaggtaattatggtggtcactgggaatagatcaccaccaccggaaaaaggggtctcttgctgtcaaatgaaggccaccaagcacaatttactgagacttgaccttgaggagagactgcactgttttcaaagtgggtagcttgtatttcttgacactttatcccagagactttacactgacaaaagtcagtgagtgctatggaaataatcagtcttggcaaaggtaaagacctcctgttctctcacgtgtcttggaaacatctgtctgtctgagtgtcaggaaccataaagtgcaaaacagttgagccagaagggttggtttctttagagtgatttgaatcttgatggatagacaagtctctagcaaattaaaaaaaaaaaattaaaaccaagtaagcagtacattgagaataatatgagctaatatactctctaccaatacaagtcaggtggagtagaaagattaatatatgggttgtatggccaccgtgatttggtagccatgcaacccgtgtattaacccataggcatcttttatgcttttgaattcaaaggaaggtttatatttcagagactagaaagtaaaccttaaattggatcttgatgaaagttgtgctcatactgggacagctttttatttgtagtcatttcggaagagaagttttgaagatatctctgttgctggtaaaagtagaggagaaatttagtagaaaaatctttttaatttcaaagtccattttgcagggatggggaaagcaagttatttttaaagtgacaagttggttagggatattctttttcttaagtttattaataatggtatagccaaaaaagtgaaaatatatgattcagattttaagtactttgccaaatttaagtcactttacatttgtgggataagacagacttgagactcgtgtgtggaagggatcgagtttaccccagccaatgggctgcagaagcccagagcaaatcttagctgaaggcttttaagcatcttgagatgactagattctgttcaagatttagaaaaacagtcatttccaaagaagcaagctaaattttgtaaaccatagctttggagttgatagtgatagtgaatgttgaaataattattttctgtagttttcaggtctaccaatactgttttgtcaaattgtttttaacttccttatttttaaatcaatattttaaaagagcattgtattgtattgttaagcccagagttaaaattttctatttgggcagatctttcttctctttccagcaggctaaccatacataatgtattgttggtttcttcttcttttttttaatccttaaattaacctttaaaaatattgattaaagcagaaatacaggccgggtacagtggctcacgtctgtaatcccagcactttgggaagctgaggcaggaggatcacatgaggtcaggagttcaagaccagcctggccaacatggcaaaaccctgtctctactaaaaatacaaaaattagctgggcttggtggcgtgtgcctgtaatcccagctactggggaggctgaggcaggagaatcaattgaacccaggaggcagaggttgcagtgagccgagatcatgccactgcactccagcctgggcgacagagggagacttcatgtcaaaaaaaaaaaagaaaagaaaagaaagaaaatctaggatatatgaaggtactagtaatatttatactataaggtataattctcttgtgaattaaatctgatgtttgatttggccttactgtagcaagctaatcccttttgtatcttttgttattgttgttgattataactgacacataatagtcatacatgtttgtgggatactgtgtaatgctttacacgtatacgttgtataatgataaaatcaggataattaagctaattcactttgaatgtacatggaaaatattattaggcctactttgagagtacaccaagtcagtccaactgctgcttctttggaaaaataatgaaaaaatgaattaaaatgtatcaccttccccccatcaaaaaaaactgctagcaatcaaatagtagaaatgattatgatgatggtaattacagtcaccttaaaaaatcccctagacagcagggcgcagtggctcatgcctgtaatcccagtactttgggaaaccgagatgggcggatcacctgaggtcaggagttcaagaccagcctggccaacgtgacgaaaccctgtctctactgaaaaatacaaaaattagccaggcacagtgcacctgtaatcccagctacttgagaggctgaggcagggagaattgcttgaacctgtaaggcggaagttgcagtgagtcgagatggcaccactgcagtccagcctgggcaacacagtgagtctctgtttcagaaaaaaaaaaaaaaatcctgtagataaggagtaggtttggcagatccatctataccccaaatcaactacagtcaggactccagtgtacttctgaactctaacagctgttgattggtttgtaatgaactttctttggttatgtagcatgatttattttgttctccacttgatgttattgtttaactcaggcccccagcatccaagctaccttccttcctacataacaatggtatcacttttaggatagtgctaaaatgtccctaaagcagtatcactcaaagtgtgttcctccacccagtcagtaagctgttttttcctgatctacagtgaattaaaatgcttgcaccatcatataaaccaactacattgctgaacacactatttagttcatctttttattacagcaagtttctggatgaaagaagcacatgcattgatttacgttctggggcaagcctttatctcattattcactggcacttctcttgctttaatattttctttctgactttcaaggattttcaccaaaccctggaaaattatgagaatatgggatttttgtaaagtggtatttgtaaagagcaacattatatattccacatgtgtagaatctctattgtcatatttagttattattcagtttacttccttctcatgaaacatatttttctgtgtctgtgtggcaccaacttgtacataaatctgatccctaggtagatgaattaataacttgaataaagttgttgtgcaatgtttaataatacaggttgaacattcctaattttaaatctgaaatgctccaaaatctaaaactttttgaggactgacatgatgctcagaggtcatgctcaaaggaagtgctcattggagcattttagattttggatttttggattagggatgctcaactgttaagtataatgtaaatattcaaaatctgaaaaaatttaagatcccaaacactgctggtctcaagcatttcagataagggttctcagcccatatgaattttattgataagtgcttaatgaagtactgtgccaagtactttacatgcattcccatatttcatctttacaacaatgctgtgaggtaagaattttgatcatcccctttttggagatgaagaaaccaaggttcagagaagttaaataacctatccagcttcaaaaagctagccagtagtgaagcagtgattcaaatccaggtctccataacttcagggctcttgctcttagttaagagccactaagtgtggtgtgggcatgggcatctggcagataaggagtgaaacaaatttagattctggaaacatggtggacaaagtccatgcagagtctcctttaacctcaaatagaaaaattggttaaaatatactttttaaaaagtcataataaagatcaaaagaaagaaagagaaatcaccaaagtatgaaaaaagaagtggcagttcaaaagaaccagagaagaaagctgaaggcatggccttggcagctgtttgatttggagagtcccttgtgttaatgtccacgcatgcaggggcagttgatgtgactaaacctgggcaagcagggagctaaaacttaatccccatatattgctgacctcctcaagggctgcccctttcgcaagaaggggacttgagaaactccacccatcaagctctttccatgtcctggtatactggtgtgggggccaaaactactctagtgatgcagatgcttgggggagattgtctcaatggaaagatgtatgttggattgatgaagcacattgacttctatcaattcttttagcattgctaaaatcaaacccacactgtgatataacctatggaagtattagaacactaaagatgaatagaacatttttaatagaaccaaaaatgggaaaaataaataaccagaggaaatggtcaaattgctatcaaaggaatagcagttcaactggcagcattctctgaacaacagtgaagcctaaaacacattggaataacaacttcaaaatctgagaaaaaataaccgtcgacccagaattctatgccctgttaaagtattattttaagaatgataatgacatggaatacacagtgataggaaagaaaaaagtgataacaacaatagtctcacaaacatgttcagtgaaagaacccagacacagagtacccaccntaggattccatttatataaaattcaaaaaataggctaaattaatagggataaatgtctgaatagtggagtgagtaatgacaaagaaggggcatgagagtgtgatggaaatgttatcatcttgatctggatggtatttgcatgggtgcttacatatgcaagattcattgagccaaaccctttaaatgcatgcacattatgcacctcactgtatgtattttaaacctaccccccagagagaatatattttttaaagatggagactgtaataaagactttttaatttgctttttattaatactcactaaagaattggtcaagatgtatttctgtaagactgagatagaactcagaggattggagtgggttttaataatgaacagtaagaaaagaaagtggtaaattagtggttgcatttaaacaaatattgactaattacaataataatgactttgaggagtgggggttaaaaagcaagatggaattaaggtgctagataacaatcatggaaggtggtaggtggtaattggagttaaagccttctaagatcctttttttattctgaaagagggtagaaatattaactttgagtcagttgtaaaaatttaaagtaatcttgcaaactaatgcaggaacagaaaatcaaatactgtatgttgccacttgtaattgggagctaaatgatgagaactcatggatgcaaagaagggaacaacagacactggggtctgtgagggtggaggatgggaggaggaagagtaactattgggtactaggcataacatctgggtgacgaaataatctgtacaacragccccygtgacatgaatttacctgcataacaaacctgcacatgtacccctgaacctaaaataaaagttatacatataatgtgtatatatatatatatatatatgtgtgtgtgtgtgtgtatgtgtgtgtgtgtatatatatataatttaagatagtcacaagaacaatagaaacagaatgatgtctaactttcatatcagttaattggaaaacaagaataagaagttattgaacctaacagtaatcaggagagaagaaaaacaggagcatagaaaagacatagtaattagaaattactaatggaataatgggtgcaataaaattagtaatcacaatataagtataatttattaacagatttaatgtttaacatctgttagaagatggagattcctccatgctatttataagagactttcaaagccaaataacacaaagcaaaggggtagaaaaagataaatcaggaagacagtttaaaaattgagagccaataaaaaccacattactgccatgcaaaatagactttaatgcacagataattttaaggaataattcatcagaaagccattaaagtcttgagcttgaactctcaaagtaagcaaaatttaatagaatgacaaggagaaatagacaaattcataattataatcagagattctaacatgtatgcctcagaaaatgaaatgatcaaagttgtggaagatttgaacagcacaattaatgaatgtgacctttgtgctatataaagattcctgccacaagttagacaatatacatttcaagcacaacatacatacatcatttataagaatggaatctatatcttcagccagaaaaggagtatcagtaaagggtaaaccaggcaaaatagaagacaaccgggagcactgaggcttgtggcaaacaggagagaatgcaccttcttaaggcgaaagcaaaaggaaaccattctgcagcctatggcttctggtttgaacattcaaagtgactgcattatcagaaaccatccaagccaaatgcctgctgctgcctttccatcttgttgcccactctctcacctttcgaccactcattgatatctgtgttcaaagaagggaaaggtgttatcagtcatcttggagtcataaacatttctgatggcaggcaacagggcagcaggagggagcgggtgaggaggaggaagaagctattgcctaaggctaggtttatggattctgtgatgaattttgggttattcattgttcttcattgccaggagttcacctctaggtgaagttgtgnaaaatcttgctttgaagatactgaaaatggatgaaataattttcttcctggatgaagataaggctttatttatctactagaacccatttaataagcacctacactttgtcatggctgaaggagctatgtgaccctgagaagacttggccatagattctctttgtggagttgggtgagttcaggctttatcaggaagattatgggcattttacttagatatcaaattgtctcacctcctttgtccatgttttatgaataatagtattcatgatcgtggatacaatattctagatttggtgtatagcctcctaatttgttcatctacagcattcttaaccccttataaatgtttcatgccagcctctcattttgttagattttagtgtctcctctttatcttttgctgacctagaaattctagaggcagctccatttttaggctgatgaaacgcagcgatccctgaagcgatctggcagtctcccataggtaacctccttcaagcttgaaatgactccattattactatgagtccctgcccttgagaacattttagctgaatgtttgctaatttccttttccacgctgcctctgcacattagatatcagtctgtttcctaaaatctttcttaactttcctaaattaaggctttgatcaccaaattatgtatcccatgggtgcttttggttgacacaaaagaaataaaacaacctgtcacagttaattttacaatataattaaagagccaaagcaactgttgagactgggcatcatcccctatctctaaggaataaataatgcagaggctcgtgtttttctaaaagtgctaactattggtcccttggcaaagaataataaagtacaactgcactgggccacaaactggccctgggcatcagaattctcactgcagtggaagttgtctttggctgcagttgtgtaaactccgacaggctgtccagcacaagtgtgaccacagacttcctccagtctaggtgtgtccaggatctctctgccttcttatacttgtccccaagacttcagtctttagtgtggactgaacaaagatgtaaatgctgtggcttgttcttgctgaccaaaggaaacttgattttgttttagatccagatatatttgaactgattcgatattttccacttgatataaagtggggaggcatgtcaatgtgatagtaacagatttctcttcattatgtttatatcattgctgtgctttaagggttcctatgaaagacttcattcactgaatgtgagtcccttgttggagaatttctaaatgcttttgtgtttaagtagctatttgttttgagctagaaatatgaaagtggtttggtttttgttttttttctttgttgttgccacttaactgcttcctcttttggggttgatcagttttaggtttagattaaaacaggcacctgagtcataaacaaactttaacagataaatggataatattctcattatataactagcttattataattcttatgaataacactaaggccacaatggataaatgagcagaggacatgacagtttcctaaagagaaaatcagatggctagtatgcatctcaaaaactgttccactcactagtaataacagatgtaaattaaagcaaccatgaagtatcctttctcattgctaaaattctactttagttacttatttctagacattttaattttaaaaaggcattaaatattttgatgaatcttgttaagttgataaaactttttttatattttgccaaaatgtttgttaaataccaaatatactaccaagtatgccagtatagaaggatagatggctggttctctgcacccttttctatattgagatgattcattctttgaattttgccaatgattaaacaaattactgcacaacatatgagataatacttgcaggcattaaatttatatttatggatattttacataacacagaaaatatgcttataaaaaggacaaatgacattttatgtagccccagccttcaaaactcatatagtcaaatagaatacaagggagggtgaagggtgtgtggtatctagcaccaccagcctggttatccattccttctattccctcgccacacagtctaaggaatgttttaaatctgggtgaaacagcccaatgctatagcttgtttcctcccatgcattgaaaaatgattgcacaaatgttattaaaacttatctctgtggttaaataatctactactctttggaagaaacctggaccgtctccaagcaaaatgactttctgatgttgcaatgctcttgtctgccatgcctcacttagttttgaatgcctgaattatgggaatgtcgtnttcttagaacacgtgcgggacgtaggaatcatcagttgtgctccagctctcttagcttagtctgtctccatgctatcatctgttatgtctgcgatgaatgcttaagaaatggtcttgtgaagagagctgatctttctgcaggtgttcttactactgaatcaaaataaatagaaaaagctctcataaaaagacttatctttggaatctgaggacatcaccatgtgtgtttttttttaccctaaaaatatctgctgttctttgctatttttaaagtgtgtgcttatttgagaggcagtagcaaaatctctcattcaaaataatcttatttttaaggtagaaaaaaattagaactgatgaaatgttttgactggtgtatcatggaggcactgaggaaagctgttcttatgagcacataggtctttgttgtataatatttaagctccttgtgtgcygctggaaacttctagagtttctctgggtgctgatcattttggaatggagatattagaggtttgcagttctcatcatcaaaaaccactaatggatcacaagtgagttagttgtacctatatctaacttcttcaagtatagaatatatggtgcctactaattgtataaagatgtcttagtgtaaggagaattgggtgggctttagaatgtgacaccctaggatcaagttctgggtctgttacttactaagtacatgaccttaatttactcttaatttacttaatgcccctgagtctgcttcttcacctgaactgtgggaagaacaatactcacttggtagtgttgtgaggattaaagatagtatgtgtcctatggaagaatcaatgtatgctattaccattaatatttccgtagcattttattgacactgtaaacagtaggtatttgaatatgttgcttttttcaatgtctttacaattcacccaagttgaacatgatatactaggggcttagtttctaatctggatgagtttttccaggtgacacacactttctgtcacctttgtgctcaattgcatgccctgctgagatggctcaagggggtctctgttgttttctaagacctggaaatggagcccttttcaccagaaaaaccaataagaccatataagattcagtccacacttgtgtgtttattagcaccacgctgaaccaaatatatttaattggatgcttaatcattttgattcagatactttatagggtgtgagaaaggtatattctatttgtggcaggaacttgtgatgtaaagtatgtagaacagtctgtagaaaagatctgtggctcctaaacttagaattctcagatcatttgctatgtccatctatcccagtcttaacccccatggaaatctgtcaaaaacagtgtccgtgctggaagtgacctaaatgtgcatcagtaaaataatggatgaacaaattgaagtatattcataccatgctatactgctcaacagtgaaaaattctgagttactgatagatacaatgacatgggtgaattttaaatcattatattgagttaataaagccagacacaaaagagtatatactctaagattagatttttatgaagttcaagaacagaacaagtacatctaatctctgatgatataagtgagaatagcagttacctataggggtaaggggaagtattggctgagaaggggcaaaaaggaattttctagggtgatggaaatggtttatatcttacaaggatgtgtatacaagcrcacacacacatacacacattcatcaaattgtacatttaagatctgtgcatttatggtatctaagttatacctccattaaaagaaaagtgccagctgggcatggtggctcatgccagcactttgggaagccgaggcaggcagatcaattgagcccaggagttcaacactaacgtgggcaacatggagaaaccctgtctctacaaaaacaatacaaaaattagccgagtgtagtggcacatgcctgtattcccagctactcaggaggcttaggtgggaggattgcttcaaccctggtggttgaggctgcaatgatctgagattgtgccactgcacttcagtctggacaacagagtaagaccctatcaaaaaaaaaaaaaaaaagcccaagaaagggcaccatttcatttgcagagatgagcaaggtgagggtagaaggaaattaactctgaaaaatatcagtctctctagggtttacattttataaactccatttctgtaaaattgaagcgaccactcaactctgattttaaaacccaatgaaacctgtcagggtagcttcctgtacatgaatgaattggatctcaacttttttaagtatagcttttgctctgaaacagaataaacagtataaacagtactcactttaacaataagttctagtcttgaaatgctagacagcgtatctgtgttgaatttagaagtgtcattgattttaaatctctctttggatgcattgatatttcaatttggagaaaagaacaaattgggttgtaaattcatcttcccagcttgggtttgttaaaatcctccatgggggtagtgggggaataagttacttagagatgaatgtgagtgtgnatttgaactcaatgtgaattgattttcgtgcaggacatcttcattttatacataaataatgagccattagctgattactctccattcgctctgtggtacgtgttttctaatacttgaacagaaaaacacaatgaatcaagcaaggtggaggacatatctaggctcagcctaaatgtaataatcacccaacttgtgaagatcatcttggaggcaaacactggtgctatcatttcattttttcctttttaaaatcctcatgatggctgaaaattttgtaaacagcctcttccattgtcatattcaaagctttcaggatactttcttctcagtctttccagccatattcccaacacttctgcaggaactgccacctccaagtttctgtccatagtgaactgtgtgatatgtctttaaaactctgaacagtttcatgttggcctctcagcacaagtcagttcttcccctcctgtgtgtctttccatctcaaaccatagatgccatgccttctgcagagtaggcattaaagttttatggaattaagggaagtagagaaagagaaagcctgcaactgtctgtacagcgaagattagaagaaaaaatgaaatgttgcagatttaccatttcatggtacacaggttttgcactgatagagatttcatggaacctttcaacagccttgtttctccttgccttcaaactccatgatacagagtaattaggattttygttccagcaataaaaaagttcacccagacttcttttgtaataaaatcrtgtaatattggcagaaaaaatacagaaaacaaagagattggtcctgaaattccataagctaatgtttacaaagtaaacagattattttactttttttttttttgaggcggagtctcaccctgtcacccaggctggagtgcagtggcatgatctcagctcactgcaacctccgcctcccgggttaaagcgattctcttgccccagcctcccgagtagctgggattacaggcgtgtgccaccacgcccagctaattttttgtatctttagtagagacagggtttcaccatgttggacaggctggtctcgaactcctgacctcatgttccgcccacctcagcctcccaaagtgctgggattasaggcatgagccaccgcgcccagccagattattttactttttaaaatattgatgttaagttgtgaagctacatatgctgttacaagtgacaatgtatagcagtgttaacaaagcagccgtgacctcattcctggaaatctgtcaccaaggccatccaaaaagtatccattaaattacttttccagattttttcttgtcccaaaaatatgtttaatgaactttatctgaaggcaggatatgtcaatactattttttctcatagctaaggtttaacacgctcctgataaggttttaagatattcatataatgtatgtattttatgtatatttacttatatatttatacatatatctatgtttatacatatctatgtatgcatattgatagactgtacacatayatccatgagatgtccaataaattacttacacatggtagaggactgtatgatgctcctctttgctcccacctcaggactttagaacttgctgttcactttgtatggaatgcttttccccagataactacatgctcactctcccatctcctgtatcttcacccttgtttattctctttacagcacttctcagagctcacaggatatgtttaattatttctattgtaaaytcctcagggtaagttccatgagggcaaagaccttgttcattttattcactttatatccctcgtgcttatcacaatgccatataatagaagctyactaaatatttacagaatgaatggatgaatgagtgacttaaaggtaatttgctccaaccctctaccataatacatgatttctctttgtattatttcaaataagaacctacattaatgaattaattgaagggcacttataaaataatatgggaacaaactgaatacagaagaggtaaaaaaataaaataaaggatgactgaattgatttgagaaagaggatgagaaaaattccagagagcatttaaaaggaaaggaggaagaagaactcaatctaactcatgtttatatcatggaaagaaattgcataattttccatcaagtttattatttttatcactgcatccctaagttaatatgtgcacaacactttacagttacaagtacagtttataataaaacagctaaataaatgaaagcaagctgcatgaggactgatgagaatatatcatgaaccaaaagattataaggtccaatacagaaaacactgtacatatctcatctaatttagacctcataacaatcatagaagttaagtggaactggtattattcccatttttcagatgtagaaactgagtctcagaaactttaaatgatgtgcctcaaatttgcacatattatgtataccagactccagattctgtgccatatctttaggatcgaaagcctgtactaaatgattggaaaactcagttccaatttttcagcaatcctgggaaataagttagaaaaaratgaattagaaaattatatctcctctgtcccaatgtaagccttctttccgtgtttctatccacctcaaagtattccttttttgaaaaagttacgatttgttttaaaggtcccctacttttattttttcttcttcctcggacactttataactattgattgaattgatatgaatcgaatttttcggatgtaaaaggttcttcactgtgcagttaccctctttyaccacgagaggtcacctacaggccagtgaggccgaggggttttgagaagtcgtagacgaacttgagagttaaaattcatgggccatgtcatgattctgatagagtgtgaagttggtgactcataggatcgaagtggcaaaaagtgaaatatgtgggttttgagacaactttgggtgaaagtggggcagagggcaagacgacaaaaagtgcagaggcctcggctggctgtgtatcctctctacgacattcttaaacagtgttctaagcacctatagtgtcccaggcatgggcttagtgtttggagaatgacagtaaggctacagcctctcctcccccaaacccacatctagcagggtgactgacagccagcccactctttacatccactaatgtgccctgtcctttgctttagagatgagattgcaaagtgagagcctgcaacggccttcccctggatttgtttggcgttggcgcttgtgctgttctgtaactactatatattgctttttcttctacctggcttgcttcactcatttgcatcatctgtgtggccctgtagacatttgagtctgtccctgtgatttccctgcatgcccatcatgaagactagccctacccggcctttgctcttactctaagaggtctggttcccaccaccccgggcatttcagggcttcagctgtcctgctgcctcagcagctgcttctgtaacaaagtagatgtcagctacttcaactccagatgagatccgaagtcaaatgaacttgtttgcctcaaagagaagaacaaaggggctttgtggggaggaggggagcattgcaaccagttaatgagcagagtgttcaatctagagcatgtccaacatggccagccctgagggcatgtgtgaccaaatggcattggtgcaggcagcctccaacagcacataaccatgttctttctcttccagggtttcagtccttccccatcttttcctttttcttgcttacctcctgagcaccctattgccttttaccctttaatggcctccagtcygttaatttgtcagaaactgtttctgtgcaggtaaggagacatttcatttattagcttgcttaaagctatgaagaatatttcggaagagcttgcagcctctgccaacccacttayattagtttcctattgttgctgtaacaaattaccacaaacgtagtgacataaaacaacaaaaacctattatcttaaggttctgtagatgggaagctgacacaggtcccatggagctaaaagcaaagcgtcggcagggctctgtcctttctggaggatctaagggatgatccattttcttactcattcaggttggcaaaatgtaggtccctgaggttgtaggactgawgtttccatttccatgcagctgtgggctgagggtcattcccagctgcttgcattgcttggtttatgttcctttctcccgtcttccaagtcagcagcaggagaggggattgtgccaagtcctcctcatgttttgaatctttcctctttctttggtcccatctctctgacacagttggaaaagattctccatttttaaggactcatgattaggttgggccacccagatgatccaggataatctccccattttaagattcatcctcttaattaggtctacaaaatccctttgtaatgtaaggtaacatctgtacaagttctgggacccagggtgtggacatctttggaggccattttccactgaccacaccactgaacccatctcttgggttggtaggaaccccaggtggtggttgtgttggaaaccagacatggagtagactgctgagtaaagcacttgactgaaatggggaaagcttggatcttcttccagccttgaagtcatggcactggccaaggcagtggggctttggttcttttagggtatcaccaatatgtctagcattaaactatcttaaaaatggacaattaatacaattgcctcaaattctagtaatcagcattttcagtggctagtgtaagagagacctattcaatatgcattcttcctttcttcattactaagagaacccagattttatttggggtagcaaggtgtccagccaaacaacaaccctggttctaagttttccttgcagctaggggtggtcagtgtgacacatttctggttgaggagatataaatggaagtcactagatggggattctagggaagctctctaaaagaagctgactgctgaaatgcaccttctttacctatgccctgtccctgttgcctgcctggaatacagacacgtggcaggcactgaggctgccatcttggaaatgtgggagtcaagctctaaggatggctgactggagagctggaaagagctgagttgttccgtaacagtattgtaaaactccagtaccatccttggactgtccccctctggatttcttttgtatgagagaacaatattgagggcgtgagagaagaggggttgccctgttcttaagcaactgaatttaattcctcactggtctctgtactccracaattgattctcamtctaaagacttacaagattcataagtgtcttctagcaacaggaaataacctgtgaaaaaggaactttcttaatactaaatttagccctaataatttcaaaacagaagtagttttaaatgtatgcgtaacacttttaaactgccgtagctttttcacatatgtgatctcattttatcattgcagtaactctataaagtaggtgggtcagaagggtgcatatcagcattgccttcattgacacttcaggaaactgaggcacaaagagcttcagcagcctcttaaagatcctaagttattgtttatatcttttaactctaaaccatttgctctctcctgctccttactttaagatttattccctaatgttatatattataagaaacatagtttatgatgttttttcttttgcccaccatgtgtatttaacatggaaaaatgataaaattaatctttgcaaagtatctctccccccagaaatgggcaacttacttaagctagttctagttaaggaggaattggtcacacctatagaaagacctctcagaaaagaggatggccagaccctaggaatggatctgtgaccrtggaagccattagggggcagcgccctcttggttatcttactccctccagttttcttggtcttccctaattaaatcatggcagctcaggcagagtccctgagtgggaacagttcctacagaaatggaactgtgggcaggaaaagcaacccacaacatatctctggcagttatttccccagcactgaagtagactgacctccgcatcagaataactcgctctgctactgttgtgaatgctctgatcagaaggatttcagatttccacagtttcatggrttagcctgaaaggcaaaatgctgatttttatgctgatgaaataaaatgtaggccaaaaaatacaaatgataccccccaaatacaaatgacaacctcattttcagattgcattctcaatctgaaggactgaagaattctcagtctgaattcctaattttttaaagtaaatttatcttgtataatttcaaagtttgtcatactttagaaaatttataaacttatgaaaaataaaaaagtgttttccctctagctaaagcagaagtagctcttcaaataccccctctttctttgaagaggtgacttccacctgtatcttccatgatgtttacaagcatatatactgaaggtcattcatttgtaagttaattggcaaaaatatcttgntttcaaatactctttctttttgcattcaaagtcatttcacatctgagccaaaatgagaagattcaggacattataaaatcatcatcatgaatgcgtgatgactttatagtaaagaagacttcctacatatgtgcattttaaaagtcaccctgacggttacaaattgtagcagaataggctcaggctctgacatcaacgtgtttagaatccagagggagagacagattgaacatgtgataaataataagaacaaaaaaatscaacgctttatgactatctgcaagcatcttccgtgagttagcaggtgtctccctgcctgatgtgatcctgtgttcttgtttatattggctagaattttcrgtttcaagtagtagagactaactcaagctagcttaaagaggaaagaaaatggggacaagatataaagaattgggaagtgtcttacaggttccaagaaccagaggtgcagcctggccatatgagggactggaaagccagcaagartctaggcagctcttgttttttgtgtgttttgattttggttttggctttttgtcccagtctcccacatctgtcctttctttctccattttaatttttctttgccggctagcacatcatctatcaagcccattttgtttagtctggctaagtcacaactcctaaggtagttttgttcctccattcatgaaaccagcccagatgagaattgaaatctcttagtcccatttctaaatttctgtagaaaactatgacctattctgggtgaggggtctacccctagtcaattggctaaggccagggggaagaaacaggtcctaggatcatgtggatagtggagaaacaattctagagaaggtagaactctgataagctgaacagaacccccaagagtgtcttctagcttcattgaagaaccatacattggattttaaccggtgggccaaggccctccctgggtagagaatggtgggtgcaggggggtgggtggagacttatatttactgaagggatccttccttgaaaccatctacctagataacaagcattctctatagactgaaaataaatggtatattttgagcatatgtgttgtagaagctcttaaaattcatgcaatttaaattctttcagtatgttaccaaattagttatatgttttagtcatcatatgtcttcaatatcaatagtaaggctattcttttgtgggaggagtccctattatgcaaaataatgaaggaccctrtgtataaggttaggtatggactaaaagtctgtatgagtagtgaggattggctgggatgttcaacagaaagctctgcacatgaattttattttattagttcccttattttcttatattatcatgaacntgtctaaagacatcttactgcatgggagtatgttatatgcatgtataataaattggtagaaagccattctgaatgatagataatatttaaattgactttgtattactttcagctatattcagtaacagaaactcagccatcaaagagtgacaggggaaggtcctttgcaatgtgccataagaaatatttaagcatgacttgtaatttgcatgctgattgttgaaatgtgagcaaatgcttttgaagtgtttttaaaatatcccttaatggtaccttacatatgcaggtactgtttgcaaactcttttcatagatattgagnaaggaaagtttaaattcagcctanaaataataataacaaaaaagagtagtagaaggtagtattactacgcagtttcttgatacgagcactccacactttataaacataattttattcttgcaacaaatgtggatactgaatctatgcctgttttatccagaaggaaattgagtttgagaggcctacaatttatgtcaaattatttggatccaaattaatttgtttttatactgtgcaaaatactcctttgaatggaagcaatgatggcagagtgatccaattaacccattaggttaagcagggaaatttcagacattgctagcaaattggagagatgcatggcttcattattaagaccagattctggaacaggtcatatgatgcaagttaaaatcctaaccccaccaattatctgctttgtgaccctgggaaagttactcagcctttctgttccttggtttcctcctccttaaattgaaggtgggtaatataacaactagttcctagagttcttataagggttaaataatatttaagcgcatagaagagtcccaggaacatgaaatgctattgcagtgcttttgactggcatgaccttctcagcctagagcctgtgcacttggtatgtcagcacaactgagggactgctcccagagctatttcttctttaagtacagggggccagatcagtggcrgtctggaaaggtagcagggtacaaaatcaagtacttcctcagacctataatgctttactttctaatggtttccaggtttccttgctctgccccagagtagggaaccaaaacagcaagcagagccacaagtgcagtgcaggctgtggaggacaggccgggggggaaatcccagcacagcagggagtggaagtggagggccagctgccagcagcccgcagtccaggctcaaagaactgccaggggctccctccaattaggggccacggcccctcccaggcctgccagtctgttttaaatccattgagtgctgttcttagaaactaaggaaccctaactaattggacaataaaggaagattytggtcttgagaggatggcacagtaaatggagtttgcagcgattttgattgcactcttactctgcagctggctggctggggcctgcagaagcctcttaacctcattgtgctgattyctcctgcaaggaaaacgagaactggttcacttgccctctcttctctccccagtagtcttcagaagattaattgctatttgtgattcattttgatttggttcaacgaaatacaactagggtgaaatactgtccttctgtaattcaggagaaattatcctttttaagtacagtgaccatttatcacccacacttggacacttttgagaataaaagggggcattaaacataattaaaattctataattttgcttggaaaacattttggcagtttcttaacaaaactaaaaatacccttaccatacacacaatctaacaatcacactccttgctatttacccaaatgagttgaaaacttatgtccacacacaacctgcttgtggatgtttatagcagctttattcataattgccaaaactttgaagcaaccaagatgtccttcgataggtgaatggataaataaactgtggagcatccatacaatgaaatattattcagtgctaaaaagaaatgagcgctcaaggcagagaaagacatggaggaattttaaatgcacattactaagtaaaagaaaccagggcagtgaaactattctgtatggaacaataatggtggatacatgtcattatatatttgttcaaacccatagagtgtacatcatgcgcgaactcccaagtaaacgatggactttgttttataacgatgtgccagtcttggttcattgactgcaacaaatgcaccactctggtgggagatgttaatggtgggggaggcaagtgtatgcagggtagggaagaggagatgtatatgggaactccatacattttgttcagttttgttgagaacgtaaaactgctctgaacatagtcattaattyttagaaattatataattttggacatgtttattagtttccttataaatagatatatttttaaactattttcaaaaaattatttttataaaagtaaaatttttaaaagaaaaaaggtattaactcagatggtccaagggaattggtgttcaccttagtcccaaacacatgctgaattgaaactaaaaagaaaattaaaaataacatgcttattatttcaagaggaaataaattacttttgaattttaataaattacttttaaagttttaataaattacttattaattcaagaggaaataaactgcttttctatagtgtatttactctttttattgggaacctttgctgtcaaatgtttctctcatttttttcctaggtttttattactaacttattgagtaattcacagcgtactaatgctccattaactgctttacatacattaatttaatttagttcttttaaaatagagatttcttcattcattcactcaaaagtatttactgacctacaactccacagcaagaaaccaaaaaaaaaaaaaaatgcaaaaaagagagcaaataacttgaatagacatttcttttaagaggacatacagatggtcaatgggtatatgaaaagatgcttaacatcactaatcattaaggaaatgcaaatcaaaactacaatgagatatcacctcatacctgttaggatggccgctatcaaaaacaaaaacaaaacaaaaccagtaaataacaagtcctggcaaggatgtggagaaattggaacccctgtatactattggtgggaatgtgaaatggttyggccgatatagaaaacagaatgggggggggggtccctaaaacaattaaaaatagaactgccttatgatccagcaatctcagtcaaactcaccaaaagaattgaaatcaagatctcaaagaaatatttgcaaaacatttatcgtagcattattcacaatagccaaggtgtagaaacaacctaaatgtccattaatagatgactgtataaataaaatgtgatatatacatgcgtggaatgttattcagccttaaagaaggaaatcctgtgatacgtgacaacatgtgaacctataggacattatgctaagtgaaataagctagtcacagaaaaacaaatactgtatgatttcacctatatggggaatctaaaatagtcaaaggctgagcgtggtggctcatgcttgtaatcccaacactttgggaagccaagttgggaggatttcttgaggccgaaagttcaagttcaagaccaacctgggcaatgtggcgagacccagtctctacaaaaaaatttaaaattagccgggtgcggtagttcatgcctgtggtaccagctacttggaaggctgaagtgggagaaccgcttgagccaggagatcaatactgcagtgagctatgatagcaccagtgcagtccagcctgagtgacagagcgagaccctgtctctaaaataactaaataaataataaaatagtcaaatgtacctaagcagagagtaggtagtggttgtcaggggttgcaggggaggggacaatgggaagtttctattcaacaggtataaagttttggttgtgcaagatgagtaaattctagagatccatcatacaacattgtgcctacacttagcaatactgtactctattgtacagttacaaatttattaagagggtatctgtcatgccaagtgttcttaccataatttaaaaaaaaatgtactgagcacttcttaagtatcacacactattccagacactagggacacagtcatggtgggggagagagaccaacaataaataaatatgtaatatatcaggtaaaaagtgctatgaagaaaaagtaagcagatagtgatggagattactattttagataagttgtcagggagcatgtcttataaggtgacttttgttgttgttgttgttgttgttgttgttgttgttgccgagatggagttttgctcctgttgcccaggttggaatgcaatggcgtgatctcagctcactgcaacctccgcctcccgagttcaagcaattctcctgcctcagcctcccaagtagctgggattacaggcacacaccaccatgcctggctatatttttgtatttttagtagagacagggtttcaccacattggccaggctggtcttgaactcctgacctcagtagatccgccacccttagcctcctaaagtgctgggattacaggtgtgagccactgcccccggctaataaggtgacatataagcagacacatgcagaagagacaggaataagcccagtgaattatctgagagaagatcagtagaggcagagggaaaggagagtgcaaagcaggtattgtcatttcatggagtagcaaggaggctaatgcgactgtgaaaataaggacaggaggagcgtagacgctgaggtgagaggtgcgagggagagtgagatgagaaatcattcaaggagatacgtgatctaacttacactttggcgagattttggaaatctcaagacaaattaggaagctgttgacatggtccaggtaagaaaagatgctggtggttgcaatggaaggaataaaaagtgtttagttggttcttgatccattttgaaagtagaaataacaagagttgctgacagacttgatatagggtatgaaaaaaaggattaaaagataatgccaaggttttgtctgagcaactggaagaagaatgatgaggcagacagtggaaagaacaggtttagaatgagaaatcagaagtctgttttaacacatgataatttgacatccatggtgaagtattaaggaggcacagttatgtctaaaggagctcaggggaacagtttgagctgtcattgtaartttcagaattgccattgtatagacggtagataaaccatgagccttcatgtgatcacctgggaggacagtgtagatacttaacagttgagtccaaagactgagcctgggtcctccagtgttgagaggtctgacggataaagagaaaccagccaatgagatggggaagcaacaggtgaaagtggtggcctggaagcctggagagaagagtgctttgagaacaagtgtgtgataggctgtatcaaatgctgcccagtagttaagtaaaatgactacaagatattgcaatatggaactcactggtgacccagacaaaagctgattcagtggagcagaagggatgggagcccgattggaatgggcttaagacagaacagaagggaacaaagaaatcaagggacagtccagaagggttaataaccttgctgataaaaacacatcttgtaagtgccagagctaggactctaagtagaatctttttgactccaaagtctgggcagtttatagaagtttagagtcttggatcaggagtcaggacagttttgacactacctatgtgtgtaacctcaaataactcatcattcagcaaacttgtttgaggtcctactgtgtgccaggcacagatgagtaacacaaaccactgatccagactaggctataggaaaggaagttggggatggctcctagagagagttggaatagccacttgagttctcatctcctaaataagtagggtgttagggccaggaaagcactaagtacctttctgtccttattaagttccatggatttgggatgccagcaaatcctttcacctacagatgcagtagggaaaatcagcacagattttccaccccctccagggtatatcaccaagatgtttaaagatgtcaacccgtaattagaattttaaatttggagaaatgtgtgcaggcattttaggtgcaattagcacagtagattaaaatcattttgaagtgacctcattcactccccaaattgcttaaattgattttagaatttcctgcccatgcaantggccagatgaaacatggataactggggaactactaataggtttcagtgaggttacccwtgtcaaccaagggaaagagataaaaactattatagcaagtcttttagtgcatttttttttcaaggctccagcctttttcaatgggcttttgtaggattttccataaacatgggtgcccaagattctgttgtgttttatcacaacaaaacagtcctcatctttgctaagtggcatcactaaataaaacttttaagtttctctatggaaagagaaactataaagccagtcaaaagacagatgatacactgggggaaaacatntgcaacaatgtgacagacaaaaagttaatacccttaatgttaaaaagcctcctggcaagtgtttaaaaaaaaaacaactcagtagaaaaccaggcagttcacagaaagggaaatgcagtggccaataagcttgtgaaaaagggccaccttattggttttcagagaaattcaagttaaaacatcacttaccagattgacaacaattaaataaattgataacatctgttagggaagccccatttccctgcctcatgacttattttgaaagaatattcctgacttctctccccgaccctccttccctcctttccagaagaggattgtgagagaatttgggaaaggaagtgggtctgttggccagtgccatctgggtcctctttttccagctctccttgcctgaattgaggatggatccccatgtgctcctagccatataggcttccctagacaggctgtgcacctgtgatggttgacagctgtcccagtgaaaaggtgggatcatctacttagtgcagaggtgaagtattcgtaagacagtttgattgcagagctaaagacacatcatccaattcagcttttcagacgatattttaaaatctacatttgtgtgactcctatatgtttctttgttggttcagaacttgggaaagaaagagaggaatgtttgtttcctgccctcttcctacccagaaaaaaagaaaaatatgttgatggtcacatgtagagaaatagaagttctttggagatggggggaaattactaagatttgggagaagtcacactatatatgtatatatatatacatatatatatatawcttagtgcgtagtggtgatgactgcataacaacatgagtgttcttttttgcctttttttcttttagattcaggagaggcgtgcagattggctacatgcatatatcacataaaggaggggtttgggctatgtaaattttttttgtttttttgtggtttttttttgagacagagtcttgctctgtcacccagactggagtgcagtggcacgatctcagttcactgcaacctcagcctcctgaattcaagcaattcttctgcctcagcctcctgaataattgggatcacaggtgtgtgcgaacacgcctgtctaattttttttttttttttttttttttttagtagagatggggtttcttcatgttggccaggctgctctcaaactcctgacctccatcaatctgcccgcctcagcctcccaaagtgctgggattacaggcatgagctactgcacccagcctatgtgaatgttcttaatgccactgaattgtatatttaaaggtagttcaagtggtaaaatttatgttatatatattttaccgctatagaaaatgtgtacaagttcagatgaaattattagatttctgacatttgcttcaacgtaatacaagaggatggggcaaatgaacaggcgtgtggaggaatcaagactggccatcatcatgtctttaatcctctcaagcaaataaggagaatcattacaccattctccctagtttctcatatatttgacattttccataataaaaacttgttttttcatgtgtactgctttcaactagcattgtcagttttaggggttccatataaataactgtactcactcataaggatataatctatgaggaggttcattgaaacactgcataggaaaaaatgtggaaatgacctaatgattatgaataagagaatgagtaagcaatagtaaattgtgacattatgaaacagaataaatgaagagaaacagacttacttgtacaacatcaaaaaaaaaaaacaaaaaactgcacgccatctacctaatcctttatttttaagtatgaatagaatcaccaaatatgtgggggaaaatagcaacatgaaagagagagaccaagatacacagaaaaaagtgagccagaggaagcaaaggcaaaccaggacacttcaaacaaagaagagctctcattaatgtgttcagagaactctaaaaaggcataatatttatttaaaagtgatacaaaaacagataataggaaaagaaagagcttttagcttttagagattagacataggcttgccaaaaattcaatagagggggcctggggaaaaataagatgaggaaatagaacagagcatacaacaaaaagagaatgagatagaaacagagaaaagataagaaaagtagaggatcattccagaagctctgacatctgaccagtaggagtctcaaagtaaaaccagagaaaagggcaggaggcagagggaggcaacgatcacagaaataatagaatattccccaaagctgaagaaagacacagctcttcagattgagtggcctaccaagtgcacaggacaatgattaacaccttgattcatcttccaaaaatttccaaacactgagaataagaaaaacatattgaaaggtaccagagagaaaaaactaccaagggataggagttaggttagtaccaggcttatcattagcaccactgaatgctggaaactacttccatgtgatctcagaccagctgcaggagcatcagctagagtcttagaggaaatacagaatcccaggcctcacccaagacccaccagccagaatctgcattttaacaaaatctgcaggtgattccttggcacacaggtgaacattatttacatagtcataatcaagtaatggttctttattgagtttcaggatttcaaatcaacctatgaaaaaagcatcagagtgttgattgtgttggcagatgataaaatacatgttattttgacaaatataaaaagtaaaattgtagttgacagcaggtgggaggtagaaggggaaagataaagtagaaagaccagatgatgtgtcatttacggaaaaagaagtcaatatactaattataaaaatagtatttaaaattacaaatgtaacgaataaaaatataattattaaacattgggagagaaaaggagaaattaagtgagctatatcctcatctttcacagtaggaagtcaatagatattgcctaaattaagtcaataaattgtgatatatcgtatagagttatggaagtaacccctagaagaattagaagagcccctagaagagaaacagaaacagtgaaaaggggatatttttctcatgatacttgtgattcttttttaaagctgagagttaggctcattttcaggtcccagtgaaatgttcctgtgcattgatttagaataacataaaccaactccaaaattttattggcttattgtattaaaacttaacttcctaacagtggtaatccaatgcaggtcatttctggttggaacacagttttcctccaagtggttgattcagggatccaggatacttccttctggagattctgatatcttttgggtctcggagtcctccgcatttatagtgaaagagaacatggaaaaagcaaactcattggttagatgacccagctcagaaatgacatcctcacttccacttttatgtctttgaatagaactaaccatggtcccagctagacgcaaggagagtttataaatgtagttccaatgctgtattgtgaagggtgagcttcaatttttggtgggcaggaactcagttctgccacactctgtatccaaatagccatatataaatggcaggtcctccttgccctctcctcagaaagggcatgtgtatgctgaacattggaaattcaagtgttctttaggtagaaaagaaggtggacgaatcagatttgctttgtgttgtttgcatattttgaattactttcccttgctttgacattatttttctaagcatcttgttgtaattattttcttttgtttagtagatctttcttctataattggatgtcatgtcctctttgtaaatgaatccattgggattatggtgggacagtggaaggaggtgcagaaagagacccagcaacaagctctctagtgctccattaacacatgcatgagtttggacaagccatgcaatcactccactccttggttttcttctctgtaaaatatagaacttgttgggctttgccaacgctttcagttctatatttctgttactttagaatcatatccatcagtgaactgatagtattgaatttctggagcacagatgtgaatgaccacagcctggactagaagttccaacaaaagtataacaactcttagagtcstttttaccactcccacccctgcaatttgtgaacagagacatcactcttgaatagcaaggcttaaagtaaacagaagttgagtaccancatggcagcaagaaacctgaaatgtggtgagaaaattccttcagcagctgaacagaaaggttttgcagggattcagctcatcagcccttcctcaaagcccttcctcagcaagacaggaaggtaaattttctcaggcactttactgtttacaaagcaacaaccactcccataaagtaggcagaatgggtcattatttttattatgtatttggtttttttaataggctcatggttcaaacatcgtaatgtacaaaaaggaatatgcttaaaagcctctatcccatcccagtccccaatctactgttctcattccttccctgcctccaaaagaaatagccactgttattaatttcttacttatcatttcagagattttaatacatatatatcctgtcccctccatcatacatacacagcaatatttattacatgatgatctgagctttaatggatcagggcagttctttctatatctgttatacagatcaccttctttgtgtatcataggattctatccaaggacacaacataatttattttaccaattgcctaatgatgggcattttagttgtttttggtcttttgtgaatacaaactgtgcattagtcatttaaatagccttgtacttaagttatttcacacaattatgtatgaagtatgagtatatacgtaaattcctctgagtggtaattttgatggatactttcaaattacccttcatggaccaattttatagatggaagaaaggttgtaagaattaatgattgcaaatcaagggctgcaaacagcttgmctacttagaagtgtgattttcctgagttggatgtggatgggtatgagtaacacaaggtcaaagaggtttggtattgtacactgaagcaggctgctgtgaggtgggcaagcagagccactcaacaactcaccaaagcacacactgaaataatgaggcttggttgcagcatgctgggaagtcacagcagcagatgtgagcctagtgctatcaatgcatgagcaggcactttgtgagccagaagcccagagtgtggggacgggcttggcaggaggctccagagatagcagttaacacacacagatgtcacagggcgatatttgtgccaggtggtcgggaagcgacctcccatgccagtcaggttcctgccacccacacttggactcattgggtcttagaattgggccagtgataggacagtggccnacttgtggcccacctacatgtcttttaagcttcagttaaggttagttttgttaaagtgaagcagtctcncttgtatattttaattaatggaatgtatacatatacagyttattttgtatagcagcatagatttacagaaaaatttaatggaaagtacagagtactcatattcccccttccccctctgctacacacacacaacctccccagctatcaacatctcttaccagagtggtacatttgttacaattgatgaacctattgataaaccattatcacctgaagtccatagtttacattagggttcactctttgtgttgtgcaatctatgggttgacaagtatatttttaaattcttgttcttagagctacattagcttatttaattcttgcagtatgagccagattgagaagagaaaactgaagcacagtaaggttaagtgacttgcccaaggtcacatagccagtgagtgctggaactgagattggaacctcagtctgaagtctgactcagtgtgcattcttaaccactatgctttcctgccttttactccattccccagttcctagggttctctttcctcttccaactcctcctccaagtgagagaaaagagttctctctgtttttactttccctggcttcacctgagcctcattgcctgtctaagaaatctttgggcaacttctcctactgatttacctacagaggccatgagtgctgaagggcaggggcagtgggtgagctgtggtcatgcaactgaggattgtctgtgggacacataaggcaaaagggaggacaaggctggagtgctggagaggggaaggagcaggtgcaatgacagtgaggggcccattgagacctgaaattagaggacaggggtaaggaatgagggatggaagaataatggagccaggccccttgggagactgaggaccaggcagtgtaggacttggttcataatgtcctattatttaagagagaaaattctgataattgaagggtcttttctttgttgaacagggtgatgaaggagggtgatggtacgcacttttggaagagctgacacagccaaattattctgcaaaagaaaagaaagagtttaggaggcttagaaggaaggactagaactgtcctgtctgtcatggtagccactagccatgtgtaactgtcaaactcgaagtggggctagtccaaattgatatgtgctctagtgtaagatacactatggattttgatgactttgtaggaagaaaagaatgtagactttctcaataataatttttatattgatcatatgttgaaataatattttgaatatattagataaaatattaaaattttctttttaaaaaaattttaatgtgcatactagaaaattttgaattacatatgtgactcacattacatttttttctggactgtgatgatccagaagggagagacatgaaccattaagactcacgactatgtaggatagaggggcaaccctatggctggtgactgagaaggaagactttggaaaatttaaccaatacagactttttttggaggataagtggtgtggtatgtgatataatctcccacctcagtcttccctatgctatcttcagtaagatcaacactactttaaaaaaattatattttagatgtagggtgtacatgtgtatgtttgttacatgggtatactgcatactggtggggactgggcttctggtgtatccattacgcaaatagtgaacattgtaccagataggtaaggttttcaaccgtcacctttaccaccctctcctcttttggagtccctggtatctatagtttccatcttcatatccgtgtgtacccactgtttagcttccacatgtaagtgagaacatgaggagtttggttttctgtttctgagttagttcacttagaataatgactatagctctatccatgttgctacaaagaatatgatttcattcttttttatggctgcatagtattccatagtgttgcatgtgtgtgtgtgtgtgtgtgtgtgtgtgtatatatatatatatatatatatacacacacacaacttttttcttaatccagtcaaccattgatagacacttgggttgattccataactttgctattgtgaatagtgctgcaatgaacatataagtgcatgtgtctttttaatatgataatgatttctttttctttgagtagatttccaataatgggattgctgggtcaaatggtagttctatttttagttctttgagaactctccatactgttttccatatagattgaattaatttacattcctaccaacagtgtataagtgtttgcttgtctccacatccacgcctacatgtgttgttttttgacttaatgatagccattctgattggtataagatgatgattaacgatgtgaacatttttttcatgtgtttcttggccacttgtacttcttttgagaaatgtctgctcatgtcatttgcacagtttttaattgagttgtttgcttttttcttgttgagttgtttgagttccttgtggattctggatattagtcctttgtcagaggcataatttggaaatattttctcctattctataggtggtctgtttaatctgaagatgaacattatttttaataaagcaaattaaaaagaattttctctggaagctcatgtcttcccttgaggtgactgaaaggttgtggatcttcaaaaccacatttggattttactgatcttcccttattgggagccaaaatgaaattagtgaactagaagagtataaatgcagataccatatctctttacattctgatcaacacggccaatgaactattatgggtttccagattatcgacttgtcatttttaagaaaaaatagtttttgcctttccccacattatatttcttttcctgttcactttttgctaacatgactgaacttagagaattgattgtcttgggaggctttgaatcattatgggatttctggctcatcaaattcaaatttaaggcatctccattgttgctacctaatagttgcttagtggattttgttctttgggagttgtgaagctgaattgtcaggaagtgagccttcctgaatgtggctgcttttmatcatttagtytagccctagcatagcagatttgaggcataaccaaaaatatgtttgaggattatgaccagcatagtctttgctgctttcctgatctatgaatacaaagaagctcaggaacaagaattcaatctgaagcttcataattaggattgcagctgatattctggtataaatttggagaaggaagatgctagaagaagctacagaaaacttgagagaatagagacaggcaagttaactgacttttaatgagccaaataatctgtaaacataacaatagcagtaaatttgaagtgaygtggtctcaaaaaaaaagactacattttaatgaattactgttcaattcgttatttgcctgatatcactgttttcatctcctttggcagtgtgaattaatgagcctctgaaaactaacatagcttaactgattttagagacttactatccttaatactgtagtgttgtgtgtgtgtgtacgtatgtgtgtgtgtgtgtgaaaatggtacagattgattgtacctggtgatttaataccctcgcccccacttagtgtagtgtagcaatagagataacagtagaaaggaagttgtgtaggagcataaaaaagggattgtaacagaataaaaataccaagtttgtataaccttcaataaattatgaattatgtaggtatttttgattttataccaaggcatttcacaaaaattcagatagacttttaattggctttaatttccagagactgtctcttgagttttctgtaaaatttgcaagatctcccctctgagtttcagtgattgccttaagcttatttcatgtattttattggaatcagaatgataaatgaatgattggattgttaaagtgctagacaataagaaagtctgcataaattcaaaattttctctttaatcaaaggctgggctgtgatcagagctttgtggttggcactactgaattaatccaagtggatgaattaattttcctgcctggttagtgttagcaaaaattatacagactgcaaggtgggataaaagtaatgaacctgattctgtagtcatcacacaataatataaatatattcacccaattggcttctgtccttttattttctctgtgaggatgaaggcttatattaaagatgtggccactagccaaagcaatttttaaagccatcttttggaattaacttcagagcttatgccagagtctttttaataatcttggtttgatgcacatcttcatcttttagggatatacttgatatttggagaacatcaaaaagcgttcacagccaaatcttctaaataaggtgcatgatattagcatgatattacctggatgataccctttaaggtaaaaaatcagatataacaaaaaatgattatagaatattgaaagtgatttgctggtagtttcaaagcccaaaaattaacttcgaaatcacttccaatataggagtggccaaagtgttttcagcaaacacagtgcccttggaacttgtaagtatagagtaagtatagagtcagccaaggtgactattctaaaagggattacaccaatttagatgtttgtttaaaaaaatcaattgtatcactttatgggctcagtgtaatgtaataggaagagcacaaacagtgagagccaggcagatctacctcctccacccctttcagctctaagtgaccttggacaagttatttaagctgcctgagcttctgcttcataatcagaaaatgcagataataattcccactgggactgttgtgagggctagaaatatagtaagtaaaataccacatatattggcctatgcatagttcagtatttgtgttttgttgtttgattaattgatctatacccagcttcatttcaaaatagatcaaaagtagcttaactgcttgttttccaaccctacatagccttatttaggaaataataatattaataaatgtaccatgtgttcaagtcatttatattaacatttttttcacaattttttaaaatgtcaacttttagattcagggggtacatgtacagatttgttatctgggtatactgcatgatgctgaggtttgggatgtgactgatactatcactcaaaactgagcatagtacccagtaatttttcaacccataccctcctctgtccttccccactctagtagtccccactgtctattgttaccatctttatgtccgtgagtacccaatgtttagctcccacttgtaagtgagaacatgtagtgtttggttttctgttcctgcattactttgcttaggacaatggcctccagctgcatgcatgttgctacaaaggacattatttcactctttttcatggctgcatagtattccatggtgtatggtgtatatgtcccacattttctttatccagcccaccattgatgagcacctaggttggttccatgtctgtgctatggtgaatagtgctgtgatgaacatacaagtgcatgtgcctttttggtagaacaatattctaccgagaacaattgacttttggatrtatacccagcagtgggattgctgggtcgaattgtagttctctgagaaatctccaaactgctttccacagtggctaacctaatttacattccacccaacagtgcatagatgttcccttttctccacagcctcactggcatctgttgttgtttgagtttttgtaacagccattctgattgggtgaagtgctacttcattgtgggtttgacttgcaattctctgatgattagtgatattgaacattttttcatatgtttcttggccacttgtatgtcttcttttgagaagtgtttgttcatgtcttttcctcgttttaatggggttatttggtttttgcttgttcaactgtttaacttccttatagattctggattttagacctttatcagatgtatagtttgcaaatattttcgctctttctataggttatctgtttactctgttgttagtttcttttgctgtgcagaagctctttaatttaattatgttccacttgtcaatctttgtgtttgttgctattgcttttgaggacttcatcataaattctttcccaaggctgatgtggtgtccccaagaccaaatgatgttttctaggttttcttctagaagtcttatagtttggtattttacatttatcttcaatccaccttaattttttgcatggtggaaaataggggtctggtttcattcttctgcatatcactaggcagctatcctagcaccatttattgaacaaggagtcctttccccgtcgcttatttttcttgacttcgactgaagatcagatggctgtaggtgtgtagctttctttccgaattctctattctgttccattcctctatgtgtctgtttttgtacaagtaccatgatgttttggtccctgtggccttatagtatagtttgaagtctggtaatgtgatacctctggctttgctctttttgcttaggattgctattcaggctcgtttgtggttccgtataaattttagaatagttttctctagttctgtgaaaaatgacgttggtagtttgataggaataacattgaatctgtaaattgctttgggtagtatggccatttcaatgatactgattctttcaatccattttaccctttgtttgtgtcatctatgatttcttttagcagtgtcttatagttctccttgtagagattgttattctctttgcttagatgtattcctagatttttggggggtggggggcacaggtatttgaaacggaattgagttattgatttggctctcaggttgaacgttattggtgcatagatgtgctactgatttttgtagattgatgtcatgtcctgaaagtttgctgaagttatttatcagttctaggagccttttggcatagtctttagggttttttagatatagaatcacattgtcagggaaaagagagagttttgacttcttctttccctattttgatgcctttaattagtttctcttgcctgattgctctggttaggacctccaaaactatgctgaataggtgatgacggtgggcatccttgccttgttccagttctcaaaggtaatgcttccagtttttgcccatttagtatgatgttggctgtggttttgtcatagatggctcttattattttgaggtatgttcctttgatgcctactttcttaagggctttttatcatgaagggatgttggatttcatcaaaagctttttccaagtctgttgagatgatcatatagttttggttttcaattctgtttatgtggtgaaccacatttattgatttgcatatgttgaaccaaccttgcatcccagcaatgaagcctacttgatcaaggatcactttttgatgtgctgttggattcagtttgctggtatttggttgaggatttttgtgtctatgtttgtcaaggatattggtctctagttttctttttccactgtgtcttttccaggtttttggtatcaggataatggctggctttgtggaatgagttagggagtcccttctccataatttttgtaatagtttcagtagaattggtaccagctctttgcatatctggtagaattcagctgtgaatccatctgttacagggttttttttttcagttggtaggtttttgtttttttttgtattactgattcagttttggaacttggtttgttcaaggtttcaatttctttctgattcaatttttggagagtgtgtgtttccaggaatttatccatttcctctagattttctagtttgtgtgtatagaggtgttcataatagtctgtgagtatctattgtatttctgtgtgattggttataatgtcacttttgtcatttccgattgtatttatttggatcttctttttttctttgtttacctaggtagcagtctattaatcttgtttatcctttcaaataaccaacttttggcttcactgattctatgtatagatttttgggtctcaattttcttcattcttgctctgattttagttatttcttcttttctgctagctttggggttagtttgttcttgtttttctagttcctctaggtgtgatgttagattgttaatttgagaactttctaagtttttgaggtaggcatttagcactataaactctccttttaacactgcttttgctgcatcccagagattttggtatctgtgtctctcttttcatttatttcagagaatgttttgatttctgagttaatatcatcatttacccaaaagtcatttaggagcaagttgcttaatttccatgtaattgtgtggttttgagagatcttcttggtattgatttctattttattccattgtgatccaagaatatggctggtatgattttaattttgatttttttgaattcatggagacttgctttatggccaagcatgtgtttgatcttggagtatgttccatgtgcatgcagttgagaagaatgtatagtctgtggttaatgggtgaagtattccgtagatgtcttttaggtccaattggtcaaatgtagaatttaagtccagaatttctttgttagttttttgctttgatgatctaacactgttagtggggtgttgaagtcccctactactattgtatggctaagtcttttcataggtctagaagaacttgttttatgaatctgggtgctctaatgttgggtgtgtgtgtgtgtgtgtgtctatatatatatatatatatatatatatatatatatacatatatatatatatatatacatatatatatatacacatacatgatagctaagctttcttgttgaattgaaccctttatcattatgtaatgctcttctttgttctctatcactgacgtacacaaacttctctctgtgttaagatggtatgatgccttttgctcttttttacattgcatttgccttatgtctgacccttcttctaacactacttctgaatatgctaaaagggacagtttattggaaatgctcatcaatgattgcttaaggaaagagcaactaaagtaatttacagcctccccttctatcaatcccaaatcaacacgagcctctgctacacattatgagatacctggattcaactgctgaatcatgaactattctatttctaaatggtgcactgaagtggaattccctctttttgttcaccttttccacccaagctgtggaacattctagaaccatagaccagaaagccatctgtgcttcaccactggtaacgtggagaccctcatcctgtagccaggatgccacagcaccccttcttcatgttttgcaggtgtccctgaggaggggactattctgcatgtgtcttccaggtcatccaacttttttgtagaggaagagagattttcttccatcagccgctcttcctctatttgcctctgtcttcctccagaggcacatgggtcatcatcaaggacatttattagatgatgtcacttctttcctaagcttgcttaggatgctcactagctcatgaaatccagaacccataagaacagcagcacttaatatgagtcacaaggtgttacaattgttgtcattgttttaactctgggctgcttttgtatcttgagtatatttctattttgcacytatcaccaggtatcrtaactgtcagagctgtctgccctaaaccatagtttagaaacttttacatcccctttgccttgcacagtgactggtacatgtctgataaatgcccattggattaacacactcagatgcaggagaatgttgaatcatttgcattctttaggcacttaaagcattagaagaagttgaaggagtttgcatgagtgaataagggcagcaaagatttaagatagaaagaagaaatgagttcttctccaaaggctgatcatgccaatgtctagaagtctataaggccccaactattgggtgggasgggtgggggataaagatttttcctttttcagttactaaaaattccttkaccaccttctgtataccctctgtgcttggcatcagaaaatcaaagatacatgacaaaacatctttttcttaaggacttgatacttacaaagaattaccactcagaatgatagaagccatgataaattttatatatatacacacacacatatatatatatawaatttatatatgtgtgtgtgtgtgtgtgtgtgtgtataaaatggtgtgagtatgtgtgagacggagagagaaagggaaagggagagagagaaaaagcacagcgggcacaaagggaggcttagttgggccttatcaatcccctgcttaaactccccagtagcatgccaccacacttgaaataaaatccacatcctttaccatgatgtaccagaccctgcccaactcagcccctttccatctctttgtcctcatcgcccatcacactgtcccttactcacgccacacctgcctacaaacattatttctgtccttgaacacagctgatcctttctcacctcaaagcccttgccctcagatcttcacaaggccacctctttcttgattattcagacctcaactcaaatatctcattctttgaataatatctacataatgtcctctcctcagtcattttctatggcgttactctgttttgtattaccttcataaaatgtttccctatgaagttatcttgtttacttacttacataattattgtctgcccttttttccctctgancccygacccagtgcactagaatggggacttcctgaaagcagggaagcctcctctggcttgctcactgttctgccccagtgcctcgaatgtgcctggaggctggcacctaattaacattcatcaagtatgaatgtggcctggggaagacaagaaagattcaccaaagaaaagttataggttaaaatatgccatgaatagggagggcagttagggccaacaccaggactttggctgttagaatgcagggtgcgggatgaagtgtggagatggactaaaggggtgaagcatcccaaggtctttgttggccaggaataggactcaagagcccagaccccagagctagagtgcaaagatcaaatgtcagggggcctcccttaccagatgtgtgacctgggacaatcacctaacctttctaatcacttgtttcttcattttcagaagagctgataatggcagtactcttcattagctagtgtgaaggttaaatgtgtcacgtggaaaatgcctagtagtacctgggacatagttagctaagcatttatactgtgccctagaagggaatcactgaagagtttgaggagtagggttatgggattcagatttgtattttttaaagatcatcaggctggcagtggggaggatggactggagggggctgataaatcagagtcaaggaaacaaccaggtagtcaagacagaccaagacaaagcagtggcagcaagactgatccaagagttattaagacagtggactctggcatcagtttgaggagggagataagggaaggagatgattcagtgggtggctggtggtaccatttgcccatatgggaaatacaggagggaacccagtttgagagcgagggtgggtagggaaggtgaggaggtgtgatttcttcagctgtggctggctgagttgaagtgttatgggaactccaggtggagcttcccagagagaaaacccccacatctttctgatcacaatataaccctaatatgattagcattgtacttatcagtacctaataaatattagcgcttaatatttggtgtttaaaatttttgcttttgaagaaaatactgtgagaaacatttttgtccacattcaagttttttcttttagacttctatatgtagaattactggggcaaaaggtatgttaccttttgaagaatttaattcatcttgccaaattgcttttcaaaaattttgtaccaataatatactcccacaataacctaggatttttaaaaagcagcttaaatgttttttataaataccactcccaaagttgccagcgtatggagaacagtcctcttgtgtgtagggataaacctaagcatcaacttcggctccttccttaaaagttgacaattgcctttttgtcctagggaaacccccaaagtcaatgtctgttattcattaacatgttgcaataccacaacccaaatcatattcttggaaacatgatggtgtgtaaaatacaaacactgtatgtgtaaatactcccgtgaggtctgtggatgggggtataaggagaaggtacttagtgaacaaaaagatctattgtaccaaaactacattaacactatcttccaccaccccctgccccaccagagaacttcctttaccacagtttagtgtatatacacgcaaggaagttccatttcctttgaatcaatacatgggttataagagggcaccattcaccgattttaacccagaataagctaaaatttctttttaatacatatgtcaatagattttcatcaagctaaagaacagccattttccctgaaggcagcattttggtcagttccacatatggttatcatgaattgttggtcattcaggtactttctgtggtttttgttactgtttttcttacgctgaccacacacaactgtgacacctctgggtaacagaacccaagaaagtctgtgatatgtttgctatccctttctgtgaatgctcactttgtgtttattagaattagatttgtaccttaagaacccaatgtagatttaatgaaggtttatctgttgtctttttgagaaagtccttatgaaggcaacttgggtatgatgttcttgtccatgtgttgtattgaattgaatatttgttttgtgtttcttataatccactggaggcccgtagcagcaacacttgctgcttctgtttagagcaggggtccccaaccactgggccatggaccagtattggagcatgaactctattgtgaactgcacatgcaaaggatctaggtcatgcactcttatgaaaatctaactaatgcctcatgatctgaggtggaacagcttctaatcattccccaccccaccctgctgctggtttacagccttaaccatccatcaaggtttgaagggagattcatacttgcttttggagactttcttatacttagtccacagtcgctgttctcaggagttaatgggaggagcccaaaatttttcaaaagaggttgggtctaatttgtatcaagtgggacttatgtcaagtagcgaagcaataaagattgttcatctcttgtaaaccgtgattcttttcttctagcgagaatcagtcaggggtggatccatcaaagaatggggaagacatgatacttctgcttgaatgtggacttggtagctccaaaatgatctcctttgttattgggatggtcatcaatgcttgaaggaaattgctgtggttgtgatggggagttgagtagaatataatgcatctcactactagagagtccatcagatgtccctggtcctcctggggttgtctgttatnatatttaagagttcacttcccatccattgtgtccrtttgtaagaaaggctctccaaaagaacataatagcaagtttacacatactgttgagcctatttaccatagggatctcaaaatcataggggtcctgcctgttttgttgtggttgtttacattctttgtgtctatttctatatactgcacagattataccataaagctattttgtgataagaagaattgaragagactgaaaccaaatctttctctcgagctacaagtttctctgaaaatagaaagagacctacccatatttttaaaaaattacacctgttatccagttctagctataatggcaactcataaaatcttagaattttagattcaggttacatggggaaagtgaatatagtcctcccttggtatccatgggggttggtttcaggaccccagtggatataaaaatccattataaaatggtatagtatttgcatatgatctatgcacatcctcccatatactgtaaatcatctctagatttctcataatacctaatacaatataaatgctatataaattgttgttatactgtatttttacttgcattattttttattgttgtattgtgttggatwttttyccctaatattgtcttccgtggttggttgtatcctggatgctgagtgtgcaatagggaagcctaactattagaaaccagctgctatgtaacattggcctctaggaaaaagtgtctcctggtcaaacaagttagggaaaccctgtgtcctgcatcttcctccttctggatattaacaatgaaaagtcaactgtaactcagcattttccaaacttacttgaccaccgagtcttttttaccctatataatagctgttaacatcctgcatgtaggaaatgagtccagtcacaccgtggaggtccagaaaattaagccacttgcctgaggtcacaaagtcagtaatgacagaaccggggcgggaccmcactgctggctgatagcctctctcagaatggcttcaaaaggtgttcaagattatgtttctttgaaattgatntaaagagtgatttctaaagttgtaggatcctagtttaatttggagagatttatctgttagcagatggaaaatgtgtcagttggcccattcaatttagtagtactctttattcagatgcatcagaaatgggacctgaatcgtatgcgtggtggagaacaaaacgttcctgaggcgctcagtgtgaggggtgggaamggagaaaggcaataagcaattaaacaagtagatatgtaattacaaattatgatgcgtgctatgtatgtgctgtcagattgaacttaaatttgcagtctttttttaattgacccagaactaaaaggaatcaatagcagttgtttttatggttatctgaatactcagctcataacgactgtttgcaccacgtgacagcctctccccttcttgtttttycagcccagtggagcaaaatgagagcgcagtgagccgggcccagcttctctcctagccgttccgactcccaccatgaaccacttggaggggtctgcggaggtggaggtgaccgacgaggcggcaggtggggaggtgaacgagtcggtggaggccgacctggagcaccccgaggtggaagaggaacagcagcagccgccgcagcagcagcactatgtgggccgccaccagcgcgggcgagccctcgaggacctccgcgcccagctcggccaggaggaagaggagcgcggggaatgcctggcgcgctcagccagcacggagagcggcttccacaaccacacggacaccgccgagggcgacgtgatcgccgcggcccgcgacggctacgatgcggagcgcgcgcaggaccccgaggacgagagcgcctatgctgtgcagtaccggcccgaggccgaggagtacacggagcaggcagaggccgagcacgccgaggccacgcaccgccgcgcgctgcccaaccacctgcacttccactcgctggagcacgaggaagccatgaatgcggcctactcaggctacgtctacacgcaccggctcttccaccgcggtgaggacgagccctackccgagccctatgccgactacggcggcctccaggagcacgtgtacgaggagataggggacgcgcccgagctggacgcacgcgacggcctgcggctctacgagcaggagcgcgacgaggcggccgcgtaccgccaggaggccctgggcgcgcggctgcaccattacgacgagcgctccgacggcgagtccgacagccccgagaaggaggccgagttcgcgccctacccgcgcatggacagctacgagcaggaggaggacatcgaccagatagtggccgaggtgaagcagagcatgagctcgcagagcctcgacaaggcagccgaggacatgcctgaggccgagcaggacctggagcgtccccctaccccggccgggggtcgccccgacagccccgggctgcaggcgccggcggggcagcagcgggcggtgggccccgcgggcggcggcgaggcggggcagcggtacagcaaggagaagcgcgatgccatctcgctggccatcaaggacatcaaggaggccatcgaggaggtgaaaaccaggaccatccgttcgccttacacccccgacgagcccaaagagcccatctgggtcatgcgccaggacattagccccaccagggactgtgacgaccagaggccgatggacggagatgtaagtaggtgcgggtttgggcttcctcggccycacgcggtgggagggaagatggcgccccatggccttgtgtgcccttgggtagtgactttacgggaagtagtctgtggggacgctaagaacttttccaccgtaagcctcagaaacagcttgcacctaaactgtcaaacgccagcgggagagaattaaagtgttgaatgcactcatcagattcttagcaggatggcctcaaatcagtgcttcccacactgtgcctggagaccttgtgagaaatgcattattgggtacatcgccctccaccccccgcccccccccagtttctgattcagaaagtatggagtggggcccgagaatttgtatttctaatgccaaataaaaaacaagccatgcttgaggaaggagagacttcactggaaaggattattgcaaaggggagaaagatactgtttcgttttagggaggaaggactgttgccatatgagaacctctgaccttaagatctttaagggtctctagagttaggtacaagggggaagttgttttatagggaggagtagccaagtagaaagaatagggtatgtgaaagtggcatgaaaagggtgggagttgaatgtgctgtggatcagagaatgtttccacctgagaccagcgttttctcaggagtggttgtatgctggccaaagttcacgcacctggaggaaggagagacacttaaccaaagtttggttagcaagcagttcagctgatcgtttgtgaagaaagaatgggaatgtggagggtctgcgtctggccttgtcataggaaaacaagaggagcatccctatccctgctctgtgtcagaaaagaaggagtttcccagaacacaaaaggttgggggtatttcttcattttgtttctctggttctcaggtaaagttcaacgttgtcactaacaagttctcatgcgatgctcctggtcccaggacgacaatttgagaactgccttatatcaatcccttgaagatctgggatgggtagtgtgccctctttggaggatagccttccaagcctttttccgccaggggtttctgcagttttgtttatttgttttgttttgttttgtgacggagtcttgctctgtcacccaggctggagtgcagtgatgcaatctccgctcaccgtaacctccgcctcccaggttcaagcaattctacctcagtctcccaagtagctgggattacaggcaggtgtcaccacgtccagctaatttttgtattttttagtagagacggggtttcataacgttggccaggctggtctcgaaccgctggccacaagtgaaccactcacctcggcctccccaagtgctgggattacagatgtgagccacagcacctggccggtttctgcaattttttttgttttggtttggttttttgagacagaatttcactctttttgcccaggctggagtgcaatggtgtgatctcggctcactgcaacctccgcctcccaggttcaagtgattttcctgcctcagtctcctgagtagctgggatgacaggcgcatccactatgcccaactaatcttgtatttttagtaggagtggggtttcaccatgttggctaggctgggcttgaactcctaacctcaggtgatctgcctgccttggcttcccaaagtgctgggattacagatgtgaaacaccactcccaggctctgcagtttttttcacccaccctatgcctcattgtggtaggtgcctaatttttcacatctggtggtatcagggtatccttcccacttcacaaaagatatgtattctgttttaaagcaaattgtgtttcattgtgaagagctacacaaagtaactgatgccactattgacattttccatttttgaaatacctaagaaatgtgataacatggcaagcttaggtgtcacaatctgttcagaatatatcaggaagactaacctttgctctgactcgtttgctataaagattctctctgcttctactctccctttccatactcttgaataattttgaagcctttcatttaaaaatggatcttggagtaagataagggtcaagagcttatattcaatttcatttaattctgcattttatgattgcaccaggccrtttctcaatatatatctttggagtgagaaaccattattgtaaggtatttgttcattttacttacacataaagagctacgcaggtcagagtggtagcattcacctcctctttraggaatagtcagcattttctgttagccgattaggaaaggttggaaaccagtagggaagggaacttcattctccccagcaaggggacagcattgggtcagtgagctcagacatgtcctgtctttgttttctaggcttctgatttagtgaaaaataagtgcactcacgtgtagaattctccttgacctccagctgtctccagattcctcccagctaggagggattgcagcaagcattttgcaaatgaggtggaaatagagcaggttttcaaaagtagggagttgacaaaaggctggcttctgtatccttttagaaacctggaaagccaccagaggaaaaagctgcaggcacagttggtccagatgctggcctcttccttcagctttctccagtgcaccagctccttgaaatgacctgcttaaccaattgcccctgcagcctcacagtgagcccacagtacagcctatggtagggttagaggctggcttttattcatttgaactaggagaacaacttaattctcttgcatgctgtttcattcaaaaggtgaaattaattatagaacattgtatgatgctttaggaaccaaccatgtcagaaaatcagcttgatgctaagaaatcaatatggatcactgggttatgaatagttaatataaagtgaaactgaaaacctgtgctttaaagtattccagcagtcatttttaagctatttgtgggttgtatttmatctgtcatgccatatttataggaaagaccttcctttgctgcctctttaatggtctactgagaatataatgatattatattctgttgatttccatctcagcatcaaaaaatatttactgaacactagttctccatgtatgctgttatagaaaatggaaaggtgttttaaaaccatgtgatctgaagtctgtctgggtggtacttattagaaatgcaagttactgcccttcgtttccaaaccagaatacctgatgtgggtctcagtgatctggttgtttcrttttattttattttgttttgtaaactttccctgagattcgtaagcatgtgaaagattgagaactactgatttaaaggaaaaaatgtattatctgggcactttcccyatgtaagtgctgtggatataagatttaactaaatcttttattagcacagataaagttttaacaaaaagaggtatctcactgtgattatggtcagcagacctggagaaatggtattcttacaaaagcagaattttgagtatttgcattctcaaaatggcaagatcacaaactataatgaagcaaataaaaggagacaaaaaaacctgtattgccatttgtcagccaccgttgctaattgctaaatctgtttttaacactacttttaattcccccagaacttaagtgcttttttcttggagcaaactggcatttgtttgctggtgagttgtatatagagagaaaatgggattgctaatccataagagtttactgaacactctctcagcactgagagaaaataactgtgttctaaacatttgaaaaaaatacttatgtgattttcttctagtaaggagtttcacttttctaaatatatgcctgagaagtatctcccaatccccttcttgaaaaatattgataatgaagacctgtcctttttcttttcttttctttttttctttttatttatttatttatttatttattatactttaagttttagggtacatgtgcacattgtgcaggttagttacatatgtatacgtgtgccatgctggtgcgctgcacccactaactcgtcatctagcattaggtatatctcccaatgctatccctcccccctacccccaccccaccacagtccccagagtgtgatattccccttcctgtgtccatgtgatctcattgttcaattcccgcctatgagtgagaatatgcggtgtttggttttctgttcttgcgatagtttactgagaatgatgatttccaatttcatccatgtccctacaaaggacatgaactcatcattttttatggctgcatagtattccatggtgtatatgtgccacattttcttaatccagtctgtcattgttggacatttgggttggttccaagtctttgctattgtgaataatgccgcagtaaacatacgtgtgcatgtgtctttatagcagcatgatttatagtcctctgggtatatacccagtaatgggatggctgggtcaaatggtatttctagttctagatccctgaggaatcgccacactgacttccacaatggttgaactagtttacagtaccaccaacagtgtaaaagtgttcctatttctccacatcctctccagcacctgttgtttcctgactttttagtgattgccattctaactggtgtgagattgtatctcattgtggttttgatttgcatttctctgatggccagtgatgatgagcattttttcatgtgttttttggatgcataaatgtcttcttttgagaagtgtctgttcatgtccttcggccactttttgatggggttgtttggttttttcttgtaaatttgtttgagttcattgtagattctggatattagccctttgtcagatgagtaggttgcgaaaatttgctcccattttgtaggttgcctgttcactctcatggtagtttcttttgctgtgcagaagctctttagtttaattagatcccatttgtccattttggcttttgttgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttatttttctcaggtttgtcaaagatcagatagttgtagatatgcggcgttatttctgagggctctgttctgttccattgatctatatctctgttttggtaccagtaccatgctgttgtggtgactgtagccttgtagtatagtttgaagtcaggtagcgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctgtgaagcaattgtgaatgggagttcacttatgatttggctctctgtttgtctgttattggtgtataagaatgcttgtgatttttatacattgattttgtatcctgagactttgctgaagttgcttatcagcttaaggagattttgggctgagacagtggggttttctagatatacaatcatgtcatctgcaaacagggacaatttgacttcctgttttcctaattgaataccctttatttccttctcctgcctaattgccctggccagaacttccaacactatgttgaataggagtggtgagagagggcatccctgtcttgtgccagttttcaaagggaatgcttccagtttttgcccattcggtatgatattggctgtgggtttgtcatagatagctcttattattttgaaatacatcccatcaatacctaatttattgagagtttttagcatgaagggttgttgaattttgtcaaaggccttttcttcatctattgagataatcatgtggtttttgtctttggctctgtttatatgctggattacatttattgatttgcgtatattgaaccagccttgcatcccagggatgaagcccacttgatcatggtgtataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctcttgattggaatagtttcagaaggaatggtaccagttcctccttgtacctctggtagaatttggctgtgaatccatctggtcctggactctttttggttggtaaactattgattattgccacaatttcagctcccgttattggtctgttcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcctctctctttttttctttattagtcttgctagcggtctatcagttttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgagtgcgtcccagagattctggtatgttgtgtctttgttctcgttggtttcaaagaacatctttatttctgccttcatttcgttatgtatccagtagtcattcaggagcaggttgttcagtttccatgtagttgagcggttttgagtgagattcttaatcctgagttctagtttgatagcactgtggtctgagagatagtttgttataatgtctgttcttttacatttgctgaggagagctttacttccaagtatgtggtcaattttggaatagctgtggtgtggtgctgaaaaaaatgtatattctgttgatttggggtggagagttctgtagatgtcaattaggtccacctggtgcagagctgagttcaattcctgggtatccttgttgactttctgtctcgttgatctgtctaatgttgacagtggggtgttaaagtctcccattattaaagtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcctggtagatcttcctccatccttttattttgagcctatgtgtgtctctgcacgtgagatgggtttcctgaatacagcacactgatgggtcttgactctttatccaatttgccagtctgtgtcttttaattggagcatttggtccatttacatttaaagttaatattgttatgtgtgaatttgatcctgtcattatgatgttagctggtgattttgctcgttagttgatgcagtttcttcctagcctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccactgttagtctgatgggcttccctttgagggtaacccgacctttctctctggctgcccttaacattttttccttcatttcaaccttggtgaatctgacaattatgtgtcttggagttgctcttctcaaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatacttcttggaggctttgctcatttctttttattctttttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttccttgcctttggtttgaatgtcctcccgtagctcagagtaatttgatcgtctgaagccttcttctctcagctcgtcaaagtcattctccatccagctttgttctgttgctggtgaggaactgcgttcctttggaggaggagaggcgctctgcgttttagagtttccagtttttctgttctgttttttccccatctttgtggttttatctacttttggtctttgatgatggtaatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggctactgctgccttttgtttgtctgtgccctgcccccagaggtggagcctacagaggcaggcaggcctccttgagctgtggtgggctccacccagttcgagcttccaggctgctttgtttacctaagcaagcccgggcaatggcgggcgcccctccccgagcctcgctgctgccttgcagtttgatctcagactgctgtgctagcaatcagtgagactccgtgggcgtaggaccctctgagccaggtgcaggatataatctcatggtgcgcggttttttaagccggtctgaaaagcgcaatattcgggtgggagtgacccgattttccaggtgcgtccgtcacccctttctttgactcagaaagggaactccctgaccccttgcacttcccaagtgaggaaatgcctcgccctgctttggctcgcgcacggtgcgcgcacccactgacctgcgcccactgtctggcactccctagtgagatgaacccagtacctcagatggaaatgcagaaatcacccgtcttcttctgtgtcgctctcgctgggagctgtagaccggagctgttcctattcggccatcttggctcctcctccttttcttttttttttcttctttttctttttttttagatggagtcttgctctgttgcccaggctggagtgcagtggtgcgatcttggctcactgcaacctccgcctcccaggctcaagcaattctcctgtctcagcctcccaagtagctgggactacaggtgcatgccaccatgcccatctaatttttgtattttttagtagagacggggttttgccatattggccaggctggtcttgaactcctgacctcaggtgatccacctgcttcagcctcccaaaatactgggattacaggcatgagccaccacacccggcctgaagaccagttctgaaaatccacagcctactgatctgtctataggcaacagaatcattcgagaacagagtcacagtagactcagggagattgatgttagcaagcacacagtgtaagttggagggttttggctactttaagtggtgtggtgtacagcttgaaatggcgtttatctctgctccatcctagaattgcagtaaaataataaaaagcacaaacactgacagaggaaacagcaacagatgagcacaacaaaatttggcaacaccctagtggtaactggctgtgatggaggagttagtgtgccccaggatttccagttctcttattttttcaaacatggagaagactgcacttcctcatcctctagaagttaagcgtggccagggaaacgtgagccctgaagttgcttccaagcgggagcagctaagacaatgctttcttccccagtggaaataaaccccaaagccttatgttaagggagcagcctcacaagatggctgtgcgcctgtcagcacaggtctcctgaaaccacaatgggtagggcttcctgggacatgtactctgagagaggaatcaacctttatcattttaagccacagagatttttggggtggtttgttatcaccgcacagcctggtccatcctgactaacacactgatgaggtttctgttttctctcttctgccaagtgtttgtgaggatgtgtgcggtagacgccccccaacaaaggcccaagaattagagacacagatacctcaggtggcagaaatatgaggggtatggctgaaaaagaagaggattatttggaagcctgtcacaggagacattaaacttcctgtgatgccttctccaatgcatgaagctaggcgactcctcctccccgcagaagatgggaggcttctgtaaggaaagggtgaaccagaggagcactgaaactggggacatggcaagagttggaaatggaaacaaggtgccctggggaacacacggcccactaagcagtgagacccggagaataccttacaactcttagttgtcaggcttagaatccaacccactcaggatccctagtccccaacagatgagtgtattcctctctgaggtaacaggcccaagagaaaatactacagatactaatgtttgggggtttcctagtataccacctggctttccacctgatcaccccatagtgacggctcttgcatcataagtacatggtcttccaataggctttttggggatttactcttaaatatgagtgaacagccaaggatcatcagacatttaaagaacatctctaacatgaaagacaaagacataaagcaaatggaaagtcgcttggagaaatcaagacagcaaaattgaggaactcttcaaaacagtaaaacaagtatggcaaaaaggtggaaagtagtaggaacaaagataaaacagaaggggaaattatgaaagaccatgtcctggagccaaagaacacatgaacttccagattaaaagagtctactgggtacctatctagaataatgaaatagaaaagactcacagaagtttcagaacaggagggagaaagagaagattttacaggcttcagagaaataaaaacaagaatgatcaggaaacacaatgatgttggacttttcacaagcaatactggaaactgggagacttacagccagtctatcttcayttcagtttgaaggtacaataaaggtgtttttagacaagcatggtcccagaaaatttacctcatatgcaccctttctcaggaaactaccagaggattgctcttcttgcatggtagcataaaccaagaaaaaagatgcaagatccaggaaacgggggacccaacctgggaatgcagcagagagaatctccaggtgayaggaaaggagatcccaggatcacaaccatgcagaagtccaaccaccaatcccatgtggcctgccgctcagagggctccagttaggcagtctctagaaagagtggaactgagagatttcctgataaatttgtgccaccaggagttttaaatggttttaggagagcttggcataaattattgatcagtccatagaagactaagcaaacggaaaaacaattccattatttacctcagtaaaagcagttgttatattggcaagaaatgcaataataatatgcgttgtagctcagcagggaagagtatagtcttcagaacacaagcactgaatattgattaaccagaaattgtaatattgagaggatgagggtgcatgtaacatgaaagaggtaaatcttatagtagagccaggaaataatatctaaaattgaaaaaccaaggtgaggcagtataaacatgctatttatgaatatggaaataaattccagggaaaaagattagaagagcgggaccatggcatgggagggacagggaagacttcaatttttgccataaactgcatgatatcgtttgacttttaaaattatattcatgtatttctttgctttaattgaaaaatatgcaagagtaggaatcctttagagatgactcactgaccaaaggaaccatctcattgttactgctttcctggaaacacagagaaaggcaaacacttctgtacattttgtgcacaatttctaagaaacaactgctttattaactatgttatatggtaagatgagtgcactaagtttttaatttcctgcggtgtttgtgttaagcacacacacttgcatttggcttatgtgacacacataagagtaaagaaataaaaagtaggtcaaggccggggctgtactacttaaggtgaagatcactaattggtaagtgaatttacaacttgacaatgaaaaatctgaagagttcaggagctgtgggcttgatagtgtgcttagtttggaaagcacagaacatttgtgggaaggatagcagcaggaatactaactgcagtgggagtgatgcttgctgaggtgaagtgtgatgcgttcatttctcctcaggtttrtatacttatgtaggtaaatggtctttacttcaaaaatgaaatgtttttgagatgtcttcttttaccagggtgcatttaatggcccattctgcaacttagaatccacagtaaagtgtcatttctgtcagtggagaataatgctctaggagactttagttgtcaataacaacaacaaaatgagacgtttttctatgaactgtgagaacctaatgcaaccggagtaatttttttaaagatttaatgattttactggtacacctttaaaatgaaaaggcttcaccctgaaatcccatttgaagaacaaatgattcatttcaatcaaggaaaaaaaaacaaaaagagatgggagaatgtttgctttgatctcaccacctggattggaagtattgcctccaattattttagcttgtctttagagtttcacctgtcggttcagctctaggcaagatgtgttgcctggcaggtgtctcccccactgacatcagaccatcaccatctagaaatcaccagagcaaaacttgtctggtgatctgcacaccagaaggcacgttttccagttactgtgtgttctgtggaataaaagaaactgatggagaagattgatcttttttaaccctctgggctccaatttttttcactttgcctgacccctctcccaagaggaatctttctcaactttttgatggattgtctcaccagacagtatatatgtgaaactgtgccaagaagtgatgggacaaacaacagggaaataaatggacgatttagctagagagaattttgttgtcagttgctagtcagagttgcagctcataggccacagttcgggtgtctgacatgcttgctgaataagtgtatrctcaataaactgcccagtagtctttagaaaaattgtgtcctctgccccgactatgcactctttagagacaatctcactctgtgaccgaggctagagtgcaaggatacaatcctagctcactgcagcctcacactcctgggctcaaggaatcctcctgcctcaacctacctactagctagggctacaggtgcataccatcatgcccagctagtgtgtgtgtgtgtgtgtgtgtgtgtgtgtgtgtgtgttttgtagagacagagtcttgttatgttgcccaggctggtctcaaactcctggcctcaagcattggcctctcaaagtgtcatattacaggcatgagccaccatgcccagccactcatattttctgtgatacgtgtactggggccatattggagaagaagggaaggtgctgggagaggaacagatatatcatagataattgaatttcatatgtaacccagttgtatcctggagcccatgttgtcctgggagttatgaaatgtgatttgagtacaaacatgatcatctttaaaatgaaaaatacttccattacaagtgtaactggcaacatgttctgagtccaaaaatgtagtttctcagtccacttgttttgaaacacagtcttcgctgactgctttcttaagagcggcgataagagaggaggatttctgtttagacacaggccacttcactcccctgaagagttccacttgcagtttttctcctgttgtttctcatattgagacaacagacattcagcttgacatgcctagctgacctcttggtcagaccctacccgtgggacaccaaaaagtgagtaaacaagtctggtaatggattgaaggagaattggagtcagtctgaacattttggccccagtttacccggaaggaatagctgaaaatagactttttgtgacctgggagaattatgaaatgcgatttggctataaatgtgatcatctttaaaatgaaaaatgctaaatgtctttatgcttctctggactggcctctaccccatgcttgtaatcatgcggatctcgcctctatccaggtcacattccgattagataaagtccgggcttcgctctttaaacatagatttcaaggccccagacttcttgattagagcctctggaggttgggtcttggcacgggtgttaataagattcagtcaaaattggtaagtgctagcttaagctgtggaccagagtttaacactcaactctttaggatctcattttccgcttttcttgcgtgagttaacctgttgcctctgtaattcactgtcygtgtctcatcgttctcctgtatctctctcagagcaagtcacacagatgcgctgctcagagtgtccatcgtatgtaaatatttggctcacagtcgatctgctgcagttaccttgagtttgtcacctgctttcctcccagccttcagtttcctcatcagtaaaatgagttaatcaggtttatgtcccagggaagctgtgagagaaaatggttttgcagatatcgagtcctatatggaaatgtgaaacaagaatcacaagtttgttgtgrcagttacatttggaagtcaaagctcacttaacatttggggttggttactggcgatctgaattagggggctggcctttagtagcccttcctcaccctctctaggctagtgtttcctttctgctgtcctcagcattcagatcccccactgggctgcccatcctggtcaggcactcaggcgaccctagttctcagcttccaccttaagcagcattataccgtcagcctttccttccagggttggtctgattaaatcaaactaaactgctaattagtgataatggcaacatgcaccgcccctccagataacatttaccttttattggcattctactcctgatttcagagaccactggagaaagtattttgaagcaggaaaccatttcagcactaatgcttcttaatcagaaaccagccactctcctgctgagatggaggtattgtcaaaatcctgagaagtaagggcttggtgtgaactcttgccctgatcatgtgtacttttacatccactttttttttttaatttcaagaaaaatgttgcagtgagggtgtaggagcttcatggcttcatctggggccttgattgccttgatgttaccctctccctgccctgaattcagcatgccaccgacatggattttttttttttttggaccgttgctaggaaactactgaccaaggtcaagtgcacatgctaattcattaagacttgttagagcctcttatcctgtcgaccttgctgttgtgttgtcaagcttacaagggcgagcgaaaagaactgtcttgctgccaaaggatgccattttttgtcaaggattcttgttaaggtattctgaactgagagatttcctcttgctgattacaccttgcagagttctgaacagacaaaatttttccaggatccggttagcaagggatgaagttgaaatgggatctgaaatcaagtagacagaatttaggattaatatgtgttcagttggaaccctatttccccaagtggatcaattcttggctggaatgtgatgtattcctagggaagggaagaagggtggttctaggatagttagccccagtctgtctccatttgtgctgttaagaggaagaaaactccaggcatccttatctccgattttcccttacctgctgcagaagagtatacattccagtgttggctctaaaaccaactttgttttcttatatgatccagactgtttagaaaaatggggctggcataccctttaagtcaacatcccagaagcttattcagaagcataaccttagaaccaaaggacccgctgctgggacagcagaaatggaacccagtgtgttttccaggcagacctcagaaaaggatgggaaacttcttacacaagcaaatggtatcagaggtataaatgtgttctcaaccgtctgccatgcaaagtgattaagctgagctgtcatagctgtttctctgctgatacctttgtgtttcattgaacactagctacataaaggaataagaaatatggcctcaaagctatgctgttccttattttgccagtgaactacagagagtttgtgactactgttctaggtcaaaagttgaaagtgcatcttacaatttatcatccactcattcaataaacgttgttagatccttctatagatcacgcactgtgcaagaccccagggatacagcaatgacagatagaggctctgactgacacagacaggctctgctggtgcagagtgtacaatctaagctagtcctttgtcaagccccaagcgagaccttcaagcctcctctgctcttaagcctttcatctgaatccttatttagtgtcttaattatctattgctgtgtaacaaatttccccaaaatttagtggcataaaacaaccttccttgactatctcacagtttctctccattagggtctcttggaggctgccatcagggggtcaggtggcctgcagtcatctcaagctcacatgcttgtggggcaggactcagcttcccatgggcattgatgctgagggcctcagttcccagttgactgttggccagaggtgtcctcagttctctgctacatgggctgtctgacacttggcatcttgcttcataaagtatgcaggataagaaggtcatggagtctggtagcaagatggaagtcatggttttttgtaacccagtcacagggtgatatcctatcacctttgctgtattttattgcttagagtaagtcactcagccgtgctccctccccrgggaggagattacccaagaggctgaataccaggaggtggagatgattgggagccatctgagaactctgccttccacatttggtatctgtcatcgttccatgccagcaaagagctactgggcttcaaatttagggcagagcagctgctggccttgtcctctcccactgaccttgtcaaccattcygaactcctgggctgcatttgttttgttgtctggctgagangaggcagatttgcagatcccgaagtgaccgatggacgatgaaaccaaagtggcgtaaaagggaaggtgtgtgagagctagcacagagatggtgcagggggctatgtcagaaaaagctgggactagggcaggctgtggaaatggaaaagaggaggtgttgtcctgaagaaagagcaggtccatggtggactgctcagaaggaggagtttaactttatccccaagggactgccattgtcaaaagaatttgctgtaaagaccctttcataagttaaggcagagcttttcaagcagtgtgctgatgatactctcggacttyggggatggagagtgacctgggccactgggcacgttgtcttcaacccttgtgcagcctcatcgtggcctccaggtcccctctgtgtggcccagtgtattgtacaaatattaacatttccctgtgtgccatggtgcaaaatgtttgggaagcacagagttaaggggtcttggtggtgtaggggagccgcacaggagagtgcaggccttgagacaggctggcatctcagtgcttggtttctcccttgggtgaggcatgtggatcctcctcttcatgcttccatctcaaccgcctttgrgctgctgggggagttttccatcgcaggtgttatccattattgatgagtcatggagaagatggtggtgaataattaagtaggtttcaggtgcagaatgaacatgaaagggaagaaagaataaaaacagaagagccagagaaagaattctaagttcttttgtaccaataagacactgggtagatgctttctataactttccagaaggcctggcagttttatttgagtctgactagtgattttaagtcttacgtgtgctggtcatttctgagtaataactgaaaaagttgcagcttttcacagcagcagtgaacactctaaacagcttcacccagcctgttctgagcagttcataaatggaaaccagtgcaattttcaagagtgataatgggggaaatggctgcaccatgggctagggagagttaaatggtgaggaatattcagtctggactcttgagaatcaacaccccaagattttctctctttaaataattaatagacggaagaaagtgttttgagagatgcccagtgctgtaaagtaggaagagatacctcctgcagtgctcaccatttagaaagggctttctagaatggtggctagcagctatgggacttgcatcccactgattcggattagagtaggtgcaatcggactgccaacaagagtggtcagaaatgccagaacaatgaggagagagagggcagtgcctgaggacaccctctctctggccccgtttcccactttggcctgcagagcttgtccacagcacagcaaactgtcaactagcatgggaggatttgccagctgtggattgttcacaggccctttgtgtctctttttttctaccttttggtcctatcatagcacattagccaatcaggtaggctcacagagagacctgtcagcatgtctgataaagggtttgatgagagagaaggctaaagtcatctattcagatgagcgcttttcatgcatccacatccttccccatcgccacagatcactgagaggctgattagctctgggggcgtctctctgcagaggtctctctgtctgcctcctgccttcagaaccacactgctgcctctgtttccaagagctcctccatccagcttagttctgccatgtttgtcttgacctttctctggtctggtctgaaccagcatatatagtccagctcttgagcccaatgtaggattatctgttggtttggttcaaaccgtattggccctggaggcagcccttttctgtgttggtgtcgctggcttgccataccccttattcagactgcagcatgaggctgtctcaggccctcggtaaaggtgaagagacttcccgtgcctagaggtgcggcccctagctggcctcagtgtcctccaggctcgcaccacatgcccaggtgcatcctgatgcaggtcctgagagagcctcttttcccccaactcccacccgttccttccacatgagctggatgctttttcacaggttctataaacgtagcagagtttggggtgtgtgaaagtttctggtagcaattcagagccgagtttattttctccagaaatagtaggtgctgctgccagaagggataggccagccccttctcagaaacatcagctgctgatgcccagcagtgacgcatgactgcctggaccattcaggcagcgaggggttaatgtgagggtcggacaccctgggaggtggtcacatctcctgttaccagttgcatgattgactcgggtatctaacaacactggaaacaactcacacgagtactgaggtcaggacttagcctcggctctcaagtggaggcactagagctggcccagctgcccaaacagcacccggaaagatggagaacttctggatgtaccgatttgagtgtcacgaaggagaggtaggtggatcctaggcttcaaaatcacatttgctgttttgctttttattttctttttctcatcctgtcaggttataagttggtctctgcatttcccttgacggtaggagttagtacagcaagaatagagagggggagtgtgcattaccccagacaggaggcagtggaatcaggtttgcctggggcttggaagtccaagatggtaaggacagagcaaaggctgctcgaccactcagaaaaggtgcttggaaaggggttgtgctccttgctttctccccgtcagcattgcattctgattctccacattctaataaatgagtcactttgggcagtgtacctccaattccatgctctgtgttgtgttttgtgcttctgtgatgctaatgaaaatgagtggagattagtgccttgcatgtaagaactgctttgctagtcagtgaggtaatgagtataatgtacccttgtacagtgcctgacacacatagtaagccttctgtaaatggtcactatgactgttcttagcaggtagtgtgctattacagcaaatctccttgtgctcttagctatatctcttaataggaattaaaagtggttttggtttttctctcccacagagctaagggccagtggtctgggaatgagtgtgggaacaccatcaaggaatggatggacttaaatgtggaaatgaatgaaagactccatttttccaaattgtagcgcatttcatttaaatacagtgaggctgtttcaaagggggaagagataacctgtgtttataagtcagttttatcagataagaacttgtttcacccttacactggtgtagttaattggttatttatttatttattttttgcctttgagaacatggcttcagaagctttttgatggtgagaaatgcattatttgtgtggcctcggatgatgacatcaccctctgttggagcagatcgctgctgtgcaaggctctgggcttcgaatgatccaggtcttcaacctatagatttaacatgggtttaaccgacttggggctgggaacaggagggctttgcctgtgggaaaagagagaacaaaaatggttagaatattttagctgatggttatctcaaaatgtttcattggtattacttgaatccattataaatatatatataaaacagttcattaagcccaggctattatcattttaatgacataattatgcccctacaatgccatgataactttctacttcaccacattaaagaaatacaaatgtgctttgataatatagtttaaattgagactgaataattatggatttcttaaccagtttcgattcttagaagcacagacatgtcttggggcaagaaaaaaaaacttatcatatatttggggtttttaaaaacaattctaatgtggaataaggttaatctaaaacaacttggatcagtgagggaaacaatgtacattggtgtgagaaaagagataaagctggataaaccagtaagcgtaagtgcaaagctatttgaggacagtggaccttgagaagtaatgctgcgtgtgttcagacccactctgtatataaacctattttttgcttccttttcctctgatacaaaatgggtgtctatgcatgcttccatttattcaacatatttattgaactcctactatatattttatggggtctctgtatgaggcacttggagaggaaacgtaagctaatgataaatcctgccttcgtggtgcttattaaaatattgtacttaaaatatgattactgtcctgtagcattatatctttataaaatagaagggagacagtgaggcaccttaagaatggtacaaacacaatgcatgcagacagttcttacaagaggggctttcctttcccttaagagatctaagaaggctgtatgaaaaaagtactatttgaaatggggatggactgctggagcttcctgtatgtgaggagttcagacaggagcataaacaaagacgctgagcagaaacgcaggtgatatgctgggaacagaaagtagttcagtttggattgaagaaagagaataggaagtagaagagggaaaaaaatagtaaaagaattaaggccaacccttggagtgccttaagtgccaaggtagagtctagaatgtgttctataagcaaaaaagaatgactgaagatttttgaactgaggaatgacttgttcggggcttgttaaacctgcattttaaatgagggtaaataggtgcttaatgacaggtgtctggtgaagaagttcatgagctcttggtgctgtagtctcatgcagcatattggctgcttagtcacttaaagaataaaaacccaacacctgattctcaggttctctgtgtcgttctacatacgtgaaattactgaataactgagtctcagatggatttggcaaaactstgtaatttttaaagaattatgttctcctgcccttcattaccatgaatttctgttgccgagtttcgttggaggaaagaggccaacaagtattggaactcattaaagttggctagggcttgctggggtatttcaccaggtgtcctaatcagcagtgtgccaaggccgtgtgtgaactatgctataaattaacagtagaggcatacgtatgccctgattctcttatgtaaatcaatcactataatagcatcaccctcaactcttacatttggaaatactgtcttggtcgggagatagtggacatgccagaagttgcacacagcagttgtatataccccccagccttagccagtaatgagctcttcttaccaattagaccattaagagtgttggagcttatgaattaatgtagaatcttggtttgattttatagagcctttttgcttttcaattttacccgtgaataaaattttaataaggaaggaaacgagatgaagaaaacatccccgtgggtgtttgttgtccttgtgagcactctcccagagggctgaaataacttttctaactgttcagatcataaaaagacttgaatgctttgccggtgcccaggcactgaaagtaccactagtgtgcattatcaccagttaatactcatggcaacccgggaggtgggtgctagctgtttccccatttctcaggaagtatcaaagaggatggatgacgtgcccaggctcagagccatcagtggtagccagactctgatctgccagacgctgggccttaagcatttaataacctccctatcctgaaacataagttaccttgttaggccacaatataaaattaaaaacatttcaaggcactgggcgcagcagtggctcatgcctgtaatcccagcactatgggaggctgaggcagttggatcacttgaggtcaggagttcgagaccatcctggccaacatgatgaaaccccatctctactaaaaatacaaaaattggctgggtgtggtggtggatgcctttaatcccagctactcgggaggctgaggcaggagaatcgcttgaacctgggaggcggaggttgcagtgaactgagatcgcaccactgcactccagcctcggcaacaaagcaagactccatctcaaaaaaaaaaaaaaaaaattcaagggataaatgaaatgtaactatgtatgtaactgtgttccctggaattgcactatacttttcaaaatggagcctaatataggaaagcagataatggtggctttgaggactaaacccattgtcttaggagttgattgattttctttttttttttttaaataatactttaagttctagggtacatgtgcacaatgtgcaggtttgttacatatgtatacatgcgccacgttggtgtgctgcacccattaactcatcatttacattaggtatctctcctaatgctatccctccacctccccccaccccatgacaggccccagtgtgtgatgttccccttcctatgtctaagtgttctctttgttcaattcccacctatgagtgagaacatgcggtgtttggttttttgtccttgccatagtttgctgagaatgatggtttccagcttcactcgtgtccctacaaaggacatgaactcatccttttttatggctgcatagtattccatggtgtgtatgtgccacattttcttaatccagtctatcattgttggacatttgggttggttccaagtctttgctattgtgaatagtgccacaataaacatacgtgtgcatgtgtctttatagcagcatgatttataatcgtttgggtatatacccagtaatgggatggctgggtcaaatggtatttctagttctagatccttgaggaatcgccacactgacttccacaatggttgaactaatttacagtcccaccaacagtgtaagagtgttcctatttctccacatcctctctagcaccagttgtttcctgactttttagtgatcgccattctaactggtgtgagatggtagctcattgtggttttgagttgcatttctctgatggccagtgatggtgagcattttttcatgtgtcttttggctacataaatgtcttcttttgagatgtgtctgttcatatcctttgcccactttttgatggggttgtttgcttttttcttgtaaatttgtttgagttctttgtagactctggatattagccctttgtcagaggagtggattgcaaaaattttctcccattctgtaggttgcctgttcactctgatggtagtttcttttgctgtgcagaagctctttagtttaattagatcccatttgtcaattttggtttttgttgccattgcttttggtgttttagacatgaagtatttgcccatgcctatgtcctgaatggtattgcctaggttatcttctagggctttttttttwaaattttattattattatactttaagttttagggtacatgtacacgatgtgcaggttagttacatatgtatacatgtgccatgctggtgtgctgcacccattaattcatcatttagcattaggtatatctcctaaagctatctctcccctctccccccaccccacaacagtccccagagtgtgatgttccccttcctgtgtccatgtgttctcattgttcaattcccacctatgagtgagaatatgcggtgtttggttttttgtccttgcgatagtttactgagaatgatggtttccagtttcatccatgtcctacaaaggacatgaactcatcattttttatggctgcatagtattccatggtgtatatgtgccacattttctcaatccagtctatcattgatggacatttgggttggttccaagtctttgctattgtgaatagtgctgcaataaacatacgtgtgcatgtgtctttatagcagcatgatttatagtcctttgggtatatacccagtaatgggatggcgggatcaaatggtatttctagttctagatccctgaggaatcgccacactgacttccacaagggttgaactagtttatagtcccaccaacagtgtaaaagtgttcctatttctccacatcctctctagcacctgttgtttcctgactttttaatgattgccattctaactggtgtgagatggtatctcattgtggttttgatttgcatttctctgatggccagtgatggtgagcattttttcatgtgttttttggctgcataaatgtcttcatttgagaagtgtctgttcatgtccttcgcccactttttgatggggttgtttgcttttttcttgtaaatttgtttgagttcattgtagattctgaatattagccctttgtcagatgagtaggttgggaaaattttctcccatttttgtaggttgccttcttctagggtttttatggttttaggtctaacatttaagtctttaatccatcttgaattaatttttgtataaggtgtaagaaagggatccagtttcagstttctacatatggctagccagttttcagcaccatttattaaatagggaatcctttccccattgcttgtttttgtcaggtttgtcaaagatcagatggttgtagatgtgtggtattatttctgagggctctgttctgttccattggtctatatctctgttttggtaccagtaccatgctgttttggttactgtagccttgtagtgtagtttgaattcaggtagtgtgatgcctccagctttgtccttttggcttaggattatcttggcaatgcgggcttttctggttccatatgaactttaaagtagttttttccaattctgtgaagaaagtcattggtagcttgatggggttggcattgaatctataaattaccttgggcagtatggccattttcatgatattgattcttcctatccatcagcatggaatgttcttccatttgtttgtgtcctcttttatttcattgagcagtggtttgtagttctccttgaagaggtctttcacatcccttgtaagttggattcctaggtattgtattctctttgaagcaattgtgaatgggagttcactcatgatttggctctctgtttgttattggtgtataagaatgcttgtgatttttgcacattgattttgtatcctgagactttgctgaagttgattattaacaagctttattccagagcctttcaaatcccaagcactgtgacaggacatgattctgtgtctcttccactagaagggtttctggcccagccagtgtaggtggcctctccaccccttgcccgtcttggcagccatcatgccacacttcggccactggagcggaggtgctctaaggaatccctgcatatgtgtaccttcaaaaagctgctgaacattcattcatttgaaatgatgaccaccattctcaaagtatgggtaagaagtgattcagttagaactttaccttgaaagcaatactaaaaaatataaatataaccttagtttactctttgactatcaacatctaggttgtagttccaactgtacatgaattcttagaacagagaagtagtactgattttatatgacatagtattgatcttagttatattttnttttcaaaaaaagtcagtgaatcacacaaaataaccttcaaatcacatgtgacttttgtagcatgttcagaaagggtcatctcaatcatgaagagaaacatttcattaaaaatatttaaggactgactcagttttcttaagagcctttcttaattatttgatattcctgtcattctctttggaagcacctctaatgttaccactctttccattcatcactccttctctaaccagtgcaaccccgccagtttctccattgtcagcagctggtttgagaaagactccamctttcccctcttcaactttatgcagttctactatccatctatttatttttgcaatatttgcacctctgcactttatttgctattatttgtttttgttttgtttttgccttgtaatgccagatggtcccaacagtcaacagaagaccagttgacaaagatgtggaccagataagtagatgctagtgtttgggstggaggactgttcaggtaggcactaatgttgtgtcttagtctgttttcttttaattctggaggctgggaagtccaagttggaggggcnncttctggtaagggttttcttgctagtggggaatccgcagtgcaggacatcacctgtcaagggggttcacgagggacagccaaactgacttgtaaaacagctccactctcacgataactaacccgttccctcaataacccattaatccatcaatccttgaatgcatcaatccattcatgagggtagagctctcatgacccagtcacctcccaaaagttctgcctctcaacactgctgcagtggggaccaagtttctaacacaagaattctagggaacacactcaaacttagcacattacaagtagtcagctcatttgtgactttctgtgacattaaaacttttgttttcctgcagcaactgagacagtgaccactgtttacagaagtcaccctgtatttgtaacttataggtttgtctcccctgaaagaccaggcatttttggggggaggcagggatctgggtttatttggacactgtcagcatttcagtattgaatgaatggcccacatagaactcactttttgtgtgtctcttgactagaatttctccaaaactttgtcaggatccttgaattcctctccacatcatggccctgctctctgagatcctgcctcagtcctcaggcctttctagaatagaatgttgttcatcatctatttggaaggaggcaggaascctttacctccagctttgggggattcttattatcatcctatccacttttcctacttgtaaaagtttctttytgcagatctccaaggggcgagagtggtaactcaatctctcactcctttagatcttttggttcaactcaggaaatagttctgaatgccagtattaggcttcttcaatgaggggagcaggccagtgactcacaaaaaagaaaaaaaaaagaaaagaagaaaaaaaaaatatctactcccggggcagagagtaggagctgagctgtggctgttggtaacaccctgtgctatcctccatggggctccagctgctagtccyagcccggctccgcagcctcatttctcacctgccagagctgtgctgttcctcctccctgcctgtgtttccagtatcttcctctgctttcctgtcccatactactctgtgaagaccacatggtgttcagggttcagctgaagcaccacctccccaacaaagcattgcctgatgcacacccctcccctcctgcagaactgaccactacctctgtgtccccactgtacagaacaacatcctggccacctgctggggacctgcttttccatatctgcctcctcccattctctgaaaacaggtctccttcctctttgtttcttggcccagtgttaggaacacagataggcactgagatgtctgtcgaaggaacaaataaataataatgacttgtggtggtgcttctcttcccttcaaacagcctgaaagttccaggagctatttgtatgtctccccgctaccacgagaagtgctgtctttgcccctaagagagatgttcagtcagaattaaaatgaggccgggggcagtggttcatgcctgtaatcccagcactttgggaggccaaggcgggcggatcacttgaggtcaggagtttgagactagcctggccaacacgatgaaaccccatctctaccaaaaatacaaaaattagctgggtgtggtggtgtgcacctctagtcccagctacttgggaggctgaggcaggagaatcacttgaacccaggaggcagaggttgcagtgagccaagatcacaccactgcactccagcctgggcaaaaagagtgaaactctgtctcaaaaaaaaaaaagaattaaaatgaatgatcagctttgccttgggatacttttatatcctttacccacttctggctccattgccaatggacaggatgatacatttcttgtctgggatttaggaacctggtcttgaggctgaaagctttgctttgtggaatcccaaagctgtggtggtaaaacttagatggtagctgtagagaatctgctagaacattttctgcagaagatgagttgttagcttaaggagaccttgtaattatgtagaactgggagttgttggtgagtcatctctgcgcactgtgtcctagatagacatccgggttcagcccttacctttgtgaactcctgaccctgcatttgcatcctaccctcacaagcacatgtctcattgcttaaaattggatatccatccagtagcccagaaggcgtgagtctccagacagagatatatgtgacaataattttactttttctatcanatttcattgcctaaattttgcctccaaattattctttgaaagttaatagtattatgtaatttctgtttttttcctccatttttaagagtatatcaaggtggaagttggacgtaatggacaaaggtcttgtaaagcagacatttgagatgagttaaacactaacaccattgtttaggcttcacgcggccatgtctgttttgaagctgtttgtccacccttgacatttaggcaatggtgtggagatttttaggcttccattagacagggtcctctctcatttggggayagctttctgcatcaagagtgtccttggagcccaggtgacagtcatcaaaggcaaagactatttctckaattcaaaatgcaaattgaggccagccacagtggctcacacctgtaaccccagtgtttttggaggctgaggcaggaggattgcttgagcccaggagttcaagacctgcctgggcaacatagtgagaccctgtctctacaaaaaaaaaaaaagtttttcagtttaaaaaaactgcatgttgaatattctacacacaacactagagggatgctgtgtcagaaaagggcctaccattgaccactgaaaaatgaagaaagcattgggtgcatctgtaacatatctgcttcctatgcaagctggaaaacattgtaaagctgaataaactgaagccatttattcagtaaacatttattgagtgcctactgtttacaagacccaaggcgaggcagttggaggatgaacatgaacaagacaaggtccctatctcytgagagctcttgggggagaaggggcataacgtgaacagatgattacacagcatggcacgtggctgtggagaaaaggaatgtactgtgaatagggtctgcggaagcttcagcaagatgagtgcttttgagctgaacattgaatgtaggaaagaatgagggtgaactttctaagtggaggtcattaattgcacatgcaaataggaggaaactcgaatgagctcaagcatgtgccaaaggcaagagcacccggggtctgcagggaagtggtccctgatgaggttggtgtgggtccagccagagcctctgcaagggcagtgcccacagcaggctcatttgtgcctcctccccctgttccatatgggtactcagcagcagtcacctcactttactgtggggtccgggttccctcttccatgcccctgctctctgtataacctgtcttcttacatcatcctaagatcatcaggtccccataatgttgtaaagaatttatttttagaagatttagagcaattgagaaataggaaatgtgagactctctggaggattgtttttaatgaaggtgtgatacagccctcaaaccatgcaattaaagaaaatccagctgcaccagtttccctgggggccagacccttaaaatctttgtgacagaaaattacttgggggaaaaaatagaatcgtacatatccaaagaagctcttcagattggggaaatttaaaggcattaaattctcatgaagactttactacattaatttggagtcagccagagagctaaatcagcaagtacccaccagctctctttggtgccaaataaaagttgtgtgtgtttcttcttgaaggcatgtggggctactttattgnagccaggggctgtggggtctggggttctttatgccagctgttaccctgggcctgccctcttggcttccccacagagtgtctgatgtctgcatgtgaatgtttaaggggtttgttcgttgtcctgacctccctgcctagaatcaggtgtatgggatcacaagaaacaaattcaagnctcacagcattaggctgggatcatacaacttcttcatctgaattaaaatgaatttcactgcattatctttctgttcatttgtggccctttatattttccataattcagactttttggaaaagatttttttgtttgtttgtttcacactatgctcaccaagctcccccttgtctatcagcgtgccccctcagccccaacaccagcaccattgctgtgtgcaatattatccctttccatgaaaatattttgctgatgtctctgtgcatcagtttcccccaagggggctggtcccgagagatcagacatgggttcaagcaagcaatagggttattttgcttcctttgctcaggacttacctccccacgcatccccacacttcctgagagaatacatctctgtttagtttttctctgtgttttatgccttttgtcaaacattgccaacagactgtgaagcagcgcagccttcctctcagaggaccattgctgtggaattctttttttttttttttgtttcgtttttttgtttttttgtttttttgacttaattttttttttattatactttaagttttagggtacatgtgcacattgtgcaggttagttacatatgtatacatgtgccatgctggtgcgctgcacccactaactyggcatctagcattaggtatatctcccaatgctatccctcccccctccccccaccccacaacagtccccagagtgtgatattccccttcctgtgtccatgcgatctcattgttcaattcccacctatgagtgagaatatgcggtgttttttgttcttgcgatagtttactgagaatgatgatttccaatttcatccatgtccctacaaaggacatgaactcatcattttttatggctgcatagtattccatggtgtatatgtgccacattttcttaatccagtatatcatttgttggacatttgggttggttccaagtctttgctattgcgactaatgccgcaataaacatacgtgtgcatgtgtctttatrgcagcatgatttatagtcctttgggtatatacccagtaatgggatggctgggtcaaatggtatttctagttctagatccctgaggaatcgccacactgacttccacaagggttgaactagtttacagtcccaccaacagtgtaaaagtgttcctgtttctccacatcctctccagcacccrttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctattcatgtcctttgcccactttttgatgaggttgtttgttttttttcttgtaaatttgtttgagttcattgtagattctgaatattagccctttgtcagatgagtaggttgcaaaaattttctcccatttttgtaggttgcctgttcactctgatggtagtttcttttgctgtgcagaagctctttagtttaattagatcccatttgtccattttggcttttgttgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcactatttattaaatagggaatcctttccccattgcttgcttttctcaggtttgtcaaagatcagatagttgtagacatgcggcgttatttctgagggctctgttctgttccattgatctatatctctgttttggtaccagtaccatgctgttgtggtkactgtagccttgtagtatagtttgaagtcaggtattgtgatgcctccagctttgttcttttggcttaggattgccttggcratgcgggctcttttttggttccatatgaactttaaagtagtttttttccaattctgtgaagaaagtcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcatatcccttgtaagttggattcctaggtattgtattctctttgaagcaattgtgaatgggagttcgctcatgatttggctgtttgtctgttgttggtgtataagaatgcttgtgatttttgcacattgattttgtatcctgagactttgctgaagttgcttatcagcttaaggagattttgggctgagacagtggggttttctagatatacaatcatgtcatctgcaaacagggacaatttgacttcctgttttcctaattgaataccctttatttccttctcctgcctaattgccctggccagaacttccaacactatgttgaataggagtggtgagagagggcatccctgtcttgtgccagttttcaaagggaatgcttccagtttttgcccattcggtatgatattggctgtgggtttgtcatagatagctcttattattttgaaatacatcccatcaatacctaatttattgagagtttttagcatgaagtgttgttgaattttgtcaaaggccttttctgcatctattgagataatcatgtggtttttgtctttggctctgtttatatgctggattacatttattgatttgcgtatattgaaccagccttgcatcccagggatgaagcccactgatcatggtggataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttctttgtctcttttgatctttgttggtttaaagtctgttttatcagagactaggattgcaacccctgcctttttttgttttccatttgcctggtagatcttcctccatccttttattttgagcctatgtgtgtctctgcacgtgagatgggtttcctgaatacagcacactgatgggtcttgactctttatccaatttgccagtctgtgtcttttaattggagcatttggtccatttacatttaaagttaatattgttatgtgtgaatttgatcctgtcattatgatgttagctggtgattttgctcgttagttgatgcagtttcttcctagcctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccactgttagtctgatgggcttccctttgagggtaacccgacctttctctctggctgcccttaacattttttccttcatttcaaccttggtgaatctgacaattatgtgtcttggagttgctcttctcaaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatacttcttggaggctttgctcatttctttttattctttttttctctaaacttcccttctcgcttcatttcattcatttcatcttccatcgctgataccctttcttccagttgatcgcatcrgctcctgaggcttctgcattcttcacgtagttctcaagccttggttttcagctccatcagctcctttaagcacttctctgtattggttattctagttatacattcttctaaatttttttcaaagttttcaacttccttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtcttttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcaggcgcccctcccccagcctcgctgccgccttgcagtttgatctcagactactgtgctagcaatcagtgagactccgtgggcgtaggaccctcagagccaggtgcrggatataatctcgtggtgcgccgcggtccgaaaagcgcaatattcgggtgggagtgacccgattttccaggtgcgtccgtgacccctttctttgactcagaaagggaactccctgaccccttgcacttcccaagtgaggcaatgcctcgccctgcttcggctggcgcacggtgcgcgcacccactgacctgcgcccactgtctggcactccctagtgagatgaacccggtacctcagatggaaatgcagaaatcacccatcttctgttttgctcacgctgggagctgtagactggagctgttcctattcggccatcttggctccgccgccccctgctgtggaattcttaagcatctctgtggctcacctgaggattcctttcatctcccaagatttcagaagcacacaacaatgtttggctataggctggggagtgttttccgggtctgtatcagtcccatccctgtgcttgcttgttttatttgcccatccattcagaagatgtttatggagcaccttctgtgtacactgacctgggagcttcctatacacgtstagcagggcctgcctgcacagggagctggggtcccatcagcccaggcaataccacacccaaccaggccattctccctgagcctatttttctaagccttattttccgatacaccgtttgacaaaggatttttgaactgttctaagagcatccagggtagtgtttggatgttaaaatgctgaaatgtctctgaattttcaatagcctgtagactaaatcagacaaaatatttgaaatctgaattgactaggaaratacaggtggtatggtttctagccatcaaaatcaggcccagctacctctttaaaaatgtgtgttttaatttttactttttcatttggggcaggcaattttataagacattcggtaccctaaatatttggcttcntcagtaagaaaaaaatgttttaaacatgtttgtgtaatatccttagctcaattcatttaggattttttaatttcaaccttttctgtattttctttcaacatttggcctaaggggaaaaacggcccatagctatgaaagctcctttgaaagcatggcaggacttgaaaaagaaarcttgaaaaccacaagtgttttatgtacagttggcagctcctttttaagaggttttctccccactgcagtgtctgttcgattgtgttctgctttgcttctctctcccggcccctttcccccagccaagtgtctgcmgagtctctcaagttctcactgtgtttcctcttgctgtgttctagtctccgtctcctggcagctcctcccccttgggtgcagagtcatcaagcacatctcttcaccccagtgaccctgtggaagcgtccactaataaagaggtagggtgctgttttgttaccaaagccattgggccattttgctttactctaatactgttctgtgcttcctaatacagcatcctacagcgctcctgacccacattaccctggtgagaacaatcctgatttctcctctccagtgtgcagttcacctgttmaagccatgtcatccagtttgatagccactggctgcaggtgcctaattaatgaataaaatgaaaagtttatttcctcaagcacagtagccacatttcaagtgctcggacagggtggattacagagcatttgcatcactgcaggaaattctgttgaacagcacttgacctcagacaccaaaaactcgacgtacagcatctttcctcctggcgttacatgcctgctgatgccatgggcttgcagttgctgtgtgctttgggaaatgtgttagtttcttaaataccctttatttcaggcccaaatgagatatctttcgtaagaatagagrggccatacattcccagtttacctagggtgtggttccagttcacacctgttgtccaggcagcccatcttatgagcgcccttctctcttgctggtgcagtgccgcctgcgagaactttccacggtgctggaaatgttccacttctgctctgtccactatggtagtcattagcctcatgtgcctgtcaaaccctggaaatgtggccagtgtaactgaggaactgaagttttcattttatcccattttaattaacttaaatagccacgtgtggctgcagactgccagacagtgcagctctaaagtatcccttttggacaacaaattctgtggtcgccttgcttatgtggagcatttcagtgagaagatgctgctttctcccattgaggtgtctgggtctgagaaagggcagccccagaggggagacactgccttcccccgtacccagggtccttttacacctagtgaactgccacccacacctgctaatgagccaacatcaggtaaatgttggtctgcgccataatctgtgtgtgggctcagctcactctaaatatagctgctctctcatcaacactgaggagatgtgttaaagaggtaaaccacatgatgaacgatggtttccttttccctcattttgctgataattttatgttaaatgcaangaaaaagaaatctctgtttaaactgagtggcagatcgcttttaaagggagtcttagttaaaatttacccttaagrcacccttgaataccatatatttgccattaaatatttacacaaaggaaaagtattttttattaatctgttcatattaaaccaaacaaacaaacatagaccttctctgaaatgacaccaacattagaatttagactagaaatatactttggtctcctctggtcttgagcctcagacacttggccattgggagcacaagtgacaagggcacagtttctgctgttcccaccgttccacagtttgcttcattcttatatcacatggttgggtgagaacaaatagtaagaagaaaagaaggacaggtgccctgatgataacagtcatgagcactatcgtttcttgagcattgacaatgttccaggaactgggctgagaaaaatcacagatagtgtctcatttaattcttaaaataattctgtgaggtaggtatcactgtcctcatttgctggttgaaaaagctaagaggttgaataacttacctgagattgtagagctcacaagtggtcagccaggattcaaatccagaactcatgggaacccgtgctcttaactgccaagatctgccactgctggagtagaaagtgtttgcaggtcacagactacatggacaaggtaccttgtctgtcattgttccagttgtccaattgtgcctccaagttctgcacgagtcgatttgtgtgacccccaaacccaaaccccaaagatcttagcctttagctttttaaatgcaactttatttatttattcttgaaagttaaggatcaactgatgttcatctcagtccacatgtgaaataaagggctaaccagacatctaaatattcagcatttgattatgcattagatataataaggcaaatttgttagtttctcagttcctacaagacttggctcatgtttctatatatccttagaaatgatgatgaaaatcctatttgtgtgtaataattagagattctttcatttcacaaaactctttttaaaaaaatttactaccccagagactaagaaagctagtcatgagctcatgcatagagaataagtgaatgtaccaaatgccctctgttgcagctttttttttaaagatggtaaactttattttgccaaattatttttttcaaacttatcttttttttaatttttttaattatacttcaagttttagggtacatgtgcacaacatgcaggttagttacatacgtatacatgtgccatgttggtgtagctcttaataaaactgcagcttttagagctatagaccaaagtaattcttttgtagcttctgctaaaatctggacactgtctagcattcagaaaagtatcaaaatagagcaagaaaatgtgaattgacttcttagatatacctggaggctaagcaattctgattaaacaaactctcattaccccaggctatagttacttgggacaagggtagggaaatggttgggaaataataacttaaaagttttaggcccctatgaagatgctagcttccatctgcataccatgaagttatgagggtttttttcttttctttaaaccatcctgaattagacagatttggctgttggctctcaactgggcctatcttctcacttaggtaagtggaaaataaaattaacgtaaagcactgctgaaactggagttctctttccccctatccacatatcctggcttttatttggtgtgcattttctcataaatgcattactagccagtaacttttcattcctgatgcactagaaacccacccactttggtgtgcagaaccatttcatcccagtgagcacacatgcagcaggtttactgaaaagctgccctgtacaatgtattattgtgtgattagtgttgaattgtcattatcctgaattgagctggagtcttacaactaggtttcttcaactgccccaatttttcacaaaacaattaaaactactatttttagactgttgtccaagtattaaccaagttatcatccctttgccattcccatcctccaaggaaagagcactgtgtcaagtgctaggttagggagttgctccccatgacatcccaacactcacccagggcgctttcctcatccagcctgccaggcaccccagagtcttccctctatgcaggtcagcctatccaacagctattcagtgccagatatctttcctcttaaagtcatgcatttaaataatcacctaagaaccgggtaggttctcagcaatggaattcttggccatgcaaaccttaccttctgcccattttagggacttgtctttaacactagctctccactctcctgtgatgcttgtatcaccctggtccagacacactagctacaaattctactactggtggaagcaggggtgaatttttttctcttatctcagtcagtgttacatctaggacatctgcttctgaaaggaacgtatggtgagttttgctcctctgatagcaggcagttaagctgccatctagtcaggctctaaaaggtgtctagctcatcatctctgcttccaacrgtgctgtgagaacgctgacctttgctctgaggtgcaaaagaaattccagggtttttaatttactcctttgttgtgttcttattcagataacacacaataatgatttatataatggagtttttcaactaaaataaatcagtaggagatgaagagatttttaaaaactctancacacatttttagcacagtgagagatnactgtggcaaagagtaaaataaatttctctgagagaattcttaatttcagctataatcatagcattggtgctttcactaatcagtttttcacatggaaatgcagatccttaagaatacaaattgtgccctttttattgttgttagagacttgtctgtgggattgttttttagttggcaaatacctctctgattgtgaaatgtaagatttctagattatctaaaatatgaatggactattctgggttttaggtaacctttactaataaatgcatgtttatctgcactttactttctctaactaaaaatgatcaataattggtaactgccactgattatgtatttatttttcatgttgcatggatgattgtgttaattcatatttcattatgctttgctctttttgaaacctctttgtctttattacagtcaagaaaaagcttggcttcattcccaacctacgttgaaggtaagagctgaaaagaaaatactgagcactgagtcattcatgaatcttttagcattggggcatatgaagcactgagatataagacaatggaagggaagaaaggccacaaagtcacttattcacaatgttagcagtcttaggatcttagactcaaagnatgatagctgggagcctctcagaaatcctcctcacgtctttgctcattatgtggatgaggactctgaaattggagtcgaagctgtgggctttacccagtgtcatgcagcttagcagtggtcacactggatccaaaacccaagtctccttattctgtctctgtgcacttcatacattcaaaaagaaaaattcaagtgggaatgaacattaactaaggcagaaattttggtcttttttaataagaaaaaccttcccagcaattttcatctattacgtggatgagctagtaatagtaacagttactgcatgcttactctgccaggttctgttctaagcacctcccatgtaataactaattgaatcctcacttcaatcctgtgaagtgagttttattattatccccatgttataatgagacaactgaggcatcaagagggtaacttgcccaagatcccacagttggcagtgcagacccaggctatgaattggcaggctggcaccatacttctctctggaaaccggtgtctttgtggggctgccacacatggttgtgcaggttactcactgcacaagggcacctactctaaggccaggtggggccaaagttccgccaagctctgcactccagctggagactgtaccatccaaatggggcaccaaatcaggcatcatttctcattcacaaagaggcactcactctctggctagaggtgatgctgagggtccacctgggtgcatcgccatttccttgaaggaggcttttctggaggccagagaacgcccagacatctctctgagggtgtgtctggactttggatcctgtgcgtaaacagtcattgtgttccactgcctgggaaagggttaccagggctcataaaccttcatgaacccttgggctcaaagcccaggacaagctcacagttttggtttagttacttaggtttctctcttgaatcatcrtaaattatttgcatcatttttgtgaggccctgaaattctgtgagagcattctgggaagttttctgaagtttgaaagctcccgtcttcatattcatcccccaggcctagggatttttcaggctcagcattagcctgagtatgaggatgtcacatgtgtgctccctcatccacagagcaatccgaaggcagcactaaagggaaaccatgttccgaaaggccaaaagaaaacctgcaattctctgacataggatcattaagggtttaattttttttaactttgtaagaatatactatccctgagctcaaagtgaacttatgaaattggggcttttatttttctgggtgtgatgcgatgacagtgatattcaattatattcaatttcctgaaaggataaatgacataagaccatatctcaaaaggtgtttaggtctgatatttgtgtgtcttggatgcttggcatttctacagtcatttaaatataatttggattgcttttaaacatatccccatacccacacttactgtagtcaaaaagggaccttctcagtgaatagcgccaaatcagagaatatatgatgttagaagtcccgtagagaaggtagttaatttttgttttcttttaacattgatttttaaaaaatagatggaagacttttaaaagttcatatcccagatgagatcgttcttcttcatatctggttggcaataatgattatgtttccataacactataaatgcatcaccaggaacttatcatagaagaactgacaatcttttactttatataaagtgtaatgtggattcaracctgttcatatattattttgtatgcttccctgctatacaactgaaactgtatatcatatatagcccgaatccatctcacatctataaaagattcagagcgggcccctgtggctgttgagtagagtgtgaattactggtgtggagtggaggcagatttgtctgtgtaccactcacagtgttagcttcaaagtcttgcttataaaaatggagaataagacaaataacaggcttccttatttaattactacatagatgctttgtgaaagcctttcctaaaacacttttaatttctctgtttcaagcaccaccttagttttagawaaatgagtagattattttacatctttactctgataantagttcagcacaggaagcagctgtgtaaactcaagatgagcttgatgtttaaggataaaaataaaaagcatttcagattagccttccaagaggaaaaagcaaattgtttccattacaagttanctaatttaagaccctgaggttttaacagtgggttaaaatgtatattttagtctctgcagatgtaccagtcaagtcaaataaaatacacaaggctaggcatggtggttcatgcctgtaatctcagcactttgggaggctgaggcgggcaaattgcttgancccaggagtccaagaccagcctgggcaacatggcaaaaccccatctctacaaaaactacaaaaattagttgggcatggtagtgcctgtagtttcagccacttgggaggctgaggtgggaggatcccttgaacctgggaggcagaggttgcagtgagccgagatcacaccactgtactccagccttagcgagagagtgagaccctgtctcaaaaaaaaaaaagaaagaaaataaaatacgtatgtttcaattgcagattaaaatgcctttttaagtagactgttatacagttatatattaatcacagwcacgttttaatttcgagttagggtttacaagtaattgtggttagaaacaggtgcccccaattaaaatatttaaaacaggtttgacttaaaaggctggtaaaatagaacagaaaatttgattttccttggaatctgtctatgtgtgggcacaggccaagaacattataacctgtaagtgaacaagattgacagcatgggactgtggctttgargtcacattatctgtcttgcacaattgaggtcagaagccattacaggaatccagacattctgaaacagatatcctatttttctgatctataaatttgtttcttccattatggattaaatggaggaagagatatgaatgggggggggcaagtaataggaattgctgtaaaaagcttttctaaaaagacagccatctagttacttaagcatttatccagcaaatatctagttgataccacctgggtgacagtaagacaagagagtcagaggtgaatgtcacatggtccttgtcccctaagagctcacagtctaacaggagaaacagtatcctttattgctgaattttatgttccatgtttaagtaaatatttgcatcactttccatagtaaatggttttagagaagcaaaatattttagaaactgtgccttctatttgaaaatgaggtgtgggtgcagatagacacagagagatgcctcagaccagcaggttggctctgcctcacctgtgccagcagtgagkcatgggagaggggagatgtgccattgagggggttggcaggccccaccccaggatggcttcctcactgtggctctatgtgttacagttccgggaccctgcgaccccgaagacttgatcratggaatcatttttgccgccaattaccttggctccactcagctgctctcagacaaaactccttccaaaaacgtgcgcatgatgcaggcccaggaagccgtaagcaggatcaaggtgaggacatctgggtgctccaacagggacagggggctggtgtaggcactggagcagtctacaacactggccacaactccacatatagtttagaggagagtggtttgagatgacatcacacaggcagtgcttatccatgtgcctgctaacaaaacaaaaatttccaaaatctactggagtctttatatacaaacatgatctatttaggttgttataaatggccagtcttgagaagaagtgctcatgatcacaacctttgaaaagttggtgtaatgaggaaggatgccgttttgagtattatgtctcaagtgcaagacatgtaccactggatttccactgacagctggaggtcagtggcaaacattcatgttacagagttggtttaaactaggtggcattgcttttgaaccagrccatcctgttcaagctagattgaacttgcttgcttcaaggaaaatgaaccctttgatcaaatctaacctggctagtctaaggtcagtgcaaggctaatccagtttaaactagtttgagccaatcataacatgtttgaatctcattaatcaagacataaaaggaacgagcctgtttgatccaggaggaaccactcttatctggtttaagtcattcacaactagtttgaaccanccagaactggtttattcccatgaataaatgcagcaacacagagctctagaatctccaccacgataccaaaactacctagaatcatgggcaaaccaggactccaggaacacttaaggtgtgtttatgtcatccacatgccattgtgccaccagcacctggaaccactgggcagcctccccgagccttgaggccactgtcacctagagccctagggacagcatcatggtagaagtccaggaccaggtatttccagcaagttggaataggttagaacttgtaagagtctgttttatccagtttcaactggtcaaaatggattcttccctcaaggagccattccatatttcataccttctctctcacacactcccaggttgcaccctggtgtttgtgtggtaacgtggaaggagaaagagggacaggtagaccgcagtaactgagaatccttgatctcgcaatcaaagaaaaaattattccttgagcacttaggcatgaagagctgtgcagggtcttggcagggaggaaaaacagtagctgataaagtgagatccttgttctcaagctcagcagtatgaatgagggaatgacaaagcaagccagggagtgtgtggggtgtgcccaaggagaggacrgtgtcagaggccgagtgccaccagagtgcaggggaagcctgcagatgcgaacacctctgaccactgccttctgcctgagaggtagaaaggaacagtaagtgaccaacaattccaagaggtgcttgcagaggagaggcagttggtttgggcctcatgcccaagctgattcttacrttagtcacgtgtccagactctgccatgtggtgaatagctcataccatcaccaacascgtaaatatgatgcgcctgaaccctcagctgtccagttatcctgcagttcccaggatgctgtgtgaatggccccacgtccctctcatggcttcctcctcaggctgctcactgccgctcctgctgctgggmctctgtgtgtcacccactgatctgaccacctctctgtacttggagnaaatgcttctcccccaagctcagagctggcccttctcttaactcctcctaggacagtaaagcccatgccgtaacttttgacatgactacgatgtttttataaaccagggaggagtgatttgcaactgcctcaagagtgactgttgtcacaaccctgctaggccagacctagtgtcaggattactgacaggaccttttagttccttccgtgtgtcagggatccactcagccacttcatctggggcacacaaaccttgcctgtgcctcagaggccctgctgccataaggcccatttctgtggtgtttgtcttcttctaaaattagcctctcccagaatgatggacagtgggaaggtccagttcttttaggggaagccccaccccctacccaaagagatgtgtcttgccccatggctcccaacaggacaactccgtggagacagtctgaccttcataccttttgggactttgagactaaacaatgctacggatagaacatcaccatgttcttggggagctgcccatccaagcttggcctagttccctttcactgtcttcctgtttccacgaagtagtgacattgtgccagcaagrctccccaaggtcttctccatcttaatttagttgtcttccaggcacagcattcaaaacaacaacccacaaacctctcagagagagcaagctgcttctcaggcaaagtcacgtcctattttgtataaagcagagaactttaaatcaaagagacatagagacatagttctgactccacgtgccccatgggtaccagatatgccacctgggcttccaggtgaatggtgctgttagcttccccaggtttggtggaagcacaaaagcctggtgtgcctcacttggggtctctgatagacagggactgccttcataagatgtgtttggaaatgagtgggggcacctctgcttgtcaccatgactgggggcattttctgggccagagccaggtgtgctcaagaccctataacatccagggcagagccacaaaacaaagattttatctctaccaaaatgccaaagagcccctatcaaggaatgctacccagagcccgttcaggcgtatcttccagaataaagcagcagtctgcccccaaaggagtactgaagacttctgaggttgaaaactgcacgttgccttgaggttagttttttctaggttctatccatcaaggnttcaaacattttaaggttcaggtttcatttgggacaccttgtttattagccctctgatagctttggactcctacagacagaacatttatgcctttccagtccccttatggcacttaggtagtgctgagatggccttacagggaaaaagcgggcacggggcacatcacttgaacgtaaagcaatgttcggggtacacagcatccctgtaccaaagctcytcagtgccaattatattgtgaattacattttcttatttccaaagtggtgtcctatagagttgttattccttctttaaagtccagctgcctcataagaaatcagagattttacttcaaagcttccaaaggattggtatcccgaagttccacagttcatttgaatcaaaaattagatggctctgttgatcagaacaaccaagatagaggctttctgattataaatacattttagacctgcctagagcagaataggcatttggaaaacatagatttatttttacaagcaaattactctggcgtgaggaattcattatagagtggtaaaattaaatggttacatttcatttataacttataagtatcattttacaatgtgcanctatgcattggaaggaactgttgcctgtcattaaatattttctgtttcatgttccttttacatccattaaaatgcttatcagattggttgacgttatatccagctagaagccttttccaagtgtaaatggagatgcctgtttaagtcagcactctccaaaaagtgactgtgtcagggagcgtacacggacttcatcaatgcaaagggaagctgggggcaaagagtgctgatcctgagcaggctgggctgggctcaagtggaaggagcttgcaccaggtgcccacatgtgcttgggagacactgctctgtaaggaagatggtgccacgctgtttcctaaagagagactgacctttcaggacaagttattctaggccaccttgacagaaaggangtagagcacagcaaagctgcagactttatagcgtccgtccaggaaggaaggagaaagaaaagctctgtggatttattttgcaatccatttagcaatgtccttaaccccaatctgattagtaatttctggcttggcactttcacctaaacaaaggtgggggtagtttcctcctttgttttctgattcctccttcttccctcactccctgcagggacccccgttttgtccctctcttcctctgcctacattgtttgtttgaccagatggatgtgnctggatgtgaatgagaactgctcaccacgcgccctgttattcgtggtgctttatctctgaacagacgctgaccttgaagcttaggtttccatttcaaagtagtctttaatttctcttccatttgtcgattgtggtgtccgccactcatgtagtaccaactgtatactaaaattgaacattgcttattggatttggacttggggttttgaaaattactgttttcttaatttaacaaaaaatttacaagattcctttgccacatggagagagaatttggagctgcggtttggccaggtattttctacttaatgtgaaaagaaacaaaggaatttggccccaaatgccaactgttgctgtgcagactcctgtgataggccctttaggaataaawttaaccaatacacagttcttgagcttgagaaacttgcagtaaaaacaagccaaaaagaatgttaggtaacaaaaatacaaggtaagctgagggctctgaaatttaaaggcttttccatctaccacaatttaagagatgacatatctgagcacaatagcagaattagaagacatctgtcattaaacatttttttgttttgttttggtctttggtccctccctaatgtgttcattctgcctttgttggtcatcatttttgagaagtaatatccttccagagagcccccatataccttaggggattgcattagagccctggttctcaaagcatgatccctggaccagtagcatcagcattgcctacaaacttcttagaagtacaggttttcaggcccaaccccaaacctactgagtcagaaactcagaaggtggcacccaggagtctgtgttttaacaaaccctccaggagattctgctctgcaccagcgtttgggaaccactgccttagagaaaggtggacccgccagtgtgtgaagcatctttcctcccactgtgccctgyagcattctagtcaggctaagtgcttgtcattaatagagttccactggcaaataagctcaagaaaatagacctccttttcggacatttgctacaggtgtcttcctcttcaaggctctgagaagtcctgcactaagaagatttcattcactttaactagcagctcccatacttatttgagcacagaatacattgttaccatgtgatagatacctgtcattggtagtattctctggaacatgttttgggagaaacttctagagagagctttgtcctatgtgctgtcagtctttaatgtgccgtagatagaaacacatctctcccctaacaacgtgggactcatgcctacccctttctagagaaagccagactggaagccagcacaatgagctcatttgtcttccttgttctccactgcatctccaccttgccttccactctcattcccacttcattctctgctcttcaaccagaagatagggtggcctgctgagccctacctgaaccacagagactgcttcatgtccatccacccagagtgtggtgtttgtgtctccattcttcctgtatttgtgaagctaatgcaattagattagattacaaatggtgtataggtatcttgtggtccatgcattttggcaagctgcattcattatcaaatattcatatattcatcttaactagcctgtcccaaagatcagatttttttcattcttttatgattttctcaaaattatgatttcattgtagaagtaaaatgtctatcattatagctttgcctaagttgtagcatttcccagcttagttgaagaaatctatgatcagtaaagtattaggcccttcacatgcattatctcaatctcatttactcctcaaaatggatggggtagagaacattgtgaggtaggtgttgttaaccccatggtatagacaaatggagaagtttacagatgacatgcttgccccagttgcacaactaggggtttacaatggagtgagattgccagagtttgaatctctattctgccacttcacagctgtgtgacctggggcaagttaattagcctctctgtgccacatttccctcttctgaaaaatgaggataacataatataggcagaaatgacaacatctacttaaacctcgtgtttcatgggattgatcatggcttaccatctagcagggtagtagctcacaggggtgttgtaagcttttacactgatttatgtgaaatactttgaaggattctggcacatagcaagttctcagtaaatgtcagtggggagagaaaagatagaacagtcaggagcatccctggcacgactaatctagagtgtgttaacagcggcagaaactcagtacacattgtggatggagtaagggggtggggggtgctgcagtttgtcctttgcactacaccccgccacgtggtaaaccatgatcaatcccatgaaacacgagggtttaaatagatgttgtcattcctggctttaaaatgcatgctggccttatgtttctcttggacccctttctgctaccctaatttctcattctggctccaactctcccatcttctgtgatgttatatttaaattttaaattataatttgttgcagggtacttggatatcatgagtgatttaaagatggtattactctaaatccacagaatatttttaacttcataaaaactgtttcgggccaggcacagtggctcacgcctgtactcccagcactatgggaggccaaggcgggtggatgacctgaggtcaggagtttgaaatcagcctggtcaacatggtgaaaccccgtcgctactgaaaaatacaaaaattagctgggtgtggtggcacatgcctgtaatcccagctgctcaggaggctgaggcacgagaattgcttgaacctgggaggcggaggttgcagtaagctgagttggcaccactgcactctagcctgggtgatagagcgagactctgtctcaaaaaaaaaaagtttcagaatacctttcatgaaactcagtttgccttttggatcctcttcctcaacaccagtcccagaaaaaaaaaaaaaagaatttgggtactccagtgatggtggaacctatttccttttgaaagagttatttcaaatcggttccctagagttgaagaattttgaccaacagctgttagggtttgggatccaaagtaatggaaattcctatattactgccatatcatttcaggagaagtaaaaaacaaacattaaagatctcccagctgtcagttatgcagattatractgatgccagtccgaacatccctggccagactctggggttccacacgggaatcctcgtggtgtggcatggcataacatcagcatagggtcacttctcagatgcagaactattcccactgtaatgtgcagcagtcaggatgacagagttgctaccttcaaactttttcagagcagactattcactgtgaactcatggcgaccagtaagaacagcagggcatctgtgtgggagtgnggttgccctggtttcccgggtgtaccayagattcgctatgtggtgtctggatggctgacttatccagtttctctacaatgaggtagtataggcaacatattttagtcactaatgaaacagagatgtgctgctgagagcagaggagcttttctaccaggtgagtacccaggaatatgagagagcagttcttcctccaccccaatcccattaccacaatagcgtctgcagtttggccattgacttgccattatttgtacaagatctgtataaatagcaagtcttagcaaaaggcaagaaattgcatcatgacctaggtcaattataatcatataacagcaaacacaaatatagtgcttagaatgtatgaggcactgtttgaagagctttgcatgtattcattttgtcctcaaaatatccctgtgaggtagatactatttttatcttcactttacagatgaagaaactgaggcacagagatgttcagtggcttgcctcaaagttgcacagctagtaagtggcagagccaggacttggttttagacaatccagccccacgctctgcttttatcaactatgctgtcttttaattgtgagcaaaagggagaatggtacatccatttttagttaggtgtaaactacattaatattacataaatttaaggcaagaagtattactggagataaaaagggagaacaatgaaaggatcaatttaccaagcaggtataccatcctacctgtgtgtgcaccttataacatagctgtaagataaagattgacagaatcaggatacacagacaaatccacataacagctggaggttttaacacactcaataaatgatggaacaagagattaaagaaccagcaagtatatagaaggtttgaacaatactgttaaccaccttaattgacctaattgtcattgattgaacactgtccctaacaactacggaatgcatattttgaagtgcacatgacacatccaccaaaggcagtcatgtgctggaccatagagctaagcctcagcatatttcaaaagattgacatacagactgtgttctctgaccacagtggaattaattccaaaatcagcagaaaaagataactagaggccaggcgcggtggctcrcgcctgtaatcccagcactttgggaggctgaggcagatggatcacctgagatcatttgagaccaggctggccaacatggagaaaccccatctctactaaaaaatacaaaaactagccaggcgtggtggcgcatgcctataatcccagctactcgggaggctgaggcaggagaatctcttgatcctgggaggcagaggttgcggtgagccaagatcatgccattgcactccagcctgggcaacaagagcaaaactccatctcagaaaaaaaaaaaaagaaaagaaaagataactagaaaatccccaaatgtatcaaaattaataatacaattccaaataatccaaggttctaagaaattgcagtggaaatttgaaaaaaaatttaacggaacaatgattaaattgaaacacaaaaatctgtggaatacatccaaagcaatgcttagagggagattcatagctttgcatatcagaataaagtttgaaaagccataatttaagtttttatctcaggaagctgagaagtcagcaaattaaacccaaagaaagtagaaggaaataaagatctatgctgaaatcagtgaaatagaaaaccaggcgtacaataaagaaaattaacagaaccaaaacttggttatttggaaagatcacttgcaattaagtataagaagcactgcaacacatttcctttgtctcacttcaccacttcccacatactaaattctgaattacgacattgattatctttagactgggatttttaaaagccagtcctcctcccacagaaacgctttatgccactattcagtattagtttgtcaattccctttttgactttgagtctctacacattctttctaactattctcctgtctctgtttgttccatgctaagcagatggcccagaaattagccaaaagcaggaagaaggtgcagtacaaacaacttcatcagcttggtgttatgcctgttcttttcattcgtttctgttttacctttttatattttcgtgtttttgttttctgcatccagcaagtttttgttcagatttctttttgaaccgccccataagccagcgtttctcaaaactcagttgccgaaggtggccgttttctgttgctcattagtcatttcacttcagaggaacgacagggagcagattggagacgctgaatgaatcgtatagtagtatggaagttccaaacattcaggagcatcgatgtggcagggacttgagtctgtttgattatagttatgcttgatttgtggatttgtcagattgctggatgcaaaaaagaaaactcgctaataaccacacatgtacagagttaagccctaaatgaaccagactgcgctttttggttgtggagcttctaggtgcttatgagctactactcctgggacgttgaggcattggggctctttcttaatggggtggcttcaggactgcttctgtgttgctgggtgatatgtaaacataaagaccctcttaccagaactgcatccaaatggcttcatttgcagctgctataaacattgtctcctatcagctcaagcagaggcaaattctaagtgacttccccaaggtcttttggtatgagctttttggcctatttcttcaatctgttgggctccaaaacccttacagagagggccacttgccatcatcgttcaaagagtgaaatctactgcagtgagttactgcttctataggggaagaagaaaaggggattccgcatttttccctgtaacctagaggtgctaactcttgtccatgtgtccatcctctgtgtggtaacttcagctttggcagtttaaccctagagtctgtattgctgttctggtgactgtgtcgtggtgcctctgtgtgagctaaccttactccttctgcatctgggtcagggtagtgtggtcaaactttctcttggtgcattttttcttctcargctcctgaaggcgaatctcagccaatgactgaagtggatctcttcatttctacccagagaatcaaagtgctgaacgccgacacacaggtatcagctggcttccacctttcccagggtgaagcttagtgacatcgtaactcagagatgcatgtgtctgtagagcaggcatgtgtctgtagagcagctgtccctagattctgggccccagtgagctagaaggtggtgttcacagtgcctgctgctgggtggggtttgggattgctttcttaaagcccaaaaacacccctaagacatggatgacgtttagcattttcagaaattttaatcagagaattcattaatgtgaacaaatttgtcttttaagaaattttatttaaaatctcttacattcacgcacacaaaaacagaaacagccctgccattttgatttgtcttttttttttttaaacttctccacaagagattcaactgtttggaatttcttatttcttttcacctgccacagatcatttcctgctcttgattagctaagggaaatgccctccggcctgggtgggtatccgttgatccctcagcatgggctttgcagtgagccctggagcccaccctgcatgcgaaccatacttgactggctgtaaggtggcaggcgctttcttaggtcattagatgctgarctggacttacccgccctctcttcctgcctccaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtacaagatgatctgccacgtcttcgagtctgaggatgtaagggttgcttcctttgatctccttttgggttaggttctcttgacttctcagaacctgattcagtctaattcatcacacatgatgcatgtatttattgtgcacgtactgtgtgtcaggcactgttccagcactagagatataaggctgagtaaaacagacagggtactcatcgcaagggctgaaaggaggcagaaaatcaataggtaaatatacttaatgtaaaattgggtagtggggagtgctccacagacaaataaaacagggtcaggggatggagggacaggggctatgtcaggtagggtgatcaacaaagccctcacttgaggaggtgaccttggagcagagacctgaataaagtgagaaagaggaaggagcaaatgcgaaggccctgaggcaggggctagctgcgtttccctttgaggaagggaaaggaggccaagctattagcgactttgggatgaggtgaagagtaggaagaatttggcacctcctgtaggggtttgagcaggtctgtccaagcatgagggcattttgggaggacagttctttgtggtccaggaccatcctctgggctacaggaaagttagcatccctgtccctccccagcaaacagcaggagcactgcccaccccagtccttaggaaaaccagctccttttcctggcacaaagccagtggttcctaagctccatttctctgggtgatgcagtcaacagagaaaatttgtttacaacagaagccattctgtcatttggcctactttcagggttgtaacccaagctgctagtgaggccaccaggctgcaaactgcagcctgaactaagctgctcccaggtgctcccctacctccccgcaccatcctgggcctcagcagtcctcagaagccgcctcccaggggaggccacagccctatagtaatttttaatagcagaaaactcacccaccccctgagggccattgcttttgactgtgctcatttttcctcctgacacagaggaataggctctgtttctcacatggagcacggagtcctgatctgggaagagaagatggcgtctgatagccttggttccttcaaagaggcccttcttctccagtacagcattcgtctagctgcagaaattgccttcctctcggaagttaggtgtcagcagccatcctgcttttttctccggggaaccagagctgtcgtggctgtgggcacagagaggaggagatgccaacacttactgtcaccatcttttattggtcttgttctctagaaagcagcacaggacaaggtcactgggagaacagagagcttgaaatacctctgcctgccattctccctactgttcctgtaaagctgaggccaacatgcaaacggggaaaatgagttttaggaggttctcagaaagttccaaaagagtgaaaatttggacttttaagcctcctgtgtcctgcaggccagcgaaaagatgaagttacagggatcgaggatccctgtaggccccgctgctacctccatctggctggagctcatagggaggggtttcttctccttggggtacccttggatccatcagggaagaaaggaaagattggagaagcaagaggtaggcaagagtggacctgagaatcttacccctttgctttcactagagcagggccagagtgtgctggctccagaattgggcaagctgagcttgagtccttcctcatccaagctgtgcagccactaagcctcaagttcctcttctgcaggacgatagtacctccctcaccaggctgctgtggcactctcatagatattgcagttaaagcctgatgtgtggcacatggctagtggtccataaatctcagtagccagtgtattcaccaggggcatccactaatgatgatcaggaagtcgactggtcacattcccaggtatatatttttcagtttgtctgcatgtacctctctgatgccaaaagcaatgccttactccttccagttttacaataggtagatggtggtagttcttgatgtgatttgtaaagtcatcagattctaacagtgagaaaagttaagtatttcttttcccatagccagccacacggaaagttcccattttgctgttaataaggtgcttttaggaaaggtggggaaagagcagtggaggttagaattgtgtttttaaaacaccgctctagagattttctggtttggctttttctgcccatcagaatttcacagagaagccttccngtgtggtgggcaggaggatgggctctggattcagcccccagccccttctcaggaagtgtgcagtttaacccctcaacctccatatcctgttctacccagtggggacactaatacagatccatagttccaaagtctagaaagctctgagaaacaaaagggatttttgaagtcaggtggctgataaacttgccttgcctgctggcaggccgtttatagaatttgtctagcttacratgaatcttacagattttgccacagaaatgttactgtgctctgtgtacttccccagaccgtcagggggttatggcacaatgtacagtatttgcaccctgctacctttctaaaattggaaaagttttgaattctgaagcagagcctcttgcattccaagtgaaggattgtggaccagtcatactaatagctgtcatagaatcgatatgcagattcagtgatggtccttgtatagcatttacttttcatagcatataccttgtatagcatttactgcagcatagccacatgagaagtgctcagttgctcttggctgtctggattaataatgttgcttaattaatgcagggaaaagctatcaaaacccagtgtagaagccagtgccacctcctgcaagctgtgtgaatttgagaggttcctttgtgtctctgggcctccatctcctcaactggayaatgcagggttggaccagtcagagttctcaactctgttagacccaaccctccctttctacaataaatatcttattaatgacccattactatcctgaaatgaaattcatagctaatataacctcccctattgaaaaatctttcacagaataatcaaattgtggccataaatataatataaaggaaagataagtggaaagcaaactaaaataaaaccatattacaatatgtattaataaatgctctggcgcaaccattctgaaaggcataatgagatagtgagatgcttatgcctacttgattaagcttggatgtaggagaacgcagtgtgcagtgggatatcataaactttccagttgacatttcaaattgagggccaaataatatgtatgtatctacaagcacatgcataatcaccatgcatgacagcacacgtgcaggttgatagggatgtgatttatcggcaacacagatatcacagcagcgctgatgttgattttccaaagtcatgaagtttcctcctggtgaagtactgaatgaagcaaaataacatcatctctcaattcagacggtattattcttgaaatgttcgatgtgtattagagccatacaaagtctttgtgtttatgtataaattggagttgaatcctggactcaggtaactgtaaacaagtattgcatgcacatgaatgtccagagggatctgtgaagatggtgcagggtatagaatgactcatcactgtatcgagctgttttttgcatggcaggatattcagcatctctgactcctgtctgctgaatgccggtagctcccttatgatcattgtcataatcaaaaacatccccagtctttctgaaaattgcccctggtgggcactggtagccccacgtagaaccactggcccagcaggcgtgatgtctagggtttcctcagactccaggagggccattgttcaggtgggaagtgcgccaggccgctcaccaggtgcactgccctgctgaccatctttcctctctggctgctgttccaggctcagctgattgcacagtccatcggacaggcatttagcgtggcataccaggaattcctcagggccaatgggattaaccccgaagatctcagccagaaggagtatagtgacctgctcaatacccaggacatgtacaacgatgacctgatccacttctccaagtcggaaaactgtaaagatgtgggtacttacctgaagctgttctccaggctgggtcagctgggcaggggcttggaaagtggggcaccctgccgcggaagtgaagggagatcaatggtgaggagtgccgtattggcaggacatcatgaagtcgttcacccccatctctcgctccctgctgtggggccctgtcatgaaatgctattgtggacaggtgtaaacagagaggcagcacatcctctgctcctggtcatcctgagctaagttttgggtgggtcccagaggcagataggacctgaactctgcttgtacaaacactgcaatctaggtaagggcactgaaaaagttaaatgatggtgccaggtacaggcactaatcaaaaccaactacacttggacaaacagagaagatcncaagtttcagacaagaggtgctgtgcttctctggggatggcctgtggcttcaaactgagctattcaggaatgcctgtaggaagatgaggctatccaagctggtctggcgatctggggattgtaggggcaagccgagggtggggtctatggaatggttggaagcctggagatcagaaagctccacatttgtctagggaatgaggaaatacggtttggctagagcaggaggtaggcacaggaaaggagatagatgggcctgagatctgggtcagaactggagggcctgcaagtccagctgaggggtttggacttgatcccataggtaaaaagaacttttaatgagaaagtgatcatttgatccactggggtctgtcaggtgtcttaggtcagattccccagaagcagagcctgaggcagggattcttgtcacagaggtttgttgggagagtgcctcagaacagaagggatgtgggaagcttggtggtgggacaccaagtaagggtgtggtcccttggacatgagcttccttctgtccagagggaagctccatggcacatattgcaggacagatttgtctcaccttggagcgagggagctggcaagcctttgtaccccatgccggttattggccaaggctggacagggggtatatgaatttactagggctgttgtcacaaagtaccatggactgggtgacttcaacaacacaaacctattgtctcacagaccttgtggccagaagtccaaaagcaaggtgttgttagcattggttccttctgagagccgtgagagaagaatctgttccaagcctttctctggcttgtagatggctgtcttcatgctgtgtcttcacatcagcctttctccatgcatgtccctatgtccaaatttcctctttttttttttgatacccatgacagacaaccattcctcttcttaaataaggacatgagtaatattggattagagtccatattaatcacctcatttaaaattggttacctctgctaagaccttatctccaaataaagtcacaatctaagtcaaaggcactgggggttggtaattcaacatacaaattttggggggacacaattcaaccttaacagaatgtgtctccctttcagctaaggacagttctccagggaaggggctgactgtaagcttcagcagctgggggaagcagacaccaacctgtgaaggggactttgtcaagccccccaaaaatacacatacacactctgttgggtgcttccaagaggtgtggtaccttttagtggcatatctgcaggcctccccagagtgcaagtatccracatcaacccctgtcttctctgccctgccagtgaaggttgtgaaaagtctgtgtatccaggatatgcacttcctgtgtgcacacccagccttttggttgtgataacttcagcatcactttttcttttttctcaactttttccttgcagagaagtgtttctgtgtgtttatttatttttaactcaagaaaattaaatgtcggagcgaattggggaagcactgtgggagggggaacctgcgcatggaatttgaaaagctatttctagaaaccataacacaccacccacccacagagcctcatcccctgccactgaggacaggactgaagaaattaaaaaaaaaaaaaaaaaaaaaaaaaactggtggtcctcatggttgtgtgctgaggcaagtttgcttatgtgaaacgagtgaattacaaaagagtgtagacctgtgtgaattcatttcttaaaaactccaaatatgcggaatgctgagaagacaggaactcatctgggttggtgtccccagggaagtgtctttctttaggcaagacaggaatgggggagaggctttcatttctacctaccccagatggtcyctgatggaggttttctaaatgtttttctccttccaggttttcatagagaagcagaaaggagaaatcctaggtgtggtgattgtggagtctggctggggatccatcctccccaccgtgatcattgccaacatgatgcatggtggccctgcggagaaatctgggaagctgaatatcggtgaccagatcatgtccattaatggcaccagcctggtgggcctgcctctgtccacctgccagagcattattaaggtacctgaatatgggaaaaatcagttgatgtggtaaacctcaagtgatgtgaagtgtgacccccatccagtcattaatgtatatgaacatattcaaagtgtcaggcaccaaggaagacacaaacacaaaaggcgtggacttgcactcaggaagcttaccatcaagttactgtttacagattcttccctgaaatcaatttagattaggggaagtgtatttggttcacatgacactactttctgatagcagcatgtccatcacagcatcactagtcaatcacagcattctcccactaagcccagactcagcctcaacagaaatggcctcagcttgggaatccagacagtcacttatagtcagccagatacacttggcatgatttaccatccctgtcaaaaatgtcagaaatgcttcaaatctgagagtgctttttccttcccagtggccctgactatgatgcaggtgagtttgtcctccctcagaccccgggtaaagcaactcacatgtgctcattgccagaaggaggaggaaactctcttccagtccatggaagctttttcatacctgagcatacttcctgctcaacctgaactgatgcttataaagctaagaagagctacttaaaggaaaattaaatgtgaatacttgagaagaaatgagattttctttagacatgaagcattcatgtggagttttttgagcacattgggacttgctgaatgcatggccagtgtgaccaggatgttcctcctccatgatggcatytgtagaccccagtagctctgcaccaagtgctgcggtactgtagctagactgagattccacagcgttttttggggtcctgtaggggtttcctgaaagacttagctggaacatagctgtgtgcgtatgtgcatgtgtgagagagagggagaaggaaggggattaattcgtgcaaatagtcattgtgagcaaaagaaaaatcacaaagccagcctcctcagctaagggggtgggggtgggaggtgaaggtgagtgtataggacacatggatggtgactttttgtttttaatgaaatggagtaaattctaatttcacataagataatcacatctggaaagaaatagtcctctttggcctcctttaatttctttttcttatatcttatacttaaataaattctacctcttgcttaatacacgttaaaggtaagattagagaatcaactttgaacatggatattcattcagaaaggtttaattgggcctctgtgaggcactgagctgcgctctgaggaagctggcttgccagtgtgcatgtgcaggataattagagacgtgcaagggctctgcggccaacataaaggtgagaggctacaagtgattagatggacaattttatgtgattttaaagttgaccttgaaggaataaaacctaggtaggtagcagaaagggaagtggcgtttggaagtttctgcttgaattgatggacaggggccggtgttgagtcagggagagatggggtctgagcctggcccggaacggctggtctggtgttgctgtgattgcatggagaggcaagcgggggggtggggctagggaggcaggaccacaagtcgctcctgccagtgagcaagttgcttattaaacaccttgggtgcatgcatgagaactgctgaggggctgtgggacccaggggccccgtggacacagtccctgccccccagggagcttggtcggtttgaggagaagtgaaaggacttatggctcacagtgctcagtgctgtgtgtctgtgctctggatgctctgagaatatgtgtggactgacttgctgagccttcggggcagcattctgtgggcaggtactattttgtacccattgtacaagctaggaagctgaggcacagcaagatgatgtaatcgtctgtggtcatacagcctccaatacagagtcatcccagggagggtgtcaggtgaaatgctaggcccaaggccagaccatggggcagtacttctcagccaggggtgatcttcatcccccaaaatgtatggagactgtttgggttgtcacggaggagaaggtgctgccagcatccagtgggtagaggccagggatactgtcaaacatcctacaatgcacaggacagccccacagcacagagttatccagccccaaatgtaggtagtgctgaggttgagaaactgcctgagcggcataggagttcagatgcaagagagagaaatcgatgagagagggaagctggttagggatggtttgtggggagttggtctgagtytagaagggttggggaggaggagcggggatagggggttaagtaaagtattgagtaatatttgtgttccctccaaatacatattgaaaccctaatcccaatgtgatgttatttggaggtggagcctttaggaagtgattagcaggagggtggagccctcatggttgggattagtgcccttaaaaaagggaccccagcaagctctcttttggtatgtgaagatgctagaagttggccatctgcaactcagaaggggctcttgccagaacctgacagtgctggtacgctgagckcagacttccagcstccagaactgtgagggataaatgcctgttgtttataagccacctagtctgtggtactttgtcatggcagactaagaacagactcagacaaggggaggacttaagtaaaggtggggatggggcctgggcaggaacaagccgcgcttcctgaggcccttaagactccagctcatggcctggagtcacctcctttcctcctcaggacagcccacaagggggacagcagatgctaggtgcacagatgggccatcagagactctaaaggcacaggagacttgcccagggcccccagctggccagtgagtccccaccctcctgcgaatcgctccttccttatctgcgtggggaccagaggagggaagcagtgaggctatgagggcagcctgactccctctgcagctgccacagcatcaaggtggaagcaaagcttgctggagtacagacggagctctgtctgcacagtttcctaaggggaaatggattgtttgaggagctgaactttgatgtctataaatgtaatctctatagaaccagaaaattaaaaggccgagtggtgataaaagagatgtaactgatgaagatgaagagtaagaaaagaaaagcagtgctttcgtggccacccatagtgaagaagtacttagcagggcagaccccgattagagcacagctgaacttcctccctgccacagtgcgccgcttgttgaatggggaaatgtgatggtccgtccgtggaccaccctggctggtgggaggtgtaaccactgataacagccagaatcaccagtaccaaatacagactgacatcagtgggtcgtatcacctttttaaaattctctagaaaacacacccctttttgcctgcacctggacagatgtgcacactgccctacccccacccctcgggccactgcagagcagcatctggaccacttcaaggctgtgttcaaatttgtttcagtgtatgtccatgctctttgcagtgactttgacaagcaactctcatcctgatgaatcagtgcttctcaaactgattggaatcacctggggatcttgttagaatgcaggtctgattcagcaggtatagggtggaattctgcatttttggcaggctttgcggcggggatggcatcaccagtctgcaggctacactttcaggaacagggatccaaagtgtgcattctgcatctggccacttcaatactggttgactattgtccccccaggttacaggaaatcaatttctagagtagaattataggtattgacttgccttactcttcctaccttattttttgggtcataattaattcccaaggcataattattggtgggtggaacattttacaggctgcctctttctgtgcctttgcctctgtggtcctgccctctgggtttttgctctgttttagaatagcgcacagcttcccttgcttccccaggagcatcatggttctgctctcccgttgctatagagaccattctggcttctcttttctctcttcgcccctcttctctgggcttcccctcccaccagatttcttaatttgctgtaccgttccactgttgtcatggggaccaaatgaccctttatttaattggcacctccaataaaatkgcagctcagraatccaagttaatgggacccaacatgaaacattgattaggaacagcagagcaaatgcatggtctcgttatttcaaattgctatttctctaagcttcatcttgcaacacattttccccaatctagaaaatttttcactgagggacagatcaggcatcccaaatcaattcacagagaaggaaagaaccggaaagaacccaccagagcaatatgaattttttaggcaacattgagaaaatagagtcattctcttgcttttcggtatgttgggtaacattttctgtatcacacaagcatacctaaataatctcagtggttaataggcgtaaacatttaaagcaggtggctttgcctgaagggttgagattccaacaacatgctcctgtcttcatcattcatctctcttctttcccacaaattcctggtctcctggtgtgtgattagagagaaaagggtgaagggactccagccccctctgggctcagagccctgtgcttagtactgataatgtctcttatccagccccggagagggtgcgcttccctgaatctccagtgcctaacacatttcttggcacatgacaagtgattcgtaaatatttattgattaggtggatggaaaggaggaagcactcaaagcagataaaaatatctgcatgaatgtctgagctgctctccaccgtacctcctagccccacaaaagaagcccactttaaattttaggaataggtttaagcataatggttgagatttggtgttaaaggcaaagacatttaggaataaacacattaaagggggtgcaatcattgaaattaggactgccagagacattagtgagcttcaccatttgttgtgaagatgaggaaattgaggtgggagaagggccagcaaagggcttcagatcccactgcttggggtagcagaaacaaaacttgagttcaggttttctgacaccacaagagtcctcttcaccaggctgtgctggtcctattgataggagcagaaggccagagcatctccctttgtcgatggggacgatgggatctgccgcatatggaaggcctggatccttcacagatgttcatttccccagggagaatcacactcattccattgctgtgctttggaatcatttccttaaccagagcagttccctggagatgttccaaaaccaccaggagatgncacatgaatgtgaatgctaagtcgcatggtacatcgaggccacaagctgagtgacagccatggggaggctcaagtcctgcagaaagcagaggaattcagagcacggggggagcagatgctgacggcggggaaattgagttccatcaaaattcacacattaggagcacaaactagaagcagaagtcagtggggaagccagggggtgggggattatgaggaccaggaaccccgaaaaactcttgccacgtaggaaaatgaactaaaaagatggccccaattcaaggctggaatttggggacacagatttgttctgtggctgaccctgttgtctttgtggagcaagccttattcacaaaagacacaccctctctggttgtgtatatggggcattatggtgtagaaatactgtgcgttttgaatgcggacagacataggattgaatcttgctgtgtgtgaatgtgagtgagtcatttaaaatctctgagcctcagtttcctcttctataatatagaaataattacagccacattaaatgagacagctcctgtcctttccaggttaatgccagataacagtgagtgttcaatgacaggtagttacagtsattttggttcaattagtttcatcatcagggtgggttttgatgcagcagtgatcttaggggtgttcctgcatgacatagacatgcagatggctgaacaggggtcagctgtatagtgactgggcaaacaaaatttcccacaagatgtcaccctcaccccacccttgccagcgcctgctctcactgagcacactggctgcaggtgtgactagtaaattgacatctttgggtgtaatcatccatggagaaattaagccacctggatgcagatgaggtcattcattgttctgcagtagtagtccacaacagttgttcgcaaaattgagcgtgcacctgaatcatctgggagatttgtcatccacagattcctgggtcccacccctaggttttctgattcagtggggcttgggtagagcccagaatctgcacttctaaaaagtggccaggggctgctgctgctnctgtgtggggtttaagagccattggtgtacncctgctggccaagcntagtaaagctggataaccagaggcaaaatagcccctacctctccctcaatctaaagcatatcctgtaactcagatacaaaaggggtataggtcatttctgccactccaagaagcactcttgctacagattctgtttgcngtgaagttgtctaacaccagtttcacgcctctgccaggcagggtncctgagcagggatccatagttccagtcctgaccccacagagcccttggacaaagcaatctgtgtctatgtcttcatctttaaaatgtgaaatgtaagtcctgacctcgcactgaaaaagatttggtagactggtcaaggagtgacagcagtagtggctgtggaatttacagaattctatttatagaataagaggcagacgatcacccttcatgcatgcttttcttggatttgtcactgttctttacaggtcctctttccacttcactcgtagagggcgcaaactggacccactcacttgtgaactgagcaggtgctgtctctgagcgatactgtgggcttggatagaacagagcttgccttttccctgagtcccwcctcattccctggtagctgttctctcctgcaggaaaagttacccacctctcctcccacccaccccacagttccctttggagtagtrggcctggggctgaacttgagcggtttcccaggcagctggccttatagatgggagtccagttgggcaggtgcttcccactgagggctatgacccrcgctgcctcagctcttatagcagggccaggggctgcagggcctgcagctacaacagtgtggtctgtttaccccagcatgcaaacatgatcctcctgcataccatgacttgaaaggggtgggaaggcacctgctatcagccattccttctcctccatgtggcaatgaggagtttgttgaggcacagcasgcaccctggggagactggaagtggacatttgtttcagggctgagttccttttgcctggcaccctcctctagggtgaagctgacaagtcagtggtcaggcctgcaggagcaaaccttcccaccacccagcagagggcaagtgtagccttgtgatggttttctaaagatgcttctgagcacaccagggcttctgtcactgctgtgagtctgatcaggggacaggagcaggagcctgagctcagctcagaccacacagaggtggaagctttctacatagtctctgaaactagttcctttttatagtcgaagatcagctttccctctacgctccattttaatttagagggagaggtgtgtcatcagggatcatgaaacaacagtctgcaagtcgtatttcttcctcttccttctccatcaacacccatcctacaaccctccccattctcccaaggaggcacacactgattggagtccctggttgctgtgggaatgttgacagctataaaatctctaactggcagaaagaaggggaaagaggagcatcagagacaagagaaaagagccatgatgaatcaggccagttgctgtgagttagatgtcctttgttagaagaggagtcattgctagagtttgcctttcagaagaaaagtccatttcccactcatgttgctcctggctggggnaaatagtgtgcctccttcatctttgaagccaaaaaggacatctgatacttcctcatagttgcacaagtactttgatcagatcccttgaacccagcccacttcccaaaaggaaggcattgcccacaggaaccccatctgtgcgtgggctaagagggctccatctgcaacatgtggcgtcttagccctgggtaggtgaagccgagcagtgactgtaccagcccaggcaccagaggcctgcaggcaagcaggcagtgggtccttcggaagactcagtgcagcttcttttgcctttggtgctgcctgcttttgtttattctgtctgcctcagtggtcaccatacccactgtactttattcatgtttaagggcttaaagaatcagtcccgagtcaagctgaatatcgtgagatgtcctccggtgaccaccgtgttaatcagaagaccagaccttcgctaccagctcggtttcagcgtccagaatggaattgtaagtagaacaccttccacacccttttccacaatgttgacaaataaaaatgtagcatggctgggggggtggagccaagatggctaaataggaacagctccagtctacaactcccagcgtgagtgatgcagaagacgggtaatttctgcatttccaactgaggtaccaggttcatctcactggggagtgccggtcagtgggtgcaggacagtgggtgcagcgcactgtgcaagagctgaagcaggacaaggcatcgcctcacccgggaagcgcaaggggtcagggaattccctttcctagtcaaagaaaggggtgacagacagcacctggaaaatcgggtcactcccaccctaatactgcacttttccaatgggcataacaaacggcacaccaggagattataccccacacctggctcggagggtcctacgcccatggagcctcactcattgctagcacagcagtctgagatcaaactgcaaggtggcagcgaggctgggggaggggcacccaccattgcccaggcttgagtaggtaaacaaagcagcggggaagctcgaacggggtggagcccactacagctcaaggaggcctgcctgcctctgtaggctccacctctgggggcagggcacagacaaacaaaaggcagcagtaacctctacagacttaaatgtccctgtctgacagctttgaagagagtagtggttctcccagcacacagcttgagatctgagaacgggcagactgcctcctcaagtgtgtccctgacccctgagtagcctaactgggaggcaccccccagtaggagcagactgacacctcacacagccgggtactcctctgagacaaaacttccagaggaacgatcaggcagcagcatttgcggttcaccaatatccgctgttctgcagccactgctgctgatacccaggcaaacagggtctggagtggacctccagtaaactccaacagacctgcagctgagggtcctgactgttagaaggaaaactaacaaacagaaaggacatccaaaccaaaaacccatctgtacgtcagcatcatcaaagaccaaaggtagataaaaccacaaagatggggaaaaaacagagcagaaaaaccagaaactctacaaaccagagcacctctcctcctgcaaaggaacacagctccttaccagcaacggaacaaagctggatggagaatgactttgacgagytgagagaagaagrcttcagaagatcaaactactctgagctaaaggaggaagttcaaaccaatggcaaagaagtgaaaaactttgaaaaaaaattagacgaatggataactagaataaccaatgcagagaagtccttaaaggacctgatggagctgaaaaccacactacaagaatgtgacaaatgcacaagcctcagtarccgatgtgatcaactggaagaaagggtatcagcaatggaagatgaaatgaatgaaatgaagcataaagaggattttagagaaaaaagaataaaaagatagatagataggaacaaagcctccaagaaatatgggactatgtgaaaagaccaaatctacgtctgattggtgtacctgaaagtgacggggagaatggaaccaagttggaaaacactctgcaggatattatccaggagaatttccccaatctagcaaggcagaccaacattcaaattcaggaaatacagagaacgccacaaagatactcctcgagaagagaactccaagacacataattgtcagattcaccaaagttgaaatgaaggaaaaaacgttaagggcagccagagagaaaggtcaggttacccacaaagggaagcccatcagactaacagcggatctcttggcagaaactctacaagccagaagagagtggggccaatattcaacattcttaaagaaaagaattttcaagccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacaaaggggatatcaccaatgatcccacagtaaatacaaactaccatcagagaatactataaacacctctactcaaataaactagaaaatctagaagaaatggataaattcctcaacacatacaccctcccaagactaaaccaggaagaagttgaatctctgaatagaccaataacaggctctgaaattgagccaataattaatagcttaccaaccaaaaagagtccaggaccagatggattcacagccgaattctaccagaggtacaaggaggagctggtagcattccttctgaaactattccaatcaatagaaaaagagggaatcctccctaactcattttatgaggccagcatcattctgataccaaagccgggcagagacacaaccaaaaaagataattttagaccaatatcsttgatgaacattgatgcaaaaatcctcaataaaatactggcaaactgaatccagcaacacatcaaaaagcttatycaccatgatcaagtgggcttcatccctgggatgcaaggctggttcaacatacaaaaatcaattaacataatccatcatataaacagaaccaaagacaaaaaccatatgattatctcaatagatgcagaaaaggcctttgacaaaattcaacaacgcttcatgctaaaaaactctcaataaattaggtattgatgggatgtatctcaaaataataagagctatctatgacaaacccacagccaatatcatacygaatggacaaaaactggaagcattccctttgaaaactggcacaagacagggatgccctctctcaccactcctattcaacatagttttggaagttctggccagggcaattaggcaggagaaggaaataaagggcattcaattaggaaaagaggaagtcaaattatccctgtttgcagatgacatgattgtatatctagaaaaccccactgtctcagcccaaaatctccttaagctgataagcaacttcagcaaagtctcaggatacaaaatcaatgtgcaaaaatcacaagcattcttatacaccaayaacaracagagagccaaatcatgagtgaactcccattcacaattgcttcaaagagaatacaatacctaggaatccaacttacaagggatgtgaaggacctcttcaaggagaactacaaaccactgctcaaggaaataaaggaggatacaaagaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaaattcatatggaaccaaaaaagagcccacattgccaagtcaatcctaagctaaaagaacaaagctggaggcatcacgctacctgacttcaaactatactacaaggctatagtaaccaaaacagcatggtactggtaccaaacagagatatagaccaatggaacagaacagagccctcagaaataatgccacatatctacaactgtctgatctttgacaaacctgagaaaaacaagcaatgggggaaaggattccctatttaataaatggtgctgggaaaactggctagccatatgtagaaagctgaaattgggtcccttccttacaccttataaaaaattaattcaagatggattaaagacctacatgttagacctaaaaccataaaaaccctaggcaataccattcaggacataggcatgggcaagtacttcatgtctaaaacaccaaaagcaatggcaamaaaagccataattgacaaatgggatctaattaaactcaagagcttctgcacagcaaaagaaactaccatcggagtgaacaggcaacctacagaaagggagaaaatttttacaacctgctcatctgacaaagggctaatatccagaatctacaatgaactcaaacaaatttacaagaaaaaaacaaccccatcaaaaagtgggtgaaggatatgaacaaacacttctcaaaagatgacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaatacgaacacttttacactgttggtgggactgtaaactagttcaaccattgtggaagtcagtgtggcgattcctcagggatctagaactagaaataccatttgacccagccatcccattactgggtatacacccaaaggactataaatcatgctgctgcaaagacacatgcacacgtatgtttattgtggcactattcacaatagcaaagacttggaaccaacccaaatgtccaacaatgatagactagattaagaaaatgtggcacatatacaccatggaatactatgcagccataaaaaaggatgagttcatgtcctttgtagggacatggatgaagctagaaaccatcattctcagaaaactatggcaaggacaaaaaaccaacactgcatgttctcactcataggtgggaattgaacaatgagaacacatggacacaggaaggggaacatcacacactggggactgttgtggggtggggggaggggggagggatagcattaggagatatacctaatgctaaatgacgagttaatgggtgtagcacaccaacatggcacatgtatacatatgtaacaaacctgcacgttgtgcccatgtaccctaaaacttaaagtatactaataataataaaaacgttaaagtggacattttagtaataataaacatctgttggaatgctttaaaaaaatgtagcatggcctttttttttttttttaaattgagatggagtctcgctctgtcatccaagatggagtacagtggcacgatctcggctcactgcaacctccacctcctgggttcaagggattctcctgcctcagcctcctgagtagctgggactacaggcacgtgccaccacgcccggctaatttttgtatttttagtagaggcatggtttcaccatactggccaggccggtcttgaactcctgaccttgtgatccacctgcctctgcctcccaaagtgctggtatcccaggctcccagggcctttgacttttttttttttgttttaagccagtttgttccctgaaggaatccatcaagaaagagtatgagtggatgaaggaggctcagctccctctctggacagagtcccttcagcagagattcccacccagaacccagtgtttctgtgacatgcaggactgccttcccggctgccagcttgagagtttgggatgcaccctccaagagcctccttgcctctggactgtccaccctggctgcacagagtcccgcagagcagctgactcccaagcctggggctgtacagtgcaggggccggctcagttcccacagtcacaattgggactcgaacagtttggtatttgagtgatccttcaaaccttggccttccggcgaagccaggcagatcacttgaggccaggagtttgagaccagcttggccaacatggcaaagcccagtctctgctaaaaatacaaaaagtagccaggtgtggtggcgggcacctgtaatcccagctactcaggagggtgaggcaggaggatcacctgaacccgggaggcaaaggttgcagtgagcagagattatgccactgcactccagcctaggtgacagagcaagactctgtcttaaaaaaaaaaaaaaaaaaaaagtcctaggtaattaaaatatcattccaaatacatttgaaggtttagaaatacccttgaacttcccatttggagttgaaatatccagccccacttcctgcattctttgtacctgagtagcctaatttgcctattaggagaggatctagggtgactctttacagtttagctctgagatcatcttttcattggtttgtacttgtacttgtttgctttgttcatagttaaactgcattaaaagttcagatacgaacaaggagttgttaacatgtgtgggtccactgggaaaacacctaaggaatgttttgaccccagactagctgagagagcagctgggccacacactcagaatcacacagcatgttgctgcaagatgtcacttgcaatcttgtctgcatccacttttaaataaaggtgcatggtctggaatgaaaagccaacttagtaaattcagacctactcttttgggaaaagttatgttgtagtgtgtgtgaggtaagggtggagggcgcatcagccccgcctgcaacctcgggtcactgtggtacctggctgtgccatcacaaaatccagcctcactgtcttttctgtgggaagggagtttgaacaggggccgctgaattgggaayctctgaaggagtctctcccctccagccagccacactttggaacacggagtggagttccagccccatggtggctcaggcaatcgtgaccctaaaaacagtctgctggcattaaacgcttcagtgcttgagtcccagtcatgactacgggaactaacactaacctgtgtcacacaggctgacagtttggaaacactggcgactctgcgacagacccaaatggccctttttacccagccccagctgggatgagaagtagaattcagtgtgccgtaaaaaccagtgatgtgctacagtctctgtgcaagccgcatgaacaaggtggccatgtgggccgacggcacctatttttttgtgaaaagacactaagagagttaaatgcccaaagcctaaccatgtcagtttctccaagagcagagtgtaggggcagggggctttcaggaaagacggccttccagccccaccgcactgtctgcaatgagggtaactctgcctttgactntggcagatctgcagcctcatgcgagggggaatagctgagagaggaggcgtccgtgtggggcaccggatcattgaaatcaatggacagagcgtcgtggccaccccccacgagaagatcgtccacattctctccaatgctgttggggaggtaggagaggtccggggctgagggtggtgctgagggncgcgtctggtgcccctgcctcgtatgctcaccgtggccctgagcagaccttccaggaaagctccctgagtttccaatcctgaacactccccaacaagcagacctgtctctgaccaaatgccaaacccattagcaagcagttatctgggagctcctccatgaaatggaatcagatcaccctcagccttctctttcatctgatgtgctcaccttctctttttaacactcagctttctgttgcttttctgtatggccgcctaagttgcctccattttccccagttaatctccccaaatgtttttaaaagatttaagtcttagactcaagttgaatcaacaaagtggccttccagaggtgtgaccccagtgcagtgtggcatgacgtgtcattactgtcagtcatcacagctgtcagtcagtcatcattgttgccattcatcactcctatcagtcatcactactgtcaktcatcactsctgtcaktcatcactrctgtcagtcatcactgctgtcattcatttatcactgctgtcagtcawcactgctgtcattcatttatcactgctgtcagtcaacactgctgtcagttaccactgctgtcagtcatcactgctgtcattgatttatcactgctgtcagtcaacactgctgtcattcattgctgtcagtcatcactgctgtcattcatcactgctatcaatcatcactgctgttctagggctgatttgtcatccttgcctcatctgccaagagagatgagggaggcaggcaccctgagaagcctggagcccttcctccattttcagagttcttgcttttaaaagggtagggtctggtgagagcgagagcatttgactgagaaataagccttgcttggtttttgttgttcatttctgtcacccctaagcttttgagaaagtcagtggattccactgttcctggaggccaccctgggtcaggtccctggtggtggctgggcggtagggagtatcttcaaagccctctgtgggagaggcactgcctctctggccagccctgggcagtgcccacgcagccagcccccagcctcagccccccactaaagtgtgttctttaccctcagattcatatgaagacaatgccagccgcgatgtacaggctgctgacggcccaggagcagcctgtttacatctgaccgcggccacacgcggtggcatgcatggaggactctcctcttcgtggttgtgtttctcgtgctgcatccctgtgtccactgagactttcccctctcgcgcccagcatttggttttacacaggaagagaagaatccacaaggacctctttactctctccgatttgcttttttttttttttttttttcaataccagggaagtttygyatgcactcccttgaggatggagagcagccagcacccacctggtactgacccaggaccatcctggagggctttctgggtgtgtccagggggtgggctgtcactgcttgagggagaatcctcccttcccaggaggtgcagacttcttaaaaggagctcgcggggcagcaaagcagctgattcagcagtgcctaaaacccagttgctgatccctgctctctgagtttatctgtgggaatgtggtagtacccagggccagcccacgtcattaaggttatgcactgcctgccatgtagttggggcaccatacattatttcttcccagaatctctgagccaaccttaaacctcttctattgctagttctaatttcaacgtatgtgtgttttctaatacgagccttctcaccccaggataaaaggggaaataactgccttgggcaaggacaccatagtgtcacagagagcttggcaattcatggggcatctgaagctttaccaggttgtcctcaagttatcaaccattagataaacacaggcaggtactgtctgcttctctctctctcacacacacacacacacacacagtcccatttgcatatcacccttccctgctcccaccaccagtgagacaagctgaagattaggcacacagatcccctggaaacccacctctctggaaggccccttccctggcaggtggccaggcaggcgggggctgctcagcctcatcctgagagacctgccctctctgcgctgaggcccagcccctccagcaccactttggcttaaagcatcctcctcctggactcccctccctgccgaacacacatcccaggagtctgggaaggagggactgttcccaagaaggcaagctgcaggtgcaattgcgtcttgttttctggcccaaggcaagaccaactttcttctctgctcagggccactaggcggatgtgatattggaaaggccagaatagtacataaaccacaaaattaaggagacaatagcaacctcaagttatgcctcagaatccccagatgtggtccataaacaccctcttgctgccttgtgggcctgagagcatttttggctggtgtggaattgttccgtgttttcatcaggtgcctcatatttatgcttccgtctcagttcagtgtagatgttttagtaatattataattctgagccagttttcacttggtccaaagagcattttgtgttcatgtgaggtgtgatttggctttgcttttgttttgtttcattcatgacctcagtagagacaggggaagagaaactattatattttgtaattaatatagtccctgttctctgcatccgagatatttatgttgtgtctatggaaataggaactcagtgagcaaatggtgggtagcatgtatttatagagagaatggagggattctaaggagggagcaaagtgactataacaagattagggacaagagacttcaaccagagagttctgtgatcaattccccgagatctctgcatcttctgagttttctgcttagaatcagggaagctcagtgcttgacaggaacgagcagtggcactctcagtttcactgtgttacaaaggagccctgaggaagggaggccgctggctgcccaggtgccctggggggaaagggacttctgctgctgcagagagtggcacccggtggggccaggggctctgggatggtccgtaaagctccccaggacttctttgaaggatgctttacagaatgtttctgggagaccagcctcaaggtcaacccatcacaaacgtgaggaccaggaaggaaccatggccagggttctccatttgctgtagagtatctggtgatacagtgagacactaaagagtcatcagccagttcatctttcctctgccaataagagtggatagaacaggaatgaagtgttactggtggtatttcaggcatcaggagccttggaaaatcatcgtaggggcccatgcctgtctgtccctaggcacctgggcagtgccacagaggcccgcccacgactggccaggggacagaactccagtagtgcatccctgtacaacctgcacataacggttatgtatgttcacctaaaggagagaatatactttctattcctattgcacaaaaaccttgtaaactttgagaggtgctgaaaaagccaattctgcaagctctcctagaggactgacattgtaacattagagtgagaagatttctctgccacattcttttgtgttaatccaggtgtgtcttcacacccagtgagtggaagttgctggagctcggtacaggtccacccagctgaagtgggttctttttcccactaccactggggcaagggagtgagcctaggtatggtcacctcagcagccacagtcttaaaagcaagtcgctagattttttgaaagtcccaagagaagtggtggtcttcccttctgtcatcccagtatatatagttatacatgtaaatatctaaataccccatgtaatgggaaggctatgtacagggcagccttcccaaacgctgtgagggcacagagctgctgtggctgctccaccagggtgtgctggtggctcagctttggggttggactcccacgttcacctccccctcctggtccaggcagaggcaccagaacccatcctgccttttctccagtgtgagcatttcagggagccaccatcagccttgggttcatgagaggaagaaacccccaaagaccaatgcctggagcccacttctccagcgacaccttccctcgccagagcaggctcctaggagtgcatggcaggggtgccgggtccctgtgcacgggtttgctttctgaacattgcccatcaacaccgccttcagggagtcccagagtaacctactacctcccccatcgctcctctgcccccctcaccctgtgggcaccaacacctcccgcacacagatgaaaaccatctacagagcccttcccgggtccctcgacccagtggtgtagccgttaccaatgtttacaaccaggggccgcccctccttagatgtgtttactcgcattcacaggccacctgttggtttgagtttcatgtgtctccttccctggcctaggttgacttgagcacacaactcgatctttcttcccctccatcaaggcagtgtgtgaggactgtgtgggaatgacatttcttgtacatacttagcacagcacctagagtatgaacttgtactattgttctgtaaagagggtgaaatagagcttattgtaaagtgtcgggagaagtatagtattgtatttgtaacaatatcgttctttgtatacacaaaactcaatgatctatatataaatataaataaatatataaataaaatatatctacacgtgagcctggaatgtggacaccgcacacccactgaatgtacttccttgacagtctggtcactggtccctccctccctccctcctccgtcccgtggccacagtcatccagtttggggttgtgatgtatttactgtgctatctatcttcctttatttaactgaacgctaatgtctgtataagagttgctgcaacaataaacaagaacttcacctcttggcctggccaagtgtcttcttgttgcagggaaggcttgggatcatgtgatgagtttgtcttttccctaacagactgactgactagctcctacccaccctataggcgcccagagcccaggagttctctaaatgagcttttattctgtggaactgacttggttttagacaagaaaggctctgttctcctgtcccagttgatcctccagtcctgtgggtctcctttgagcacactgaactggagaaagagaaattctccggatttcttacttgacatcctccatgagggcaggaaaacaggaattaattctcccccacctcagtcatctcccgtaagggaggtacctttttgtaagggactaagatctaagtggacggtggaaaacagcgccctgagaggcccatccaaaggttctgtgagaaggttctggaaggtttcctcctggtgctctttggaaattcactttttgaaggttgccaggcatgccctccctgctgccgggggcatgctgggggccctggactccccaacacagagtgtccagccctgttccaaagcagactgcttgtcagctttttctttgcatacacccctcccccatcttccctgcaaagctttttgcagccccgtcaggtctgtagctgctgaaagccctgaacatggaggcagggccttatcctgagggtcctgtggcctggccccgaggagccccttctcctccatcctcctcacagcaagcagagtgtcccaccaccgagacggctgccattgaatcaagtgggaagaaagcacattgaactggtgtctggggaagtcacaatttgaagaatggcagctagtctttatagtaacttccatgtgccaagcatcctacagagatgaacttggtaactccccacaacacctctaagaggtagaagcttttcctgtattatcattgtctccattttatacaggaggaaacgggcacagagggttcaagcacttatgctcagctttccaacaactcccacctgcacccacctgggacaggcttgtcatcgcacacggatgaactcagcgttagacttttgggtctcttttggttcttataatgttttccttcctggttttcttccattgatttgcaaaccacatctcttattcaaatcagtctgccctacttccccatccccagactggaattgagcactggcctaggagagcgggacttgctctcagctccctccctccctccctgtctccttctttgagtccctttatgggaaggggcatgggtaggaggtgcacagaggttcccctacattaagagttgcccttgggaaggtcacagtcctcgccttgctggttcattctgctgatctggtccactgaccaggagatcaatgaagacaaacaattggcagcaaccgggcattcagggtccctgagccctgggccccatcttccagctgaccccttagccacagtcctctaaagcagcagtctccaccttttttggcaccagggaccagtttcatggaagacagtctttccagagaccgggtgccacggagggggatgattcaagcacattatatttattgtgcactttatttctctgattgttatataatgaaataattatacaattcaccatagaattgtataattatacagttcacaattctatggtgaactgtataattcagtgggagccctgaactggttttcctgcaactcaatggtcccttctagggctgatgggagacagtgacagatcatcaggcattagattctcataaggagcctgcaacctagatccctcgcatgcacagttcacgatagggttcacactcctatgagaatctaatgctgccgcagatctgacaggaggcggagctcaggcggtaatgtgagccagcgacggcgagcggctgtaaatacacatgaagctttgttcacttgttgctcgcctcctgctgtgtggcacagttcctaacaggccacagactggtaccaatctgtgcacacctctaaagtgcacacctcttccacacaggttgtgtccccagccgcctgcagccaccatctccccagccagcaagctcctgaagcatccagcaaccatcctcctcaccctcagaggaagggaggggcacccctggctgtctctcccctgcccatcccagagccattgcttcctattatctctctcaccacccacagcaccacaccttctgctggtccggtccctcggccacatgtagataagacgttaccagcacccagttcagtgtgtggggaggcaagtggagggcacaggcccccagccttcacagtgatgctcttgggattcgcctcccttgacgaggtcaatattcccttgcctcccagagtggagtggcgagtaagtagctcctttcctgaattctgcacccatcccccgccaatgacaacacccctctcacatcaccaggatgacggtgggaagacagctggtgggagggtctagtctttgaactggcacctctcagcaagctccctggaagtctgtctgtcccacaggagaccacagtcccctgatggatggtatctgcctgtgtgggtgtggtctgcccccacaggcaaggctgctcctaccatagactataccttagcttccccctcttggctttgatcttagatgaaattgcagaactagagaaaaaaaccatttaaccaccttgatgcacatagaaccactttatttaggtctttcttctataatttttgcttaaactgtgatcctcagagttccttaaaccctctgagcttgtttcctcatctgcaaactagtgtttatctcagggagaccgtgtgaggataagctaacacatagaaagctttcagaatgtgcatggcgcatagtggttgctgaggaagtactggccgttcctggggcccagcagatccaggtcctcataagcttcctggaatttccagaccccctgggtacaccaacgggagccacaactcaagaggctccgcacgcacttgcatggcttagtgcaggtcgcccccaaacacccgaagtcctaaactactgatgtactgaatttcatccaaaagcagattttagcccctgggaaaaacttctagatgccaatgcatacttttttaaaagttaaaaaacataactcccataacaaagatggaatgaacacatatcagagatttattaatcattaatgatgaaacaagtaagatggtaaagctggtccaaaaag

SEQ ID NO: 10724 - DNA, 51008 bp, Homo sapiens
gctgcccaggctggagtgcagtggcgcaatcttggctcactgtaagctccacctcccgggttctcgccattctcctgcctcagcctcccgagtagctggaactacaggcacccaccaccatgcctggctaattttttgtatttttagtagagacggggtttcaccgtgttagccaggatggtctcgatctcctgacctcgtgatccgcccgcctcggcctcccaaagtgctgggattacaggcgtgagccaccgcacccggccaaaatacctattttctagtctcctaagttacccgagatgcagttgttaagcattaaaacagatgccaacaggggttcagggaaattccagtttctatccctttgggttttttgttttgttttgttttgtttttgagatggagtctcgctctgtcgcccaggctggagtgcagtggcgtgatctcggctcactgcaacctcagcctccagggttcaaacgattctcctgcctcagcctctcaagtagctggaattacaggcgcatgacaccacgcccagctaatttttgtattttttagtagagacggggtttcaccatgttgaccaggctggtctcaaacttctgaggtcaggtgatccacccacctcggcctcccgaagtgctgggattacagatgtgaaccgccatgcccagaccctttccctttgtctgattgatatcattccacccctgttcactgaaccaaccagaggcgtgtgcaccttctggaggctggaatgattcgtgttagtctgaatgcctgggctttggcataaaggccctgagtccatcttctggctctgctcctgatcagctctgtgaccctgggtgatggtcttagcctttctaggcttcggttttctgatctgtaaagtagggatgataataacattacctagcctgtagtcccagctatttgggaggctaaggtgggaggatcctttgagcccaggagttcaagggtgcagtgagctgtgaccgcactactgcacccaccctgggcaacagagtgagaacactatcctatctccagcaggcacgcagggccccataacttaagctcatgtgatcttatccctgccctcttcttggccctagaatcctcaccatgtatttgctctgcctagactgggctgtgcattcctctgggaaggggtggtggttatctcgctcatatcccagggccagcacagggataaacttaaaattgtttggaatgaacaacaacaaaaaaatcagggctgggcgtggtggctcattcttgtaatcccagcactttgggaggccgaggtgggagtatcacttgagtccaggagtttgagactacccaggacaacatagtgagaccctgtctctatgaaaaatttaaaaagtagctgggcatggtggtgtgtccgtagtcccagctactcaggatgtagtcccaggctactcaggaggctgagatgggaggattacttgagcctgggagaccaaggctgcagtgagctgagatcatgccactgctctacaacctgggtgacagagtgagactttgtctcaaaaaaaaaaaaaaaaaagaaaaagaaaaaagaaaaaaagaaaaaagaataggcggggcatggttgcttacacctataatcccagcactttgagaggccaaggtgggcagatcacttgaggtcaggagttcaggaccagcctggccaacacgatgaaaccccatctctactaaaaatacaaaaattaagtggtcatagtagcatgagcctgtaatccagctactcgagaggctgaggcaggagaatctcttgaacccagaaggcgaaggttgcagcgagctgagatcacaccgttgcactccagcctgagtgacagagactccgtcttaaataaataaataaatcggtcaatttggtctaatccagtgaatgtctcaagtagcattattgaggcatattttccatatcataatttacccttttaagtgtgcaatttagggattttaccacatcatcatagtcaatttaccaacctactatggtgtaaccaccaacataagtcagttttaaaatattttcatcatcccaatatgatctctctttctgagacagcgtcctgctctgttgtctaggctggggtacagtggcggaatctttgtacactgcagcctcaacctcctaggctcaagcgttcctcccacctcagcctcccaagtagctgagactacaggcatgcaacaccacacccaactaatttttgcattttttctagagtttggtctcattatgttgaccaggctggtcttaaactcttgggctcaagtgatcctcccaccttggcctcccaaagtgctcgtattacaggtgtgagccacaccacacctggcctctcttttttgttttttttaactgacctatttcaaagcactttgcagacatttttaaatgtcacccctacacccttcatcatgtatctcctaagattaaggagagctcttccaaaaccacaatacccataccgtcttgctttgcttttcatttctttttcgagatgggatctcattctgtcacccagactggagtgcagtggcgcaatctcagctcactgcaacctccgcctcccaggttcaaacaattctcctgcctcagcctctcgagtagctgggattacaggcacctgccaccatgcctagctaatttttgtatttttagtagagacagggtttcgccatgttggccaggctggtctccaactcctgacttcaggtaatccacgtgcctaggcctcccaaagtgctgggattacaggcgtgagccaccaygcccaacctgttttgttttttaaattcaagatctaatcaaggattaaaccttgcatttcgttgtcttgggaagccagaacccagactgaattgaatccaggttaatgaacattgctagcccatgtgaaaacttgcacaggccaggcgcctggggaaagtgcagtgcaccctgaatctcatttaatcctcagaacgttctgctaggtgccactgcccacattttatggagagaggtggtgtcctccaggctggagtgcaatggtgcaatctcagctcactgcaacttctgcctcctgggttcgagattctcactcctcagcctcctgagcagctgggattacaggcatgggccaccacgctcagccaatttttgtgtttttagtagagatgggatttcgccatattgtccaggctggtctcgaattcctgacctcaggtgatccgcccgcctcagcatcccaaagtgctgggattacaggccaccgcgcctgatcctaaataatcatttttaaaatcaatcaatccttccttcctccttcctccctcccctgccttccttctttcctttctttctttcttccttcctttctttctctttctttctttctcttttctttctttctttcctctttctttcttctttctttctctttctttctgtcttttccttccctccctccctccttccctccctcctccttcccttctttccttcctctctccctctttctttctttcttctttctctgtcttttccttccctccctccctccttctctctctttttcctttctttctttctttctttctttctttctgtctgtctcttttccttccctctctccttcccttctttccttccttcctttctttcttccttccttctttccttcctctctccctctctctctcttttttctttctttcttctttctttttctttctttgtcttttccctggcgcctggtggcaggcgcctgtaatcccagctacttgggaggctgaagcaggcgaactgcttgaacccaggaggtggaggttgcagtgagctgagatcgcaccactgcactccagccgggcgacaagagcaaaactccatctcaataaataaatacatacatacatacatacatacatacatacatacatacatacatgtatacatacatactattggaatctagcatggaggttgccacccccttttgctggtgtggggtgcagttctgagaggcagggcagacacccattggggccttttgctaaggaccgaattgtgtccccctagaatttgtgcgtcaaactccaaatccccaatgtgatggcgttggagattggggcctttcggaggtgattagggtttgataaggtcatgagggtggggccctcaagattggatcagtacccttataaaaagagacaccagggaacttccttctactctctctcrccatgtaaggacacagtgagaaggcacctggatcttggacttcccagtctccacaaacataagaaataaattcctgttgtttaagcacccaatctgtggcattttatttatttatttatttattttagagccaaggtcttgttttgtcacctgggctggagtgcagtggtaccatcatggctccctgcagcctcaaacggctgggctcagggcatcctcctgcttcagcatcccaagtggctgggactacaggtgcatgccaccacgcttagctattttttttttttttttagagatggggtcttgctatgttgtccaggctggtcctgaactcctgggttcaagtgatccttctgcctcaggcttccaaagtgctgagattacaggtgtgagtcatcacacctggcaatggcattttattatggcagcctgagctgactaaggtagacagcagggaaagaagcttccatgcattcctctttggggaatctgaactttccaaggcctgcctccctcctctgcaggacgctggaacatgttcagtgataggtgggcctgaggctgtgcatcccatgtccccagagcctctctgttgctagaaaatgttctttctttccttgtgattaaggagaaatctgccttcctgggcctctccacccctggggcctgtctctactactctactatttgggtttctagaaccctcccatctcctttggagacatcctctttcttttttcttttcttttcttttttttttttttgagacagattcttgctctgtcacccaggctggagggcagtggcacgatctcagctcactgcaacctccgcctcccaggttcaagcgattctcctgcctcagcctcccgagtagctgggattgcaggtgccggccaccacgcccagctaattttttgtatttttagtacagatggggtttcaccatgttggccaagctggtctcgaacctctgacctcatgtgatcctcccgcctaggcctccgaaagtgctgggattacaggcgtgagccacctcgcccagcctcagcctttctcctaatcatcaccttgccctgggcgggtcctaactgccgggagcccccagcaagcctcatcttaacaagccagaacatagcccacatgaggggatgggggagtgactggaagtcactgggccatggttgcaaaggtggcgaatggcagaggagctgggacacacccacagggtgtctgaccgtgattttaactgctcttccacgcctccgtgaatgaatgaatgaatgaacacatgttctactaccagactttgtttttcagaaatatagcaaccctttggaaaaatcataggtccygtcactaacaagttgaatttagttatcaagtcactttcttggttagagaagaggaaaggggaggaggagatgggaagaggaggagggaggagggaggatgaagaagctctgacgggacccagtagtgcaaggcagagggtgtctccggaggaagcttcccttcactgtggcaatttcctgaggcttggtcttggcttctcgcagcaaacagggtcttcatctgcccagcatctgaaccctaaccgcagagggttgagagacagaggagggggcccccacagggcctgtggtttgagtgaggaaagcaattgtgtaaaagtggagagcctttccgcagcccagggccagtccctgcctgagtcatgctagagagagagggaggagcaggcaggatcctggagctccctggatttcaagctggccgtggcctcccgggtgacgtcactgcggtcattgcctgatgagctcaggcagaggcgcctggggacggggtaagtggtgagagggagggccacggctgtcttgggtgaaccccaggctccagttggagactctgctgtggcaagaggtccaccccacccccgggcgccatctggggacactccggcatcccattccaatggctgttctgccagggcctcaccctggctcttggtcttaggactgctgtgtttgcctgcctaggtgtgcgggtcaatctgtgcagagctggggagcaagtgatcactgggagcaaagacagctttcagcctggagggagaagcatttcttcccgctaggataatggccaattcagaggccctagaccatgctgtccccagagcctgggtgcattgctgatgacgagatcccagccgggggtcaggcctcccaggactgtcaagctgggctgcttgagtccctggctccaggggtgggggtggggctgaatggcaagggagagagctggtccattccaggctccaacctcagaaccctctgggagtaagattacccagccctgtgctcgggctgagcaatcaactatagcgcacacgctcctttactgtggttccgagatagttaattgraatctggatactctgggtaaagtcagaacatccagctgggcccagcatgggagatcagcttgatgagtctcccgcaccctattctgggcatcagcagagtcagttctctgaagagtctttttcatatatatcacatagatagagagataggcaggttggtaggtaggtagataggtcaataggtaggtaggtaggtagttagacataggtatctatctatctatctatctatctatctatctatctatctatctatctatctatctatcttactgtagtttagcacagacattggttaagtcatgtcactcctctgaacctcaattttctcatctctaaaatggggatattaggccgggcgaggtagctcaygcctgtaatcccagcactttgggaggccaaggcaggtggatcacctgaggtcaggagttcaaaaccagcctggcaaacatggtgaaaccctgtctctactaaaaaatacaaaaaaaattagccaggtgtggtggcacgcacctgaagtcccagctactcgggaggctgaggcaggagaattgcttgagactgggagccagaggttgcagtgagccaagatcacaccattgcactccagcctgggtgacagagcaagactctgcctctaaaaaatataaaataaaataaaataaaatasagataataatagacccacctcctakgattgctacatgagggcaatgaactgatctacataaagcaccaagcatagtgtctggcaggtaaagttggccagtaatgtcatcaacattgttatataataataattattgtcattaattttattgcccaactggcgtcccagcctgagctgaagctctgtctcttggccaccctgtccaggaggtatgagcctgttttcttgggccagatcttctgcttggcttgaagccaaagtgtgacttcccaacctctgcatgcagccccctccccagggtgctggttggtctctcctctcagctgctgctgcaatgtgcttcacagtgacaacacacccacagctccagtggcagttgatgcatccttgtggccagaatcatgcctggcaggacgcatgtggcaaagggcttgtctgggtcggtgctatgctctctgtgccagggaaaatccagctcttggagtgggtgagagcagggaggccttcatggtggtggagttaggggatgggagagacagggaagcaatgaggggcttgcacagaaaatatcgttttaccctaagtacccagatgacaaatgagacccaaaatgacctttggcaggggccgtggcttctggggaccccagcgtttgacagagcaggtggcagagccgcaggacccagctctagtgtgtggcagtttgttggtttcattgccgttgctgggccagacgtgcactgaggaccccgggataaaggggtttactgtgaggatgctggggcccaagacctcgtgggcacaggacccaggtgaagaccccagggcccgtgaagagccgaagtggatttcactgtaggggcttcttgtcatccccaggggtacacattcttgtggccgctcctgctgctggcagccgagtccttggccacgagcccagcctcctctggggggtgggtctcagcccaggcccacatcgggctgttgatttcattggctgctggctggcctcgccattggctgcttgcagccaggtgctcacccctgcccatcagctgtggccatggtggtgccagcagggagaggagcatgtgacttgcacgtgaggagtagccgaaggcttcttccctaggggacatgtgtctacctcggggcgatgcgtctacctgtggatggggagggaccccttattggggcccaggcaggtccgcattctgggccttgtccagtacaccctctggtttccaaccagccaaccaggctcctgggggacccaccaaccctcccctttcttctccgtacttctctcctcacctggtagacacacatgtcttcattttggttcttacgttgagagacaaacccatccttccctccctttcttccttcctccctccctccctccctccctcccttccttctctctccccttccttccttcctttctttctttctttctttctttctttctttctttctttctttgtttctttctttctttccttccttccttctttctttctttctttgttggtttctttctttctttgtttctttccttccttctttgtttgtttgtttctttgtttctttctttctttcttttttcttcctttctttctttctctctgtctctctttctctctttcttttctttctttcttgcacctaggttggagtgcagtggcatgatcatggctcactgcagcctcgacctcccagcctcaagtgatcctccctcctcagcctcctaagtagctaggaccacagacatacaccaccatgcctggctattttttttttttttaactttttgtagagacaagatctccctgtattgcccaggctggtctcagactcctaaggctcaagtgatcctcctgcctcgatctcccaaagtgctgagattacaggcatgagccactgcacccagcctgagacaatgctttctctaccagtctctaccccattgcactaatagtcagtggaaggctgcagaccttcacacgtgagtccctggccctgggcctcaggcagggtttgctgggtgtatgtttacccaatagttgtgggaaagtgggtgctgacctcaccgggtgcggaggacagggtgttaagcggctcccacaaaacactccctcctcctcgggctatgttggcagaagcacatctaaccctggcgacccaaggtcatgagggggatgagttaacttccttgtgtgtcctaagcggctgctgtgtatttgttgactgtctcagagtaaatgtggttggtttactcactttctaccccttttagctggtgggactggttaaaagcttgtcctctgcataaaagctttgcctctgggattagcctggcctggttgagtctcagttgttgaaataacaacagcaataccaatagcagtgatagcttacatgtaacaccaggtatgatttcctacctggactatctcagtaatcctaggaggaaggtctattatcatgtccattttagagaaggaagaagtgaggctcagtatggtgctcagctaggaagcagtagagcctggtggtaaccaggcaggggctcagagcttctctccttcctgctccttagctgatgggccatcgtgggcaggttacttggcctctccaggactcggattccccttgtctgcaaatgggtcaagaaagtttaatgtggctgggtgcggtggctcacacctgtaatcccagcactttgggaggccgaggtgggtggatcatgagatcaagagatcgagaccatcctggccaacatggtgaaaccctgtctctactaaaaatacaaaaattagccaggtgtggtggcgcacgcctgtagtcccagctgcttaggaggctgagggaagagaatcacttgaacctgggaggcggaggttgcagtgagccaacatcataccactgcactccagcatggtgacagagccagactctgtctaaaaaaaaaaaaggtttaatgtggcagggtacgctgattcacgcctgtaatccctgcactttgggaggccaaggtgggtggatcacttgaggtgagagttcgagactagcctggccagcatagtgaaacgctgtctctcctaaaaatacaaaaaattagccgggcgtggtggcaggcacctgtaatcccagctactccggagactgaggcaggagaatcgcttgaacccaggaggcggaggtttcagtgagctgagatcacaccactgtaatccagcctgggtgacagagcaagactccatctcagaaaaaaaaaaaaagaaaaaagaaagcttaatgcatgaagtggttacagaaaataagcacttttcaaacagtgaaactcagcccctagtttgggattattatcttggatggaaaggggagttttttttgtttttgtttttgtttcttttttaacatttcccatttcacagatggagggaagagtgatttttgctgctctttctgcattaagttagagtttgtagaggtgacctttaagaccagcttgctcaaaatcagcccgcgacttgggcacctccctcaaaggcagcttcatctttgtattgtttgttttgtttttgagatgggctcttgccatgttgcccaggctggagtgcagtggctattcacaggcatgatcatagctcactgcagcctcgagcttctgggttggagcaatcctcctgcttcagcctcccgagtagctgggactataggcctgtgccaccatggccggctarctttttgtttctttgtagagatggggtctcgaactcctggtctcaaacagtctttctgccttggcctcccaaagtgctgggattacaggtgtgagccactactgcacctggccctagaacactttattatgtagtaaaaagtaaataactctcacccatctctttttatagaactgtgctgcccaatatggcagctacaagccaggtgtgatcaccgagggcccaaaatgtggtgagtccaaattgagtccaactgacacgtgcagtgagtgtaaaatcaacactgggccttgagacctaatatggaaaaaaaagtaaaatatctcactaataatttgtcaatattggcaaggcgtggtgtctcatgcctataatcccagcactttgggaggccgaggcgggcggattgcctgagctcaggagtttgagaccagcctgggcaacacggtgaaaccccatctctactacggtacaaaaaattagccaggcatggcggtgagtgcctgtagtttcagctactcaggaggctgaggcaggagaatcgcttgaacccaggaggcagaagttgcagtgagccaagatcgcgccactgcactccagtctgcgtgaggggaacgagactccatctcaaaagaaaaaaaagccgggcgcggtggctcacgcctgtaatcccagcactttgggaggccgaggtgggcagatcacctaaggtcaggagttcgagaccagcctgaccaacatggagaaaccctgtctctactaaaaatacaaaaattagcctggcgtgatggcacatgcctgtaatcccagctactcaggaggctgaggcaggagaattgcttgaacccaggaggcggaggttgcggtgagccaagatcaggccactgcactccagcctgggtaacaagagcgaaactccgcctcaaaaaaaaagtcatggcccctccatgaatcctcacacttgagacagtttatagacccaggacctcttgaatgaagaagaggctaggtccccttggcgaaggactttggtatgctactaaaaatttatactcccaatctttctcccaaccttcccctaaagagacctttaccagggtaactgcgctgggaaaggaaataatcagatatcccagggactactggacactggctctgaactgatactgacaccaggagacctcacctgtcacwgtggccctctagtcaaagcaggggcttatgaaggtcacgtgacccacgagttttcactcaggtccttctcacagtgtgtccagtgggtccytgagcccatcctgcggctattttcccagctccaggtgcataattggaasagacatatgagcagctgacagaatcccacattgatttcctgatggtgggaaaagtcgagcagaagccattagaactgcctctacctaggaaatcaaaagcagcactttattcctggatggattgcagagatgagtgccaccattaaggactggaaagatgcagggttgaagattctccccacatcccctttcaaccctcctatttgtcctgtgcagaaaacagatggatcttggagaatgacagtggattatgatacatttaaccaggtggtaactccattgtagctgctgtaccagcccgacctgatgacattattctgattggaactcgtgagcaagaagtattggtagcaataagtaatctaggtcgggcatggtggctcacacctataatcccagtactttgggaggcygaggcctgaggtcaggaatttgagaccagcctggccaacatggtgaaaccctgtctctactaaaaatacaaaaattagcagggcatggtggcttgtgcctgtagtcccagctacttgggaggctgaggcaggagaatctcttgaacccgggaggtggaggttgcagtgagccgagatcacgccattgcactccagcctggtgacagagcgagactctgtctcaaaaaaaaaaaaaaccaacaaacaaaaacaaaacaaaacaaattagccgggcrtggtggcrggctcctgtagtcccagctactcaggaggctgaggcaggagaattgcttgaacctgggaggcggaggttgaagtgagcygagattgcatcgctgcactcctgcttggatgacagagtgagactccttcyccaaaaaaaaaaaaaaaaaagtaatctagacttgttggtaagacatttgcatgtcaaggttagaaataaatatgagtaaaattcagagttctttatcagcgaaatttctgggagtccagtggtgtggggcctgtccagatgtctctttgaaggtgaaagataaattgttgcactacgcctctcctgcaagcaaaaaagaggcacaatgcccagtgtggaggcaacatatgccttatctgggtgtgttagttactccagcccatttaccgagtgacctaaaaagctactagttttgggtaaggttcagaacagggccttagtggagactgaacacctaaccgtggacaaccaaattaccatgtgacttgagcttctcatcatgaactgggtgcgatttgaccgccaagccataaagttgggtgtgcacagcagcaccccatcatcacctagaagtggtagatacatggccaggccagagcaggccctgaaggcagaagtaagtgacatgaagtggcccaaatgctgaaggtccccactcctgcaaccctgccttctctcttcaagcacccatggctcacagggagttccctgctatcaggtgaccgaggaagaggagactcaggcctggtttatggatggttctgcaggatatgtgggcatcctctgaaggtggccaactgcagcactacagctcccctctgggacacccctgagggacagtggggaagggtcatcctcccagcgggcagaaacttaagcagtgtacctagttgtgcacttttcttttttctttttttgagacggagtttcactctgttgcccaggctggagtgcagtggcacgatttcagctcactgcaacctctatctcccgggttcaagcgattctcctgcctcaacctcccaagtagctaggatatgggtatgagccaccatgcctggctaattttttgtatttttagtagaaatgaggtttcaccatgttggtcaggctggtcttgaagtctggacctcaggtgatccacccacctcagcctcccaaagtgctgggattacaggtgtgagccaccgcacacagccatcttttctttattcttgctttttttttttcttttgttctgtcaccccagctggagtgcagtggcacgatctcggctcactgcaacctcagactcccaggttcctgagcctcagcttcccaagtagctgggactataggtgtgtaccatcacacccggctaatttttgtattttttggtagagatggggtttcaccatgttgcctgggcaggtcttgaactcctgatctcagattatccgctagcctcagcctctcaaagtgttgggattataggcatgagccaccgctcccagccacgcgctgtgtatgttcttaaccagcggcccatatatggtgctgtttctctgaaagccaaggttcatgggtctggaatcaaaaggtgaaaatgggagtggcaccactcactattactctgagtggcctactggaaaaatgtgtgcttcttattcttgtgactttattctctgttggcctaaagatcttagttccagagggaggagtgtttccagcgggagacacaacaattcctttgagctggaagttaagatgccacccggccactttgggctcctcatgcctctgggtcaacagggaaagaagggagctatggtgtgggctggggtgactgatccagatcaccaaggggacattgggctgctgctccacaatggaggtagggaagagtgtggaatgcaggagacccgttaggccatgtcttttttttttttttttttttttgagacgagtgtggctctgtcgcccaggctggagtgcagtggtgcgatctcggctcactgcaagctccgcctcccgggttcacgccattctcctgcctcagcctcccgagtagctgggactacaggagcccgccaccacrcccggctaatattttgtagttttagtagggatagggtttcaccgtgttagccaggatggtctcgatctcctgacctcrtgatccgcccaccttggcctcccaaagtgttgagattacaggcgtgagccacagcgcccggcctccttaggccatctcttagtatcaccatggcctgtggaaaatgacaataacccaatctagatcggactatgaatggcccagacccttcaggaatgaaggtttgggtgtcactccacccagataaagaatcacractggctgggtgtggtggctcacacctgtaatcccagcaatttgggaggctgaggcgggagcatcacatgaggtcaggagtttgagaccagyctggccaacatggagagaccccacctctaccaaaaatacagaaactgcgtgcctgtggtcccagctacttgggagactgaggtgggaggatcgcttgagcccgggaggtcgaggctgcattgagccaaaatcgtaccactgcactccagcctgggtgacaaaaaraaaaaaaaaaaaaaaaaaacatgaccagctgaggtgcttgctgaaggcaaaggttgtacagaaccagtagtggaagaaggtggttttaaataccagctataaccatgtggtcagccacagaaacagagactgtgattgtcatcagtttttcctctttatttttctctgcatgtgtgtctgtgtgtgtgtgkrtatatatatatatatatatatatatctttgtttcytttcctctcttactctcttatcatgtaacataagatgtattgattttatatcatagtatttaagctatgggatatcaaggagaagcgtaaacatcactctcctcttcttacctcctcttccggggaagggatgagtgtgtttctggtgtatgcaggagagttgcatcgtgttaggtggaattatgactttgctttgtctttacttggagattaagtacggtttaggaaatgtctacagggtacctagttgacaaggggtggacttgtgrtggttagtcttttgggtcagtttcattggccaaaggtgcccagattacacattgtctctgggtatgtctgtgaggctgtgattggcatttgaatccacagacacaatacagtgccctccccagtggcagtgggcatcgtcyaatctgttatgggcttgaataaaacaaaaggcaggttgggcacagtggctcacgcctgtaaccccagcactttgggaagctgaggcaggtggatcacttgaggtcagaagttcaagaccagcctrgccaacatggtgaaaccccgcctctactaaaaatacaaaaatttggctgggtgcagtggctcacgtctgtaatcccagcactttgggaggctgaggcgggcagagagcctaagctcaggagttcgagaccatcctgggcaacatggtaaaaccgtgtctctactaaaatacaaaaaattaaccagatgtgacggygcacgcttgtagtgccagctactcaggaggctgaggcacaagaattgcttgagccggggaggcagagctttcagtgagcagagatcgcgccactgtactccagcttgggctgcagagtgaaactccgtctcaaaaaagataaattaaaaaataaataaatacaatacataaataaaatacaaaaattagccaggcgtggtgaaatgcgcctgtaatcccagctactcaggaggctgaggcaggagaatcgcttgaacctgggaggtrgaggttgcagtgagctgagattgcaccagggcactccagcctgggagatagagtgagattctgtctcaaaataagaataataataataatawggcagaggaaggaggaatttgcacctttttccttgcctgcctgcttgagctgagacatctcctctcatcttctgctcttgcactgaaatttataccattggcttcctggttctcaggcctctggactctgaactgccccaccagctctcctgggtctccagcgggcggacagcagttaatggtacttctcagctgccgtaatcacatgagccaattatatggcatagtaaatctatctatctatctatctatctatctatctatctatctatctatcthtttatctctctatctctctatctatctgcatttccttgacacagggtcttactctgtcatccaggaagctggagtgcagcagtgcaatcactgctcactgcagcctcaaccttctgggctcaagtgatcctcccatctcagcttcctgagtagctgggaacacaggtgtgagccaccacgcctggctaatttttaaaaatttgattttagaaatgaggtctcattatgttgcccaggctggtcttgaactcccagcctttagcaatcctcctccctcaacctcccaaagtgctgggattacaggtgtgagctgccatgcctggctcctacttttatataaaaggatatatttatggtcatgtgcctcatgatgacattttggttaacaactgactgcatacgtgatggtgatcccatagattataatggacctgaagaattcctatcacctagtgatgtcttagccattgtaccactctaaggtttattaaagaaaaaaaaaaagacttggcatatggctcacacttatagtcccagcactttgggaggctaaggcaagaggatcacttgagcccaggaattgaggctgcagtgtgccacgatcccagcactgcactccagcctgcatgacagtgttgtctcaaaaaaaaaaaaagataactgtaaaacagcctcagataggtccttcaggaaggattccagaagaaacattgtcatcataggagatgacagctccatgcctgttattgcccctgaagaccttccagtgggacaagatgtggaggtggaagacagtgatattgatgattctgcccctgcgtaggcctaggctaacgtgtgtgtttgtgtcttcatttttaagaaaaaagtataaaaattaaaaaacaggccaggcccggtgactcacgcctgtaatcccagcactttgggaggccgaggcaggcggatcacgaggtcagragttcgagaccagcctggccaacatggtgaaacctgtctctaaaaaaaatacaaaaattagctgggcatggtggcgcatacctgcagtcccagatacttgggaggctgaggcaggagaatcacttgaacccatgaggcagagcttgcagagagccgcgatcacgccattgcactccagcctggtgagagagtgagactctgtctccaaaaaaaaaaataaaaaaaaaattgcgtccaggcctggtggctcacgcctgtaatcccaacactttgggagatcgaggcaggcagatcacttgaggccaggagttcgagaccagcctggccaacatgacgaaaccccatctctactaaaaatacaaaaattagctgggtgtggtgcgggcgcctgtaatcccagctacttgggaggctgaggcatgagaattgcttgaacttgggaggcggaggctgcagtgagctgagatttcactactgcactccagcctgggtgacagagccagattttgtctcagaaaagaaaaaaaaaattgcttgttgcttggctgggaggaagcacaaaaggatgctagctgctgtttactgctcatgttattattcataataacatgttggtatttgctatatcatgagaggccctaccaagctgattgtgtcttcagctatctctgatgttatgtttgtgtgggttttgattaggacgtgtcttccttactcgccctttgtcgagtcgtcctgagcttggaatctgggccggcttcctgcagtcacacagggccctgcacgaagaaggaacccctaggcttgctttaattttttctgtccctgtcttgaaattctcttttttttttttttttttttgagacggagtctcgctctgtygcccaggctggagtgcagtggcaygatctcggctcactgcaagctccgcctcccaggttcacgccattctcctgcctcagcctcccgagtagctggaactacgggtccccgctatcacgcccggctaattttttgtattttttttttttagtagagacggggtttcaccgtgttagccaggatggtctcgacctcctgacctcgtgatccgcccgcctctgcctcccaaagtgctgggattacaggcgtgagccttaacaatttttgaacaaggggctttgcattttcattttgtactggactttacaaatgatgtggccagacctgcttggagtcacaattcttcctgtgctaatagcagtgaggggggtcccagcaaaggatggaggctcccggcagtctgagctgagtcagcagcacatgggataaggcccctctaagagggacctttacaaactgcaacgaagcagtggttacaggggctggaaaacctgacatccaaggatgagctcacggggcagtggttgtttcgcctggaagacaagattttgggtgaactgggtggtgtcctccaatttctgaagggcagtggagaggaaaagggagagagggagtgtgtgtgtgtgtacgtgtgtgtgttctctgtggccctaaaaggcagatccagctcactataaggaaagaatcttgaagaattttgaacaaggaaagttgtgcaagaagggaacagctggcctgaactcaaacctcagctctctcagctctgcctgggggtcaagagcatgggctctggctggagccaactacatctctgtccagatctgttattcttaggtahggtcattcactggcttgatcctttatctccctctgtaacatgggcctgataatgctccacagtacagggtgatgatgctggtataaaatataaagcacctaaagggtgtctggccattaggaggtgcctaacaaatgacaccattgtttgctgttttttttgtkttttttttgacagagtttcactcttgttacccaggctggagtgctatgacgaaatctcggctcactgcaacctccgcctcccaggttcaagcgattcttccgcctcagactcccaagtggctgggattataggcacacgccaccatgcccagctaatttttgtatttttagtagagatggggtttcgccatgttagccaggctggtcttgaactcctgacctcaggcgatccgcctgcctcggcctcccaaagtgctggggttacaggcgtgagccaccacgcccagccgtttgctgttattactgttactataatgagttcctcgtgcctgggaaggttgcagttgagatggaactcaggaagttgcagagatgacccttgtatcagaagtaaaataagatgcacacatttcctccttgacaattgcagcatctggcatatttggatgattagcaaaaaccagtccgtcaggcgtgatgactcacgcctgtaatcccagcactttgggaggccaaggcgggcggatcacttgaggtcaggagttcaagaccagcctggccaacatggtgaaaccccgtctctactaaaaatacaaaaaaacaactagccaggcatggtggtgcacacctgtaatcccagctactcaggaggctgaggcaggagaattacttgaacctgagccaagatcatgacactgcactccagcctgcagcctgggcaacagagcaagactcaaaaaacaacaacaaaaaaaaaaacaaaaaaaaaaaaacacaaacaagtcataaagtgctgtccgagtgacaaaggccctcagggaaaggggtggtgcttcttgtggaatggaggttgttttggggcttggaggctactgagaaagtgggagtggtttgaaaactccagccaacttcccggtagctaatcactggctgaatccaatctgaggaatgtggagctccccatagggctcctaggaaatgggtccctgatgtgtctgagagctgcacacaggaattgcccatctcctctgcagcccgtgggaagcagcatttgtgggccgtgtgcgtgtgagcatgagactgtatgtgcctagttaatgcatgggcagccaggcatgggagggtctcggctccctctgactccagagcctctgctttgagccacactcagggtgacagcagcttccctggaaatggcagtggtttgtgctgagacaaacatttctcctcttccttctcccccatccgcctctcctgtgagtggggtccagtcccggagcttcagccaggaaatgctccttgtgtgtccacagccctgctcatcagcagtgggatgagaggcccagagtccaaggagcagcagatgggttccatcaggggctgctggactgtggtcagaactcaggcagtcacaagtgtgtttgtctctccagagacagaaggagagggcggcatcacagtcagctccaggaattcccctgcatttaacgcacacgttcaggccgtctgtctttccacaaatatttaccaagcacagctctgggcgcacaccaygctaggcactgtaaattcagccataaacaagacagaagctcagtttcagttttctcttaccataaaactaaccatcttcaagtgtgcaattccatgtcattggtacagtcacaatattttgcaaccatctttaccatccatttccagaacattttcatcatcccagaagaaaactttatacgcatgaagcagtcattcccatttccccaccccgcctacccgctggcaaccacaaatctgctttctctctctatagatttgcccattctggacattttatatgcgtggaatcatcataaaacatgtgactgcgcacctgttgtcccagttactccagaggctgaggcagaagaaccgcttgaacccaggaggtggaggttgcagtgagccgagatggcaccactgcactctagcctgggcaactctccgtctcaaaaaaaaaaaaaaaaccaaaaaaaaaaaaagtgaccttttatgtctggcttctctcccttcacatcatgttttccaggttcatccacgtcacagcatgggtcaggatttcatttctttttatggctgagtaatattccattgcgtggataccctgtctttgctttcttttctttttttttttttttgagatggcgtttcattcttgtcactcaggctggagtacaatggtgtgatctcggctcactgtaacctccacctcctgggttcaagtgattctcctgcctcagcctcccragtagctggaattacaggcacccaccaccatgcccggctaatttttttgtatttttagtagagatggggtttcaccatgttggccaggctggtttcgaactcctgacctcgtgatctgcccgcctcaacctcccaaagtgctgggatttcaggcatgagccactgcttccggcctgtttatttttatttatttatttattttgagacagggtctcgctcttttacccgggcagtggcgggatcacagcatggctcactgcagccttgaacacctggggtcaagtgtagctgggactacaggtgcgcaccatcatggccggctaatttttttttttttttttttttggtagagacagggtctcactgtgttacccaggctggtctcacacttctgcagtcaagggaccctcccgccctggcctcccaaagtgttggaatgacaggtgtgagccaccatgcccgccctccaggcttttctgaccactggaactttcttatcactggagcagtcccgcttttccacatttgtaagaggggaagagctcactttcagtttcctgactcagggaagcatgaagttagggaatggagggaccctgaaattgcacgtggaaggctgagtagtaaagtcagctgtctcttgagagcttaccaggtatcaggtgctatgggcacgagccgacagccccacagctagaacagggctgcctgtgtgacgagaacgtcctccactaccaaaggccagctgtggggtcaggataaggacaaccactaacccaggactcgggctccatatctctaaaacgggcctcctagacatacctccctgaaatctgatgacctctgtgattagcccagtgtygagtgagaggacaatgcccagtgaccccgcggccatcacccatctgactgctgtccttaagcagggtggcatcatccctgaaagccctcttggctatctcaggaatgagctccaggggctgggcttggcctgggagccaggcaggcagctcacaatgagtggttccctaacagggagcttctagtcctaaccactcacacttgtcaataaatgtcagcttctatgttcttcactcctggataggtgtttgtggtatcaacatgcaaactaaatttaaaatgcacagtcttttccagtccaaatggaatggttcaaaggagggtgtgttggggtaatgcctcagtggccttgttctggtcccagcctgcccagcacctagtccctctcggagaccagcctgctcagcacccagtccctctcagagacgcacaagcctctctcctggctctctcctcatcagaagacaggcagccaggctcccgtggggtgttccgggaaggcaggagtcaggacccagggccaagcttcaggatgcagagccaagctcctggaagagaagtggaggttttcacttatgtcagtgtagactcttttttataagggagagaaatccaaaacaaattagcttagttcaatttaacaaattggggttgtggctatatatcaggcacgatactggtgcctgtagttcactggtgaaccaagagccctgccccaggaggacagatgttaggcagtagggataataagttagatggtgtgaggctgggcatggtggctcatgcctgtaatctcagcactttgtgaggccaaggcaggcagatcacctgaggtcaggagtttaagacaagcctggccaacatggcaaaaccccgtctctactaaaaaatacaaaaagtagctgggcatggccaggcacagtggctcacacctgtaatcccagcattttgggaggccraggtgggaggatcacctgaggtcaggaattcaagaccagcctggccaatatggtgaaactttgtttctactaaaaatacaaaaattagctgggcgtggtggcacatgcctgtaatcccagctacttgggaggctgaagcaggagaatcgcttaaacccggaaggcgaagattgcagtgagccgagatcgggccactgcactccagcctgggtgacagatcaagactctgtcaaagaaagaaagaaagagagagaggaaggaaggaagggagggaaggaaggaaaagaaagaaggaaagaaagaaagaagaaagagggaaggaaggaaggaaagaaagaaaaagaaagagggaaagaaagaaagaaagaaagaaagaaagaaagaaagaaagaaagaaagaaagaaagaaagagaaagaaaataaataaattagggcatggtggcgggcgcctgtaatcccagctactctggaggctgaggcaggagaatctcttgaccccagaggcggaagttgcagtgagccaagatgatcgcgcccctgtactccagcctgagtgatagagcgagactccgtctcacaaaaaaaaaaaagttagatggtgtgttattgggtgatatgcgctatggaaagaaaagtggaggcagggaagtggcctcaggagtgggaagggcagggcagactgcagaatagataaggttgccagggtgagtcttatggagaaggtgagagtcaaaccacgatttgaaggagatgagatgtcagccttgtggaaaccttggggagaattctaggcagagagatcagttatagcaagggcccagaggcacgactgtgtctgacagattccagcacggagggcagtgtggctgggcttagtgagtgaggggggcggaagaaaagaggagttccgagagaaatggggagcagacaggacaggaccatgaggtgttgtccagacgttggctattatttatttatttatttatttatttatttatttatttatttaagacagcggagtctcaactttgttgccaggctggagtgcagtggtacgatctcagctcactgcaacctccgcctcccgggttcaagagattctcctgcctcagcctccggagtagctgggattacaggccggtgccaccacacccagctaattttttgtatttttagtagagagggagtttcaccatgttagctaggatggtctcaatctcttgacctcatgatcctcctrcctcagcctcccaaagtgctgggattacaggagtgagccacggcgcccggcccagacggctttactctgagtgagattgggagccactgcggtctttgctgaaaaggaaggaagtgatttgacttttttttttttttaagcaaaaatgaaaaatcctaatttctaggctcggctgagtcagaggcaggtggaacacctgaggtcaggagttcaacaccagcctggccaacatggtgaaaccctgtctctactaaagatacaaaaaytagctgggcgtggtggcacaygcctgtaatcccagctactctggaggctgaggcaggagactcgcttgaacccgggaggcggaggttgcagtgagccgagatcacgccactgcactccaacctgggcaacaagagcgaaactctgtcttaaaaacaaacaaacaaacaaaaatcactgtgcatttatttccccaycactggctacagaaagcctagcaatactcccaaaggtcaggaaccagcagcagaggtggggccacttcctcctctctaagcctcctctgatgttagggacaatcagccagcgtgaagagcttggtttctgctcctcaggaaatgccagggagggcgctggtctaagccacgggatggttttcaacagggcagagcctctgctcagggtttcgaacggggataggaagaactttcactttcatgggtcgaaaaaatatagtaaagtaaaaaggtttgaagatacatctcagtaacttttttctctttttgagacagagtcttgctctgtcgcccgggctggagtacagtggtgcagtcctggctcactgcaacctccgcctcccaggttcaagtgattttcctgcatcagcctcctgagtagctggaattacaggcacacrccaccacgcccagctgatttttgtatttttagtagagacggggtttcactgtgttggccaggctgttcttgaactcctgacctcaagtgatccccctgcctcggccttgcaaagtgctgggattacaggcatgagccacaaggcccagcccatctcagtgacttttgacatatgcattcacctgggtaatcaccacccaggacaagatgtaaaatatttccaggggcttctgttgtcctcattgttgtgggcacactgctgtagttcccgtgggcctcaggaccaggccacagtgagtgtcccccagcccccaacactgtgcacacaccatctcctgtcccccaccctctgcaaggcaggggacaccaagcccatcttacaggcaaagaaatggaagctcagagagaagtgacaccaccatcaccgtcacccccaacagccacaatggcagcttccattggccaagggcagcttcagggaaattcttggccaaagatcagagattttgtcctccttggcaggccttggcttagcaggttcatttcagtagacagtgacgaaaagattcctatcttgagatcatgtccatcagttatacgaattcccctacacagtctctcccctattttcggctcagggtagcgggaggtgatcgtctgctcyttgccccaagctggttttcccagcctctgctttctatcttgttatttcagaagaccagtcagggaagagccactctccctagtccaaggaggacaaccaaagggcccctcctgggctgtgtctggtccacgattctgggggtggtacagccaccagaccccaacctcatagctgagctttttgacaaggaaggtagctacctgcaggggttcccacgggctgggggcgagagaggcagggattctctcttctccgacagaaatatcagccagaagcgagcttgcacagctcctccaacagacaaccagagataaaacgtgtctcagggcatcttgtactttccatgttccgtccctgatggtatggtgacctatcatttatcttgtggggccgggacagcctggcctggcagttccccacgggagtcagtttatcaagcacatcttttgttcggataaaggactgcttggcacacagcaaatgggcaaggcaccacccccaccttgctcacacccacctcccccagcaacaagggcagggatttctatgagtctccctcctgacaaccctactaggtagggatcattattccctttgagcaggaggaaacggaagctcagaggmtgatactgaacggagtgcctacttgttccaggggcttcataattatttagctcccacaactgcgctggggagtgacttagggtcagctgcattttacagctgaggaaactggttcagaggaggaacctgcctgcctaaggccacacagctacagctgagggctggctttgggattcgaggctggctaaatctagctctggccaatcttccctttgatctctgctgctttggggcataggttggactgacacagctgtctctctgggcaggtgctgtcccaaagcacctggtcaagcccaagagtgaagtaggcatgggagactggtttctccctttcccctttgccccacttccccagggcacctctcagcaaagccaaayatgttggcgaaaataaatgagcaagaaccgtgtacaagatccctgcccttggccaggtgcggtggctcatgcctgtaatcccagcactttgggaggccgaggtgggtggatcacaaggtcaagagattgagaccatcctggccaacatggtgaaaccccgtctctactaaaaatacaaaaattatctgggcgtggtggtgggcacctgtagtcctagctacttgggaggcggaggcaggagaattgcttgaacctggaggtggaggttgcagtgagcagagatcacgccattgcactccagcctgggtgatagagcaggagtctgtctcacaagaaaaaaaaaaaaagatccctgaccttgtggaggtcctgccagaacccggggaagcgggcaggatgcagcaaggtgaggattttttttgagacagagtctcggtctgtcgcccaggctggagtacagtggtgcaatcttggctcactgcacctccacctcccaggttgaagcgattctcccgcctcagcctcccaagtagctgggattacaggtgtctgccatcacatctggctaatttttgtatttttagtagagaggggatttcaccacgttggccaggctggtctcgaacttctgacctcagataatctgcccccctcggcctcccaaagtgctgggattacatgtgtgagccacctggccaaggtgaggattttgaggtgagggattcaaagaatcttagaaaacaaacgttgatgctttctttcttttttgagacagggtcttgctctgtcacccaggctagagtgcagtggtgagaacatggctcactgcagcctcagcctcctgggttcaggtgatcctcccacttcagcctcctgagtagctgggaatacaggcgagcaccaccatgcccagctaattaaaacatttttttgtagagacggagtctccctatgttgcccaggctggtcttgaacttctgacttcaggtaatctgtcccccttggcctcccaaggggctggaattacaggtgtgagccaccgcgcccggcctggtgatgctttctactgaagagtcagttgataggtctttcggggagatcttgtgatgaagaatcaaagcatttgactggggaaagagttccaggatagtcaagtgatgctcaggaagtcagtggagccacgtgctggttccccatccctgctatagcaaattaccacagacttagtggcttaaaacaacacagcttcattctctgacagttctggtggatgaagcctgaaatgggtctcacagggctaaaatcaaagtgtcgggagggctgcgttctgtctgaacgcagagagtttgtttcgtccccttttccagtttctagaggcccctggtattccttgggccatgatctctccttcatcttcaaggccagcaggttagcgtctctcctgtctgacccctattctgtcctttcatctcctctcttaatgctgcctctgtttttatatcttttctctaattttactgcctccctcttggaagggcccctctgtatactctgggctcacccagataaactaggataatttctcccatctcaaatccttacgaaatcccatgtgaaaagtcccttttgccacatagtcacagtcacgggttctagggattgggacatggatgtctttaggggtggagggcgtccttcagcctgccacagatggcaaagtcatgccattgtggctgcagctccattgtccaggctgagtgtgggggcgcayggcgtggttctcatgcccaccacctaccctgaccctgcggaggtgggcaggaggcagcgataatcaccacgtgcagaggtcctgccaggtgcccagcctcatcattccctagaaggcaggcaccaccacatgctcccacactrtagataaggaaacagctttgaaacagatttgaaagtgtttgaggatttgcctggaaggagggctccagagccagggactgggtccgggacacccggagactctctgcttcttggagctccggcaactgcttgtctttctcttcacaggagaagggggccctgctgccgctgccgtggggcggggcgtgggcggtgctggctgcaggaaggctctcccctcccactttgtgctttccctgcaggctgctcctctgtcgagctgatcrcacccacagttgagctgcgctggccagagatgcctgcccacagcctggwgatgagcagcccggccctcccggcyttcctgctctgcagcacgctgctggtcatcaagatgtacgtggtggccatcatcacgggccaagtgaggctgcggaagaaggtatgtgcctccctgggggtccccggcctgggtcatacttgcttctctccacgtcctgtcaggaaagccccgggatagggaaacrtggccaaggtgtgtgcagggctgggaggtgagcacctcttccagccccgccggggggcttcctgccagtcccacgtgtcagcaaggcctgcaccttctcctctctggcttaagagcacttactcgcttgccgtgccaccgggctgagttcttggcatggagagagccagcgagtgtctgtgagagaagcaggttctggagggtggagtgtgggagcgtgacagcacaaagcctctgtctaacctggtggcttcccggcacgggaggtctgatatctgggtggagtgggaaccggcaaaacaggagtccgagaaacgtttaagtggaaattcccaactcctggcaaatgtcactaacaagcccactgtagcctccaaaggccagctcccagccgggcaccgtcggggtgctcagcgaggaatttccccactaatccgagcccctgaaccaaaacaacattaacgagtcccagagctgggccggggcaagttccagtagcgtccgtcacactggttggcgagtctgcaaagtcataggctgagcttgtcggctgtcctggcggcagaatgcagaaagaccccaggcacctgttacttcctccccaggtattttaataaagcaatcatttcctgaaactgtctctgtcttcccctgtgtccagttcaaaggcgaggtgaggcaaggctggctctggcactgcatgcgggtggatcctggggagtgaggatcttggccacaagccaggctcaggccctgctgcaggtacaggcaggattaaaggcagggcagctgcccaagtgataggatgcccggaggctacagcacactgatagcttctgacttctccctgccttggctggtcctgggatatgggatccgggcatcaagtagaacagctgcattcactcattgaatccttcccagaggaccgaatgtggcccrgagctgagcatgagatccccgccacagccctgagggcaggggaggcgccatagtcatcctgttttctaggtgaggaacctgggctcagagaggagacatcacttatgaaggtcacacagcccggtttgaactccagtgtccagcttcagagcccacatcctgtcttggaggcgggggtttctgttttgttttttttttctgctgtccaggctggagtgcagyggcatgatctctgcttactgcaacctcyacctcctgggttcaagcaattctactgcctcagcctccccggtagctggcattacagacrcacaccaccatgccctgctaatttttgtatktttagtagagatggggtttcaccatgttggccaggctggtcttgaacycctgacctcaggtgatccacccgcctcagcctcccaaagtgttggaattacaggcgtgagccaccgcacctggctgaggcctgggttcttaccagcaggccagcgattccttttttttttttttttttaattattatttatttattttagagacagggtcttgctctgtggcccaggctggagtgcarttgtgcgatcatagctcactgtagcctcgacttcctgggctcaggtgatcctcccacttcagcctcccaagtagctgggactataggtgtgcgtcactgctcctaattttttatgtttttggtagagatggcttttgccatgttgcccaggctggtctcaaactcctgggctcaagtgatcctcccatcttggcctcctggagttctgggattacaggtgtgagccactgtgcccagctgtgatttccttttaacacgaattcggggaagggaggaggtgaacctgtcccagagcctttctgcctgattggcagggacaccgcagaaggaaacccccactccttgggctgctcctgaggtgttcctcatgacaacgtggccccctcttatctctgctctgggcgctaagtatcatccaggaaggacttgctggaggtgacagtcacaggccctggctcctccacccaccagcctggggacctggaaaagtctgggagctcagtgtcctcacctgtaaacgggggtcgtgacagcagcgccaggagaatgcaacgccccaccaatgtttgtccttaagacttataagtaactgaaattaacatgagcatcgcagcctcaggtcactttcaagggacctcaaccaaaggctggcctccaccccagctaaggtggcacctcggccgctgacactgggggcttcctggcctgcactgcagctggctctggcctggctgacttgtatctgagttgtatctccagggggagcaactccatgggcagtggactcctaaaggcagtgcccactgtatgctgaggccccttgaaacgtatcacagatccacggacagagccttcggtgttggtgattcactgatttcagggccagcagagaggaattttgggtgtgaaggttccaatctcgaagatctgagctgcattctcctctggggtagggcagggcaggcccaccagggaggacaaaccagcccttgggggacagtcatgagtcagaagcacaggatttgccgtcagctgaacaatttagaaaacctgctcctgagattcaggctctgctgtgggcctggtggggtctgactgtctggaygccagcagggaacagtggagcaagagtcatgggcctctgatgatctcagtgtgactttatgtctctgctttccaatgagagaaagtgacaattcactgagcacctccttgtgctgggcattgtcctagcggcttctccaggtctccctctcactcgtcacacagcacatgagctgtgatttctcctgagttttcagagttcaggatcctgtggttaatcagcrcggagctgggttttcagcctggggctctcaagaccttctcatggcttttagtgcaaagtccaaattcttcaggtgctgccaggacccctgatgacccctgtccctttatcttgggcccctgtcccttgccctctgtgctcccgtgtgctggttttctgttcttcacacatgcccagcttcttccagcctcagggcctttgcacgtgctgtcccttctgccttgaatgttgttgctccagccctcccttcatctggttaatgtcaatgcatctttcaagcctcagattgtttgttttattttttttggagacagagtctggctctgttgcccaggctggagtgcagtggcaagatcacggctcaytgtagcctcgacctcccaggctcaagcaatcctcctgcctcagccctcctgccaagtagctgggaccacaggtgtgtatcaccacacacagctaatttttgtattttttatagagggggtttcatcatgttgcccaggctggtcttgaactcctgagctcaagtgatccaactgcctcggcctcccaaagtgctgagattacagacatcagccactgtacccagcttgtttgtttgttttagagatggggtcttgctatgttgcccgggttggtctcaaactcctggaagctcaagcaatcctcctatcttggcttcccaaagtgcttggctcacaggcgtgagccaccacacctggcttgttttagagatggggtcttgctatgttgcccaggctggttttgaactcctgggctcaagcaatccccytgccttggccttccgaagtgctgggattactggtgtgagccacctcatccagccctaagcctcagctttcatgtcactgcctcagagaaactttctcagagcctcagactgggtcaggtcccacgtaaacattctcaaggccagccgtgccttcttcttaacaggtgagacaccctggccttccctggttcataggcaactcccccatcggactgtgagcttcataaaagcagagacagggggrccttttcatggtgagctaccagcccctggcacagggtaggaatcgtggatgatggttggatgggtgtgtgtgcaactgcacctctgtcctgccactgtgaactctggtcatggacaaaacatagccccaggtgactgggccgtttgtctcacgaggagtgactctcaactggtatatttcaggcctttgccaaccccgaggatgccctgagacacggaggcccccagtattgcaggagygaccccgacgtggaacgctgcctcaggcaagtacttcgggcccctggyctggccacacctggccatggcctgccctttcagaacttcttctgcacacaggggacttggaggactcccaggggctgaggttttctgtgttcctgatcttctctgactgttttactttattcaatgatttaatttcaaatgaactttggaaaagtaagacgtggtcatgactcataattacaaagtgagaaaggtggtgacttcagtgaacattcagtctccctcctacctctgacctccaggcactacgcagttctactggccaggggcaaacactcctgccaatggccatgcatcttcccacagagatttgctgcatttacaaacatgtgtgccacgcttttcccgttctgccccatagaatcaccctttatcctctggtctgtactatgcttttttttttttttttttttttttaatatggcaacagagtttgttccatatcggctcacagaggagttgcattcactgtattggtgctccagtatttatgttgccactctgttgaatgtacagcccataacttccctaaccaattcccctgcratgggcatttgggctccttctgtgttatgaacagaaggcctcaatacctctttttttttttttttttttttttttttgagacagagtctcactytgttgcccaggctrgagtgcagtggtgccaccttggctcactgcaacctccgccacccgagttcaagcgattctcctgcctcagcctcccaagtagctggggctacaggcgtgcaccatcatgcctggctaatttttgtatttttagtagagatggggtttcactatgttggccaggctggtctggaactcctgacctcagatgatctgtccgcctcggcctcccaaactgctaggattacaggcatgagccaccgcacccggcctcaacacttttttcatttgcctttatgggtatgtgtgagtaaaaccgcaggatgcaacaaaatcatgtcccactactggtgtgggagccatttttccatccctctgacaatgcaactgacaactcattgtattggcatatttgggtggattcctaccaaggtgataggtgaaaatttatatcacatttttgttttgctttgcacttctttattcttagtgaagttgaacatcttttcatatgcttaacatccccctggtcaattaaaatgaatttcctcattataaaaatcagaactcattacagacgatttgggtaatacygaaaaaacacagagacagaaaggaaaaccactcacagttctaatcacagttcacacttgcatctctctcctctttgtcttctatagctaaatattttccataaaattaggcatgcattaggtacacccaatttggagttctgattttcttttattaacattattttgcgaacacttyccatgttggtaaatgttactaaaaaaattattcttgaccagatgtggtggctcatgcctataatcccaacattttcgagggccggcagatcacttgaggtcaggcctggccaacatggcgagaccctgtctccactaaagatacaaaaattagccgggcatggtggcacgggcccgtagtcccagctactcgggaggctgaggcgggagaatggcatgaacccaggaggcggaggttgcagtaagccaagattgcgccactgcgctccagcttgggggatagagtgagactccatctcaaaaaaaacaaaagatccttaaaaaactggcttcgtaaaatcccatcagagactaaatgctaatttcacataatcacagtcaatattaaatttttttggcagtttctgctctgccatcttttaccagttagctggagagtgaggcgatggcactccaggggttggggtcatcggaagagcttgaaggggaagtggggaggayggagagctggacaggctgaggccggagacaaactgtctcatgggtctcaacacattcccctgcatcacaggcggaaatgggtgggacactgtcatttaaataatacaaatttctttcacttgaaagaaagtctgtgggtttttttcttatgtttttcttggccattgacaataatatgtccacttgtggttttaaaaaaattacagacctgtgtcatgtaggaagtgaaattccttgctattttaccctttcaaatccttcatatgaggcccgtctctccattaatgagcccttactacatcccagacactgtgctaagcactggctgtactttcaagaacaaaagccttctccatacatgacttccattggtgactcttgtccccagctgtggcggccctcctggacagtggagaaggatgggatgagctgtccaggcagcaggaggccaggacggtgggttgcccggggccagctcacagcagccaccaagaggatgcgttttggctcctcccaggctgcagaggttttatgtagcaaagctttcatgtggcacaatgtggcacaggagtggccaagtggccttacagatacttggtttatttttactggctgaaaccatgccccatggagagacgatagacccgggtggcgccgagacatttccacccaaccaatctttttttttttttttgagacagagtttcgctcttgtcccccaggctgaaatgcaatggcacgatctcggctctctgcaacctctgcctcccgggttcgagcaattcccctgcctcagcctcccgagtagctgggattacaggcacctgtgaccacgccagctaatttttgtattttttttttagtagagacagagtttcaccatgttggccaggctggtctcraactcctgacctcaggtgatccacctgcctcggscttccaaagtgctgggattacaggcgtgagccattgcgcccagcccaaaataacccctcatctacagtactggggtttaaatggtagaaattcatttcagcactttctgagtgcgtcttatctaataatactttatagccatttggtgaggacttactggargccgactgtatactgggcccaagtcagacctggggagtgcctgggtcccctgggcccctcctctgccacctgatttcacagaayctcatggaaacttgagtgtgcagaactaagagaattctatatcctgccgtctgctaccggagaactggctggaacccgaagggggagaccacctggaagcaaaagttggttaaatattagaccagggtttatggtatgattcgagtcacccttctgtcaaataggaaagcacttcagtcttggttcttggagcatgaatctgccttgcaggttagcacatgctgcagtccaaatgtgagcctagttctgggagaagccagggactagccaccttttcaggatacctatccggagttcccggcaatgtgcgtctgggccagaatctgaggttgggtgtgtggaactgcacggaggggttacctgtgtggtcccaaagaagagaggcaaacgtgcgacctaagcttggagcatttctgtttggagtgtatagacttaaactgagtgaactgatttgtcaggaaattgggtcccaaaatgtcagccctagaagtcccttagatgtcatccagcatgtacattttgtacatagtgaacgcagtcccagagagtgagagagatttgcctgaggccatggagctaataagcaccacagcagaactggaggtttccagcctaatactcccttccggctgcaccacgaagtactcaaaaaaaawtttttttttttttkagatggactttcactcttgttgcccaggctggagtgcaatagcgtggtttcggcttgctgcaacctccgcctcccgggttcaagtgattcttctgcttcagcctcctgagtagctgggattacaggtgcgcgccaccactcctggctaatgtttgtatttttagtagatgcaggatttcaccatgttggctaggctggtcttgaactcctgacctcaagtgatccgcctgcctcggcctccccaaagtgttgggattacaggcrtgagccacctcgcccggtcttttttttttttttttttttttgtgacagggtcttgctctgtcgcccaggctggagtgcagtggaatcccggctcactgatgccttgacctcctgggctcaaacgatcttctcacctcagcctcctgagtagctgggaccacagacacgtgccaccatgcctggctaatttttaaatttttattgttgtagagacgggatcttgctatgttgctcaggctgattccagcacccaagtgatcctcccacttcagcctgagatcacaggtgtgtgccaccacacccagccccataacgtgcttttgattcatttggccggagcatctgagggcagtcagaaagtctggcaaagccaagagggtgaagtgagctttagcgatggtgtccaggacagggctggtgatggcgatggaggagatggcggcttgcttaaaatctccctactcagtcaagcacagtggctcacatctgtaatccctgcactttgggaggctgaggcgggtagatcacctgagcttaggagtttgagacgagcctggccaacatggcaaaaccctgtctctactaaaaatacaaaaattaaccaggcgtggtggggctcgcctgtagtctcagctactcaggaggctgaagcacgaaaatcacttgaacccaggaggtggaggttgcagtgagccgagatcacgccactgcactccagcctggggcacagagcgagactctgtctcaaaaaaaagatcttcctactcagtgtccaggagtgttgtaagcactttccaggaattcactcacttggcactctgaggaggggcctggcactctcggctctgctcctgaggctgtccctctatgggaaggcgatttcactgtcttgtatacctgcctttgaaacgaagcaggcactgcattgcgtcaaccctgatacaaagtcaaggaaattggccccaccgtggatgccagcagggctgggggagagaagaggagaccctgtggagcggccagcagctgtccctgtcctggccatctggggatcactgtcctcaccgctgtcacctatgcaggaaaatgcagctggtgtggaaaagtctgtggagggtgarggcaggcctgatgctgcaggaggcaatacaagtccagtctagtaggaatttgctttgggtggcttttaccttaaaaaaatggttattatttgaatgatgcatttcacccgagcaygtctgtggtacgtgcctgcctccatgtctctcggtttggagcctggaggtgggaggagggaggtgagctttcttccatcattccttggtgtctccattgctccctgtccctggccactgcggcctcggaggggcccctctgcggtttgagacagaccagacgagtgagggagggctgggccagccccaggggctgacagtcagagctcctgaccacctctcctcccacgctggtgaccgctgaattgctgcccaatggctggaaatagaaggtggggctcagtccccgctttttctgcaaggcctgctcctccccagcctgcagacatgccaggcagagcaggatccacgtctgccatgaacttcccgtcttgttcctccttcccaccctgtgttccccaacttctttccttcacccactcttcagggtttggctatgtttgtgaactatctgtactatgattctcttaacagctttccaaacattgacttactctttttttttttttgagacggagtctcactctgttgcccaggctggagtgcagtggcgcgatgttggctcactgcaacctctgtctcccgggttcaagagattcccctgcctcagcctcccgagtagctgggmctacaggcgcctgccaccacgcctgactgatttttgtatttttagtagagatggggtttcaccatatcagccaggatggtctcgatctcctgacctcgtgatccgcccgcctcagcctcccaaaggacttactcttaaaatatcaacacatactttaaggaatagctgagtgaacgagttgcatatgctggttgtgcttttcctgaaactttcaaataaacattacaaaactcctcatccaggtggcactcccttgtgaatcacttgtgacaggcagacctcattttgggacataatcaaaaatgggttttccaagggtgtccctctaatcagcctgtagggggatgtgggtacccacagctcaattgccagaggacggagtgatttttgttttgttttatgttttttttttttttttttttttgagacagagtctcactcactctgtcgcccaggctggagtgaagtgacacgatcttggctcactgcaacctccacctcccaggtttaagtgattccctgcctcagcctcctgagtagctgggaactacaagcacacaccaccatgtacagctaattttttttttttgtacttttagtagagatgggattttgccatgttggccaggtaggtctcaaactcctgtcctcaagtgatccaccagcctcagcctcccaaaatgctgggattacaggcatgagccactgcacccggccaaggatggagtgattttggaggaacacctattgcctttcctcatcagtcctggtaagggacttacttgacagggaggtggccccagtctttggtttctccctctcttttattttatttatttatttttttgagagggagtttccctctttttgcccaggctggagtacaatggcatgatctcagctcactgcaatctccacctgcccggttcaggtgattctcctgcctcagcctcccgagtagctgggattacaggcatgcaccaccatggctggctaattttgtatttttagtagagacagggtttcaccatgttggccaggctggtctcgaactcctgacctcaggtaatccgcccgccttggcctcccaaagtgctgggattacaggcgtgagtctgtaatctccctcttatgtcttccctgagggcagtaccccaggatctatccagagccagcctctgacagacacaggcaggccacagtgttccccaccgctgggtgagaactgccctgccacagacttgctttccttgtgtctgggttgcaaggtcaggatctgggggaaaaggagaagaggggttcatgtcagtctcgggatatgcggacccagatgccaggtgctgtgtcctgagtttggcctgagaaagatctaggccctgctgggtttacaggagttttgtacactcagattgaattcctctccctctcttatctgcctcactccctcttgtgcaccgcactgtagccatgggctcacctttctgcacattgaacatgctgtgcttattgtgacctcaggacctttgcacacactggtcttccttcctggaatgcttttcccctgcagggccagcttctcatcattcaggcttctgcacakatgtctccttccctgcccacccccaccccaggcacgctgcagagcttcctacagtgtggggtggccaagcactccaggccccctctttccttttggtcaggcccacacaccatcgcactggcccaagaatcgtcttgccagtgrgagggaagaggaggaccctgcagcgggtccccactcagtgctgctagtctgggcctggcccgaggagackgtgttattggtggaatgtatgtcagcaggaaggcccggagaacatgcttctgttcctgcacctcacacgcgtggcctgtccttgggggaggtcatgccctgggcactgaattcctgtttatttgagcttccaatgtggcaatctatgggtttagttgctcattcagtctctaatttatgggactcaacctccccacccttcataaaggaagccggccattagtaggagtctggaaaatgtgaaccagcagaagtaggtgagttttctgagttttctttcttggtcatttatttatggtggggttatacagagcccctccgcccccaccacacatatgcacatgcttgattcctttcaacagaaaaagaggcaggaaaggatgtgtaaaatgaagagcttcaccgggggctggccatyggttggctccagtgagtgggagcggatcttgttatgattgtccctgaaaggacaggtggtagttagatttagggggaaaaggagacagagcccggcattcatttcaaaggcctgctcttgggctctagccccttctactcgggaggggcccaggaagctgcattcagaaggaggatgacctcaggcctgactcagagaagccctgccctggaggtaaagagcacaaactccagtcagaactcggttccaatcccagctcctccactcgttggctctgtaaagcactcagcacctctgagtcccacttttcctgcctggtatccaagggctagagaggaaggtgggggagagtatggcaggagtggggtcccggcaagccatagaggtatggtaagagcatcctggaccagtagccctctgactcccagcccatgacgtggcctcgctgcctcagctgcttgcaagcataagcttggagctgccttcttctggactctggggtatccatctccttgacctggctgtgaatggatttgagtgtgtgatatgcctgaaatgacccccagtgggtcaaagcacccccagcttccatgacactctcaaaagggcctatggccccaaagctaatacctggctgaccgcacccctcttgtctccccagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagckgatgcctccttggccaccagaccatgggccaagagccgccgtggctatayctggggacttgatgttccttccagattgtggtgggccctgagtcctggtttcctggcagcctgctgcgcgtgtgggtctctgggcacagtgggcctgtgtgtgtgcccgtgtgtgtgtatgtgwgtgtgkatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatccygggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctrccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgkgaggggcccacaggaagctcagccttctcctcccaaggtttgagtccctccaaagggcwgtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgtgtgttttctcctagacccgtgacctgagatgtgtgatttttagtcattaaatggaagtgtctgccagctgggcccagcacctcgtcttgggttgcgcgttcctggtgttccctgctgcccaagctggcctgatgctccagcgcgctgggcgttcttgccggtgactgtctacagccagtttggcgggacaagatctctggcgcagacaccaacgcgccctggctgggtgttaatcacacagcaagcagcagcctcctgcctcccgttggggcgggtaaggtggcatctggcgaggtgagccaggagcacccaaatcctgccccggccaggtcacccctccctgcggggctgccccgcccgcgggctgccattatcagctccgtcaaccaggacacggagactccaggaggccagcgcccggaagtgcggggccaggtctgaaagtcggggctgccaaagtccctgggcggagcccctgtgctgcacggcctcactttccctgaacgccccctcccagcaccccgaggccggagcccctctaacggatgggacctgccgtgccgggggttctccagcagcgcagggaccccaggccccgccagaaagcgccgtgaggccccgggtcccgttcggagctgagaggggaaacactgccccctggtggtaaggggacgcctctgtttttgggccgcggcggctctcgggagagaaacgggaagggcgcgatccagtattgagcacctactgcttgctaagcgttgggctgggcatactagttggatttttttccaacttatgtctgtaattcaagcactttgggaggccgaagttggaagatctgagcccaggggtttgagactagcctgggcaacagagctagatcccttttctaccaaaaaaaaaaaaaagaattagccgggtgtaatggtgcctgcctatggtcccagctactcgggaggctgaggcaggaggatcgcttgagcctgggaagttgaggctgcagtgagccgagatcccaccactgcactccagcccgggcaacagagggaaaatgtctcaaaaaaaaaaaaaaaaaatccccaaaacaatccgaggcaggagggatttccgctttctagatgaggaaggtgagggtttttagatgagagaggcaaggttcacaggaaggaggcttgtagggggtgtctcctcacaggggagaggtgacttgcctgctgtccctgggctcggacagtgtaaggccagagggaggacagatcccagggcaggggccatccaggaggcgaacccagcgtgcattcttgttgttgttgttgttgttgtttgagatggagtctcactctgtcacccaggctggagtgcagtggtgccatctcggctcactgcaacctctccttcccaggttcaaaccattctcctgtctccgcctcccgagtagctgggattacatacaggcatgtgccaccacacccggctaatttttatatttttagtagagacagggtttcaccatgttggccaggctggtctcgaactcctgacctcaagtgatctgcctgcctcagcctcccaaagtgctgggattacaggagtgagccaccgtgcctggccacagcagcgtgcgyttttatatttatattttccttcctggggaaagaggggctctgtgggcaaaataacctgctgggaacccaccggacccaggtgagcaggggcatcggatgcccatggcaatactgtgaacctggggcgtgggtgaaggaggcggcccccaccacactggagccgcagagaccacgagaccatgaggtcccctgcccggcaccgcccctgttctgtcggcttgtgagtgcctcctcagggtggggtggtgcccgatgctggggtggcaacctcatcctgccccccgtccccatgcatgcagctccagcctggggtgggcgggctccgcaggacggcgcccgtgatgaccccaaggctcagcgccctgatggaggcagatggggccttttaacccctgctggggagcggctgcctggggagggggcaactcacctgcggtggggggtgaaagagcggttttaaggggaccatccaagccaagaaagcaaggagcaaagagaagagctcagcagctctccccagacccctccaccttgagcttgggaagtggagggcggtggggaaagttggggaggaaaagtgtgagggttgatggtgtggaggggagatgtacggaggggcgtgggggtagggggagggagtggggatgggggagggatggggtatgaaagggaggcgtggggggtgtggagaaggggtggatatggaagggaggggtaggggtggggtgggtgttggggatgagtgtgggggaggggtgggtatggaaaggaggggcaggggtcggggtggttgtgggggaagattgggacatggaagggaggggtggggtggggtgggtgttggggatgtgtgtgggggaggattggggtatggaaggaagacagggtggggtggggtgggtgagggtgttgtgggagtggtgcgtatggaagggaggcttgggttgggctgggttgggggtgggtgtcggggagtggtgggtatggaagggaggtgggggtgggagacagatgggcatagaaatgaggtgtaagtgtgggaggggctaaagggatcagcagtgtggggtcacgagcctctggcccttatcagggagtctggggctgtgggtcacgccgggatgggcttggcatggctggctttgtttcctaagaggrcctctggctctgccgtgggagggcagggggtgtggacagccaggcagtggacacagtgggcagtggcatggctcttgcttccccagtggcttggacagtcccctggctactcgcccaggagctggaggacccaggtgcgggggagagaagagaggggcagtacccaggatggtgtctgggctgctatgaggagcccattgaattttttaagggagagaaggaggccctggaggcctgtgctgctcccacccaagatcagacccaaccctcggggatggggagggccaggaagaggtcttctggctccacagccagggccctagggggccagggcccatctcccgggcagcagtggagcacagtaggccagcgaggcagggagggcatctcatggttttcttttttcttttctgagacaacagtcttgctctagcccaggctagagtgcagtggcacgatctcggctcactgcagcctccgcctcctgggttcaagcgattctcctgcctcagcctgccgagtagctgggattacaggcatgcgccaccacaccaggctaatttttgtatttttagtagagacggggtttcaccatcttggccaggctggtctcgaactcctgaactcagatgatccgcctcggcctcccaaagtgctgggattacaggtgtgagccaccatgcccagccgcatccttttctttttctaacagatgggggcggggggagtctggctctatcatccaagttggaaagcagtggcaccattgcagctcactgcagccttgaattcctgggctcaggcaatcctcccacctcagcctcctgagtagctgggaccacagatgtgtgcaccacgcctggctaaagcacctcatggttgatcgcatcttccgaactgaccagaggcagagtgggaattggtaccgagtgcaagatgacctcaggcactggcggggttcttcctgacctcatcccccacgcctgyggcccccsacgcctgcagcccatcttcctcccaactccccccagatttagctcaactcctgggggctgtctcctccttcctgaccctggagttgggggcactgggaagggtgggcctcggctgtctgtggtctagggggcagagggcactgagcagaagcctggggggcccagagcctcgattcagggaggcaggcaaggactttttcctcttgggggcagtgaatggggccaaggtccaggcctgcaaagctgaagctgccctagttggggcccactgtctggagcatcttctcccgagctctgagtgagcagttggaattcatgtagacccaaggcccagggaacaggatagcaatctgggggcctcttttcatgatatgtcagtgagatctcatgttacagaagccttcattcccaccccacacaccttcttaggaggaagcccatggcaggtgatggcagctgtgccctgcccacctgggctcccccatctctcgtgacaggcccaccaaggacctcctggggctccctcgacaaacaggttaatgagtctaatgtctcaaggcttctgagaacctccctggtgcgtgaggaccttgagggtgaggatgagggcaggcaatgatgacagtggacagagggacctgctgttcaccgccttggatgctggtctgcgaggcagggatcgaacctggggaccccctgggaaggcagaatccacaggattgaggggattcctgggcctctgtgtgtgtatcctgggaggatgctgcggttgggaacaggtttccaggcaggccaggctggaaggttgcactgtttctaattcaaggcagtccaaagagggattatctgttggggctggtaagaatccaggcaggcttcccaggagaggcatcgcttgaattaaaacttgtttatgtttttaggctgggtgcagtggcttactcctgtaaatcaaccccagcactttgggaggcccagccaggctgatcatttgagaccaggagttcgagtccagcctggccaacatggcaaaactccatctctattaaaaatacaaagattaggtcgtgtgcagtggctcacgcctgtaatcccagcactttaggagggtgaggtgggcggatcatgaggtctggagatcgagaccatcctggcaaacatggtgaaacctcagctctactaaaaataacaaaaattagctgggcgtggtgggcgggtgcctgtaatcccagcaactcaggaggctgaggcaggagaatcgcttgaacccgggaggcggaggttgaagtgagccgagatcgcaccacggcactccagcctgggtgacagagcgagactctgtcttaaagaaaggcttgtttaagtttctgaacttgttaattatatgtacttgcaagtaatggtcgatgtcacaggtttagaaactacaggaaagctcacaagagctcacaagagaaacatcaacccctccaggaatcaccatgcggaggctgacccaggccgggctccgggcgctctgggactcctgttcaagcgccttgcagtgaggccctgggtcactgcagtacctcccgactggatccctgagtctaccctgggcccttacggtcactccccacccagagtcagaggcccccatcacccctgtgtgcgaagccctcaggtggctttgatcctgcttggaggaaggccaagttctcaagaggccagcaaggtacctcgaggtcgtcagtgtgcagaccccctttaccttctgtgtctttatctcattgcccgtgtccccctaggatgtgcacttgaggggcaccgggatttcggtctgtgccgttctctgccgtgcctgtgtccccggctcctggggaagatatgttaagtgaagaaacggatgtgaatgatgagtgtgtacatgcacgtgtgtgtggatacaagcagagggccacagggaggttcaggttgttttttcccccaccggaccaaattgaagactatattcaggatggaattccacagcaaaagatatttacagagggcttctcagcatcggggagacgccagtgtgtcacagcggtgagtgctgtctgtgctcggggctcacagccttgaagagacacctaagacttgctttttttatcatcgcttgagaatttcctttgatcatacatctgcatgtactcctaggggtctcggtggtcagtggcatgaactgtgacagtgcccttgcacggtacatcatcatcctggagaccctcatcatttatttaatcagccctcgttgttggataattgattcatcagggtgcatga

SEQ ID NO: 10725 - DNA, 63128 bp, Homo sapiens
tttgggaggcttgagcccaggagttcaagaccagcctgggcaacatagcaagactctgtatctacaaaaaattttaaaaaatagccagatgcagtagtgcgcacctgtagtcctagctacactggaggtaagtggggaggatcacttgagcctaggagctcaagactacactgagctatggtcactgcactacagtttgggtgacagagactctgtctccaaacaaacacaaaataataataagttaaataatacatgtaaagcaaccatcaaataactggtctgctccattattttttcttgtattttctaatgttctatataacgtgtgtattaattcataatcataaaaaacaaagtcctaaaactgaacaatgtagaaaagaaggacttgacatctcacttttacaagtgagccaccagctgggaccatcactcaggcaggaaatatcactcaggcaggaattcagcaagtgggccaaagggagactcaagttttcaaacaggaagcgatatggaatctgctcttggctgtcagaggctgctactgtaaagctccaaagctcctggggaaagatgatgcctgcctttgtagtcagaaggtcaccaagggtattaagctgagaggctagctttgtgtattaggcttagttttgttgaaaggtaggaccagaccgaactagctaattttagtctgaactattccatttagtgccccatgtgatccagaataaatcattcaaccttgctgggtcataattctttcatgtgcctataacccaaatgtcttgtttctattacagtatgtctaaaaatgaaagaaatatttccattaacttagaaaattacagtggaggagacaccaccaatttgattgctggaaattggcccactaaaatgtccctaggagacacacaggggttcccaggcaccctcttgggtgcccttggacacaggctgtgttccctgacttgccaccctgctgccctggctcctttgtacaccactggtctctcctctccctaccccgtttctgtgaggagtatgagcaggggacacctgttttctccctgctgcaacatcccaagcatgggacatgccttgacattcatttcccttaacatagcacagatttggcttatagcatttatcaggactttactgaggactcctgacaatacaaattaaagagaataaagaatagtctggtaagacaccctccttccccgcttctctttttttgaatagttattgagtacctactatgtgccttaggaactcctaagcaaaaacagaaacagcccttgctcatggatctcacagttcagtggaggagggagacagacattaaccaggtaaccacacaaataaaaattgttataagttgataaatgcgttgaagaaaaagtagggagtcctaagtaaaggggatttacttagtctggggagttaggacgaaagttcctgaggaagtgacagtagagttgaaaggtkaaggattcttgggcattcagctgttaacagggatggacagagaaagaatattggatcctgaagaaacagcctgtggaaggtgatgaggcaggcagggtctggtcctattttgaggaactgaaaaggggacagtctgaaagggagaatgatatgaaagcaaaggagaaaagcagattatgaggaaaaccatgagaagccactgaaggattgtaagcaggggaatggcatggtcagatgcagtagaaatggcagccctctggagatagagtgcacatacttcaaccagcaggcaaaaaagacaaatcctggaagcaaaggaacggtgctaggaggagaaatatgaactctgtaaatgggataaatagaacgtcttctattttttagagtattaaaaagaatcagcaacatccacacaaaatttgtataggaatattcaaagcagtattattcataatagccaaaaagtagaaacaactgaattgtctgtcaactgataagttggccaataaaactgtgctatatacatagaatggaactgttattcggcaataaaaaataaatgaagtactgatacacgcttcaacatggatgatcctttaacacatgctaaatgaacgaagtgagacccaagagaccatgtattgtatgactccatttatatgaactgtccagaataggcaagtcttttttattttttattttatttttattatactttaagttctaaggtacatgtgcacaacatgttacagaggtatacatgtgccatgttggtttgctgcacccatcaacttgtcatttacattaggtatttctcctaatgctatccctcccccagccccccaaccccctacaggccccggtgtgcgatgttccccgccttgtgtcctgtgtccatgtgttctcattgttcaactcccatctatgagtgagaacatgcggtgtttggttttctgtccttgtgatagtttgcttagaatgatggtttccaccttcagaataggcaagtctttatagacataaagttgattggctgctactgagtatgtgagtttcttttagggaggaacaaaacttctaaaattagattttgatgacagttgcacaactgtaaatctaccagaagcactgaattgtatggtaaatggattacatctcagtaaaactgttaaaaaacacagttttaaaaagaatccaggaactggggacacagcagaactggatctcaatcctaattttttctcactttgtattaatgtactgcaaataattgtagctagcacaagagagcacaatgactgtcttgctaaggtgagttgggaggatttatttcgggctctgttaatacatgttcgattgggagagttgggcccagagttcatctaaattagtagtaccaagcagctgtttcagttaatcattatgagggctgtaaacactcaaaaaatactcaattaacattttaaaagaatggtcctactttgttaaaatagtactttttctctttttggcgtttttccttttaaaaagtagccctatgtatcttgaaatcttgctttcgttaaaattaaggtgttagcttaactttaggatattgcctcagaccttttaaaaaatgtatttgctatctagttcttaaactctgattaggaacacatgaatcattatttaatactacacaggttcaaaatagcttaagagagatggaattcgaggttgagcaggtggcggtgtttccgttttcacactctgagaaggccaaggtttcttagggaagcattcctggtatctgtatcaaccgttttcagagttattcagctggtgtgtgtgtgtctaatttcatttgggttgagccgctgactctgttaggttttcataaaaaatcatttcatttccctttccagcttccgtcctactggtatgtgcatgttaaagtgtaattcaggcttaactactttaggtgtaggctagttacattgctttgttttatgtatgaggaagctgagactcagtggtgataaggaaccttgatttggttgtatcactaatgacagagcttcgagttggaactcatctcctgattcgtttcttttggtgaaacatcctcttgatttctgagctttcaacctctatcttttcaaatcttacactaaagaataagtatctgcgtagaatttcattttctgttcccagaattgactttaagaatagacagaagaggtggttgtcagtgtagcataatggagggaaaaaaattaaagatgggcccttccttttcagccatttgttttcccccaggtaacaaaagaaaatcctccattttatttttcctagtaattaggagaaatccacatgtttcaacaaaggcagaaacagcatgaggactctgacctaatggattttagaaatgttgagatcataggaaattaaattaaatttcatgactgtctctcacctggcctataaatctcctaatctcccttacttctgctttggcctctttaagacccattcttttcaaagacgagacttttttttttaaaaaaaaagtaaactctgggtgtctctcccctattaaaaactctgtaataccttatattgcgtttagaataaactttcaattcctttcttggctaacaaagccttacaggatctggcccatgctagtttctgacagagcaagagcatcaccatcttggacaagcaccgccattttaagttccccttgattaaaaaccgcctaaatccagccccagaaacatcagcctaatggctaatgtcagcatgaccataaaccacaaataacacttctgaccagaaactttccaaccctgagataaaccccactctgatcagaaatatgcctcccctccaaccagagacattacacccctgacaataaaactctcctccacccagaaacattccaagtctacaatatgctctccctccctaaaccactaaatacctttagtctgtaagagagaacactcctgaccgaaatcggccagaagcccctctcaggtttattctccaaaataaacctgtctctgttaagctgctttttgtgtttctttctttaactcttacagtttccatctccaggctcaagaaagtttactttctcatttcttcttccctcaaatgcactagaatagatccttacttagggcctttgaattagtgttatccttttcctggaatgctctatgctctgatttttgcgtctgttattcaaatcgctgctaaaatatctcctccttaaaagggcatcccctttactagccactcagtcaccatcaccatcacgtcacttattgtaacttctttgcatacagcttaaaaccaacagattttttttcttttcaccctcagataagttccctagaatctacactacttgtcttcatcattgttcaatcaacagcctagagtagtgtttgttgaatgaagaaatgaacaaacgaatgcaccctttcttccgtgaccctctcctctgaacagggcaaaacttaactcataacgaggatacactcaaaaatgtctttcttattgccaggtgtttccactcttgaggaacagatgccctttaggagacagggcaatttgactggactggcccttccgattttaggtgaaaataatcaccataacagcttttcatctctggctaggcttcccagtgaccaaagctttactttccgatttccataccacgtaaagacatcagggtgagcactagggccctgagaaccctggaagctacttcttggctgggatagggctggttgcccggtgcgctgtgagtggtcctccccggagatgctgggagaaggggcggagccatcagaaaggatgagccttccttgggccttcggatctggtggggctgccactttgggaagggccccgggcttcggaagaaagcaaaactagccttgtggcgaagaaggagcccagctggccccaggctgttaagactaaggggtcgagggaaaagaggcagagcctgaaaccaaatctgcggagcaagccaaggcctggggacttgccagagggaagggttaagccgtttccaaggcaacggaccaggaagcgcgcaagacgtccgccgcaggttcgtaggtcgccctcgaatttaaagctcccaaggctgagtgggtcccggccaatggagaggccccctttaagtcatgtgaccagcggggctgccccgcgggctgctccgcgggctgcactggagcacgtgggaaggctttttttcctgttccttctttccctttttaaacgcccacccacttttgcgcgggctcggccgcggaatttttctcgcgagaggcgcgctgccctctcgcgagagagagtgggaggcgtggagagtaggcggtgttgcgggccggagctgcggcggcggcggcggcggcggaagccgaggggtgggcagggcgggggcgggccgcggggctgggagggggagggctgggggtcagcgcgggagggggccagcttgcttgcccggctcgctcacgggtcgttgaggccggtgacatgtctgtgagctgcggaggctgcggcccccaggtgagccgggcgccgacgtgctcgccgcggaggctgcgtttagatggggtggcggcgggtgtgcggccggcatggatggagcggcccggctccggcgctccagcccctccgcctgccgctggtcccccttctggcttcggggccgcccgagagctgcgccttcgcatggcggagggaggagggcgggaggagcgcggccgaaggaggaaactcaccgcaccgggcccagagtagagggaggtgctgggtctcgagacgcgtcttcctggggtcccaagtgtggcggtggagctgccgccccttttaatgacaggctgtttccatccccggggtggtcttcagagacggccccccgggtgcgtggtgcgcgtgcttagtgtgtgttcgtggtgtgcgcacaggaacatttgcagcggttgggaggacgttgcactttgttcccgaacagcatccttcactgtcagacccccggagccttggaagcaggcgctgctcagatcttgtaaacggaaggcgtcaaggggctcctcagagtattgatatttggatttgctgtcaaatactctcctaggctgttaatggcttaaggctggccataaagtaccccgaatggattgagtatactgctgttaatccaggcatctaagctgctttataaaaaatatgtagatgtaaccgaagtattaaaaagtgacaatgacagtaaaagctaacattttttctcttccccatattaccagctttcattttttttctctgctttgtctgtcttctaaaaccatataaagttggatgtggtttagctttagatgttaaggagtttcatggtgagaaagactgctgagatacatacctaatagctttagtacaaactggagttaattcctgttctcttttcagcttttcaatcgcttgcaaaatgctcgttttgcttagctgcttcccactgttttagaaatgtcatgtcgattgttattttgttatgtctgaaaatactcaaaatatggagtactaagaaaaaatggggtatcagtaatgcacagatatattttttttaatgtcatcatttgaggatggcagcccagtgcctggcatgattggtgtcagttaaaatagtgcaattgaatgattttttttttttttgaaaaacacatttactttttcaaacggtaccctgattattcattttttcttgtcgttgttcctcctgacaaaactgacccaggggtggacagtgaatgtcactattgtagctgtaacagtaatttatgaaaggtcaaagaatgtaaggaaatcagggaagaagtgggttcccaagctgagctagagactaatgtatgtacccacataactgcagtatcgacaatattgataagggcctagcagtggactcctaggccagtgatattttgcagttgttgaggatatgggaagttgcctaagacatggaaccatagtgagaaattctctagccttctctagccccctgaactccagggataagtctagaagctgaagaagtcctcttttgcctttagaggctggaaaaaatacggtacttttaatttttttattttttaattttaggaacttactgtctggaaaaggaactcaaaccaatttggacaatatattaaaggccgttttaagagaaaatgccagttgtaaataggtagaggaattctgtctatacgtgacaaaaatgtgaaagacttagaaaatatctctttgtgaatgggcagaggagaccagtgttgattagaaaaaattccttcttactccatcttagcaaactaattttcagaagtagaaaaataaattttttggctggtcttcataaccttttggcaagggtttcaaacttgtagggcgtgtggtgtttggtttttcaaaagtaattgaagtaactttggatagggtaactgattttgttttttttcctgtcttgtggtctgcattttattaatcaactacctggaaggattgaagggtgaggacaggtcgagaaaagctttaagttaagcctgggcatgagttaagggtcaatgagctggtaatatggggaagagaaagaaaaatgctttatcagtttaaaaacagcctggaaagatccaagtgtctcgattctcccagtcatccttacatataaaagtttattaaaaaaatacttctgggccaggcttggtgccttacacttgtaatcccaggactttaggaggctgaggcgggtggatcacttgagaccaggagttcaagaccagcctggccaacatggaaaaacyctgtctttactaaaaaataaaaaattagccacgtgttatggcacatgcctgtaatcccatctagtcgagaggctgaggcacaagaatcgcttgagcctgagagatgggagattgcagtgagccgagatcgtgccactgcactccaccctgggmgactgagtgagactctgcctcaaaaaacaacaacaaaaaacttctggagtaaargcatttgaaatttgtagattagagactggacatggtaaaaggagaaaagttatcatttttagaataatctgagaatgtttcttgggaaataaatggggtagaggcctggaacagagaggatgttacttgactgaaaatgaggtatattgtaaagagtttcggtttgggagtcaggtctattaattaaatgagcctcattttcttcatacccacctcaaaaagttagtgcgaagcacatagtagctgcttactcagtgtttttatttttacctcccgtaatggtttgaggattctttgattgcaaggaagaaaaagccaatttaattagcctacttaaaaaaaaagcatttgtcatacagtgctgctgaagtccattgcatgattccaattcagcgttttgggaaccagaaagtcttcaggcagttactcttccagtttttctctggaagcacatggtcttatgtctctgctactcacgcaggtctgttccagtttctttcagattggccttctctttaaagctcttggtttccacttccccaaaactttgatttgcatgagactttggtttgccatgatgccaacatcagactcactgactatgcaacatggttctcagcaaacatctccaagtctcagttatgtttctagrgagagaatccaattggtcaggtttctgcttctagcacagttggctggagagtgaggaaagataggaatgggaaaaatggatgaggaagagacttagatttgtctcacagtttgcagggctgctccttttaaactggccatgccaacatatttaacaaaaggagagtggacagggaggaagtgatggatacctcaggtgtgctttaacatcctgcaatttgagttcttcctctggcattgcattgaacttgctctcagcttggtaatgttctaaccagatctaaccagtagtctctttacaggacagattctcctgggtgtgggagttcaggcaaattactgaaatgcttgatgactcagttttcctatgcgtagaatgggcataatagcaccttctgtggtgagaattatgaattcatgtatgtaaagcaattaaacartgtctggcatatggcaggcacaatgcaagggtacggtattagtatttgttgagagcataccgtgtggcaggtactgtgatacaggcttctggtcgtgttcagagaggaaggaatttctgccctcaagaagtctagaagtccagtgctgaccactcatgcttaaaaccatttcttgacttcagtgacactaaattcttctaaatctctacctcacctacctttctgactgccatttatttgtggttccttttatgccggtcctggaaccctttatcatggttgtcttcatagatgctctcttgaatttctgttctttcccagtcgctgagaccagctttcaggttctctatatgtggattattcttagagtaacatctccatctctgaccccaagtaaatctcttaatttttagttctttttttgggtattattatttatataatttatatgttttgagacatggtcttgctctgtcacccaggctagggtgcagtggcgcaatcttggctcactgcaacctcctcctcccagggctcaagcgattctcccttctcagcttcccgagtagctggaaccacaggtgtgtgctaccacgcctagctaatttttatatttttttagaggtggggtttcaccgtgttggccaggctggtctcaaactcctgggctcaagccgtccacctgccttggcctcccaatgtgctgggattacaggtatgcgcccactgtacctagcctcttggatattcctatgttgatataaaatactgtcttccagttaccttctaatttgcaaagccttctgatttaccttctgatttgcaaagaaaaaaattttctttcagcatcccaggcttaaaaccttraagttatttttcacattcttctttttttatgctgtaatataccctgttagttaataggttctgtgtgggcttttgggtgcttcctatgactggcccatctgcaaagtagatctgttgacttatttcggctactggcagcttaggatagatccttatatctgtaagagctacttaaatgccttttcagcaatatactcttagagtcatggcgtcatagatgtcactgataaaaagaaatgtgttcctgggttaaaattctgaacatattttctgttagaaatagtcttgtggatagggctacgtacaagattaagaatgttactccattttctagggagcatattcatgttgaaagcacaatctcaagattttagttttttgttgttgcatttttttgtaggtattcaattacatagcattttaattatagcatatcatccttataatattgccatacacatatacaaagttttattataaatcagttgttgaaaatatttttgaaagtcaaatatattacagmtgcacactcaatagtgaaactaagataatcatttgagggcatatatcctttacagtgatttcttaaaactgtattcaaatgtaggtctaatgagttttttattatgaaaatgttaactgttttatcctcctgccttcatctgattattctaattaacttctaacaatggaccgttgcatgtttaaaagttgtgtttattgttgctgaataagtagttttgaagtcagtagccattcacacttagtactttgtcaactagacccatgttattcctttcaataccagtggctagttgggctcaaacataccttataagtagatctcaatctggaatgcagttgaaaaatcaataatttttctctgtgactgtttgggaaaacaaaagtgacagaacaaatattcttggattaattttgtaaaaagtcattaggtaagtggccctattttctatttggtgatgttgcttttgccaccaaatgcctgtctgcattcacgtcattgatgaaatttctcttcaccgtacagctcgttcacttcagtaaatctatagttgcttattatgagtaaggcctttggggaatgcagagatgagtaaggcatggcgatggaatgaaattcactgttgtatcccaatcactgttacttagacgcttggtgaatgtatgtgttgaacgttggtagtacttacagtccagtgcagggcatagacatgtagacatttaactgttacataaggcactgtagtctaaagtgctaaaatagggtaagtggtgattttgctccccaaggaaatgtttggtaatatttggagacagttttggttactgcaactgagtgctactggcatctagtgggtagaggccaaggaagctgctaagtgtcctaccatgcatacacagcctcctacaacaaagacttatctgacccaaaatgttagtaatgctgagattgagaaactctgtagcggtaagaacatatatattgtgaatgcaggaatgaggttgaggattaaaaaggaaaaaggcagaaactataaagaagcaaatatcttaatagatattaagacatactaaaatcattttatacgattgactgttgttttgaaaaacaaaatagtatctgatagctgtagtagttttagattttgtaagtcaaataacaggtctgtacccaagaaaggaacttagcttccttatttgcaaaaagggggataacatcacttttattctgctgttcacctattaggtattattctgttttatttttctagtgtttgtgttagggtttacaagataacttattacaggttttcttcaaataacatcacttcatgtttaatgtagaaatctatgacagtctttttttgtctccatctcccctgccacattttttatcctattttgtcatacattttatcaatatgtctgtcttaaaccctctaattaattgttactatttttaaacagttatattttaactgtttaaaagggattgaaaaatgaagaataacttctgttaccctcatatttaccatttcagatgttctttattccttcgtgtaagattcagatttccatctggtattgttttactttgcctgaagaatttctttccatagttactctagtggtggtcaactggtggtgaattttcayggcccttattcatgtgaataaatttattttgccttaatttttgaaatacattttcattgagtatatctgggttgatgcttttttttttttcttcttcttagtactttgaagatagtgctccattgtcttgttttccggttcatatagatgtgaagtctgttgtccttggttcctctgtatataatgtgtactttttttctggtcaattaatattttttctttatcactggttttcagccatttggttatgatttgccttggctttctttatgtttattcttagggtttgctgagcttccttggtactgtcagtttacggttttcatcaaatttgggaagttctctgctattttgtcttcaaatattttttttcttctgcacccacttccccagtgcacgcacgtgcacacccacacacacacacacacacwctctctctctcactcactcactcgcttactcactatgtctcttcgtggaactccagttattcaccttttatggtgcttaaaaagtcacttacactctacgtttgtttttaagttttgtctctccatgtttcattttggatagcttctattacattgtctacaagttcactgagcttttcttctctagtttaatctgttaattgtatccagtatggttttcgtttcagtatatttaattttcatctctaaaagttcaattttggtgtcttttgtatcttctccttctctccttatggtgatgttttcctctcacttcttgagtatatggaacrtatttgtactatagttttacaatccttttctgttcctgccatcatcactgtcatttctaggtcttcatttattgcctttttttctcttggttatggttcatatttttctcttcctttgcatgcttggtaatttttattgtatgccagccattgagtttatactgttgcttgcttgatttattatattactgaagtgtgttggatttagttggggtgcacagttacttggaatctgttggattgtttcagggcttgcttttagaatttattagtgtgggtccagaacagtttttaacgtagtgctgaattattgtctctactaaggctgcttctactaaggctgctacttcttctgaggagtctatcattacctgatacattacaaggtttttctattctggtggaatatattatggtttatctctagggctctcacttactttcagctctccctccagcttaataccctgtaaattctagccatcttggtctctccaaactgatctgtgtttaaaactcagtgaaaccaccagactgcttggctttcctgtccctgtattgtgacctggaagtagctggcagccagtgtttcccttctctcagggatcacaatcccgtgttccctgttgtctgatgtttaaaaccaatgtttcatatatattctgtcctgttttcttgtagttatattcaacagaatattaatttttaacacttggccatttggcatttggtcaaaatgtgtatttggagtgtttactctaaatgtgatctcagatactataaagtagaaattattggaaacacaaatgtattttcacaaactcattaaatgtagacatactcatttaaatatttgaaggcatactttgctctttattctgttttatrtttttcagcctacatcatgctttgaactttgttctttaaatatgttactttttatttattagttcagcagatgtttgaatgcctactatgtaaaaatacataaaacacttttgtcctcatggaacttacaacaggagggaagtatgcaaacagtggcaccagaggattaaattataaaccacttagagagcacaaaggaggtggttactatttgggcaaggagggataaaggagagatatgagccaagcctattttagggagggaagtttttgaactggtgcgtgaatagtaagtagcagttcagctggtggaagagagagggtagatttgagagaagtttaggagaatgacaagtcaggatttggcaatttactaggcgaggtagtctgtaggaattgaggggaagaccagtttccagcttggcctactggttgggtttggtttaatggctcytactgagatagagaatacaggaggagatcgtttagggagaaagttttatttaccttttgaacatacaaattttggagtaactgggatatttagttggaagtgtctaataggaaattagatatacagaactgaagaataaattagggagttatttgcatagttaaaaccagaggtaaggataaaatgtccttgaaaaactaaataaaatgagacaagaggataaggatgaagactaagaaatattagtatttgagtaacaagttatgaaataatttaggaaaggaaacttacatacagagagacaagtttttctcaaccagaaattacatgtggcagttgttaaaagtacagattcctatgttccatgtagacctgttgaatttggatcttctggtgggggagttgtgtgtgttagaaataagctgatgtgtacaggtactgaggtttgagaactagtgcagtaggaagagagtcaagatatggcaatattgttgacaggcgcttcacagactggcatagttaattctcctgatacaaaaaaggtcaagtaataggtgatgtcaacttgaacatttcttaggtcagaggagataaggaaagacttggagaatatatattttttaattataaaagaatttatgttcattcagaaaagtacaaaactcaacatacatagacacaaaatgaaacacccatgattgtatctacccagatgaaaccaatgtctgtactcatctagtgtatgtcttcttttatattacatatatagatacacacatgtagttatacagatttttcacaaaatgggataatgctaatatgccagaacctgtcttattttacttaatgatctaccatcttctcatattgtagatagatgacattttataaaatttaaaagtcccacttgcatgggtgaccactggcatcagtttagtgtacctccttcaagtcatttcctgtggatgcacaaatatttacatatgtgtgtcagagttgtgtctgtatataattttttctttctttcttttttttttttgagactctgtggcccaggttggagtgcagtggtacaatcttggctcactgcaacctccgtctcttgggttcaagcaattcttgtgcctcagcctcccgagtggccggaattacaggcatataccaccacacccagctaatttttgtatttttagtagagtctgggttttgccatgttgcccaggctgttcttgaactcctggcctcaagtgatcttcctgccttggcctcccaaagtgctgggagccactgtgctaggccagtcttttttttttttttttttttttaaattacaagtgagagcatcctattwacaccattctgcaacttgctctttcacgccagtatggatcactctaactcattatttccaatagctgagtaataatcatgtgaatttatttgaattgatgaacttctagattattttcagttttttcattttatttcagtgaatagtctttcacatatctttgtgaattttgtgcaagtacatatgtaggataaattttaagaagtgaaatagcaggactaaaggatatgtgtatttatttaaagtgccctatatctctgttctctgtattctttataattgtttctgtaattgctttcatttgtttacttttgcattctgtgatttttcttaaaatcttcttggttttccattgtttttagcaatgtctgttctgcttttttgttatttctaaggggatttcatttgtttagtgatagttttctgtgtgtttcctgagctatagtggttcacttcgtagttgtttgccttgtctgcctctttcttgtctctcatctgcttttttccaagccatgtaggttcactttaatttctttgactatagataacgcacttagttattctttgcttaggactcttgtttcttcatccagaatagggcacaaagcagtaaagcactaaatgaaaagtttatcataatacaaatgtattttaggtgaatatactgtatttttgttcttcttgtgaaatctgtcaaaaacgatgtgctctctaattatataagatgctaaagaaatcctgctctagtagctgttatcctttcttcccccatcaatctttgcatcatttccaaagatgatttttttctttgctttacaaaagtatgtcatatcatytcatattggattcacttttatgttgcacagatattctctaatagatttctttcttcctgagacagtattttatttatgtttaaatgaaaaagtggtggagtaaggcagtaagttgtttttcttccatgagtgaaacagagtgtaaatatagaattaaactgtttctctttcattaatttcaaacaatgatttgaattctgagataatgtgagtctcaggggcatgattatatttgtctggattttttctttttatgtatattgtatgttgtttgtttttcagtgttccttcgcagatcccatactgaattccatttgctttattattcaatcttgaataagggtgttttatctggatctgctattcaggaaaattgtgggtaaagtgaactggggtagccagccctgtcaaatcccggatgttgtttcagagcactcccacctctccctgcccaactttgaaactgtttcttctaccttaggtgcttgttgcacctgagggtgagcagctcatttagatagttggtcccatttatttgatggtgaagtctcctgggagttaatgtttatctttgctcagttgactttagtcagcagctgcaaaggtaattgttgtttcctatctcttttccctacttcccttttaggcaaggttaggagcagactcagagaaagtgatgtaaggcgtgccattcctttgtcctgcagtattgtttttaatggctgccatggcgtcattgtgggaatgaacctaagatcatttaattactctcttgtttctggcatctagattgcttcgtatttctattgtgagttgtaatgaaccagactataaaacctttatgcactgtagaggagtggtgaagagccccagtgctggagttrgaaaatttggacttgaatcccacctgtgccatttatttactctgtgggcctgggcaaattgctaagcttcctcttgcctcagtttttctcatcgtcaaaccggggtcctattctgtagtcttaaggacaacatgagatgtttacataaacctcttagcaaaacagaacacttggtgcattatgagcccttgttaataaactagatgctctaggatcattatttgctttgatgcattcccaaaagcagaaatgctgagtcaaagaagtatttccagggttttgacacgcattacaaaactgccctgcaggtgccactttacttaggagccttctttgacagtctctggtttcttggaacccttatgttggcttctatgttttatgttacatttgagaaaagcccacttgcctctgaggctttctggcagttgaggagaacactgtggagaagaaaggagagtgaagtggcctgggacaaataaaaggattatctttttgctttggccactatacatttttatacttaaactttgttttgataatttttggtccacttgatcattttggtccttaggtaaatatttaagtcttcttttgcctgtgttttatagttttcaaagtacctcccataaattatttttcatttgagtctcacagtaaacttctctggtaaatacggtatcatatacattgaggaaaaagttccagagacattgcagtttacccagaggaaacaaagctaataagaggcagcacagggagacgcatgatcgtcttctggattctggggtatcaccctttaccttgtgctgttgggaactccttgtgttaggctgagcctttctcatgctgctgcttcaatttcagtaattaatcagattttattgttatagagaccactagggcttatcttagttcagaatagaatacaatcatacttctttgtctaaaaattaaaatgtagaaatctctaaagaagtgtgtgtgtttgtgcactcacgctatagtcttatctgcatagcaaaagaatatacaatttgaacttcactaaaatttagttttttaaaagttctgacggtggggggctagattgaagtttgtttttgcgtataaatctcctcatagtataaatttatgttaaccaaatgtcttggaaacctcagctaagcaattcattttttgtctttttgtttttttcagaaactgggtcttacaatattgtctagactggctttgaactcctgggctcaagcagtcctcccacatcagcctctcgagtagctgagactgcaggcatgcaccactgtgcctggcttcaactaggcagttcttgataagaccagattgattttctgaaaatacttgaaactaagaatttcttaaatatttatttgactttttaaaaaaagtatttagttccccacttctactctttattgtgatgaaactttttcctttgaaggctttgaatgcaggagggccatatctatcttgtttctcttgtatccatagcatctagcacaagtagattttaaatgaatggacaagatactgtggtcaaatgcagataccgagtggttaatgcctggagtggatttaagttctcaaagatgttaaagcatctttaaaaagttgagacttagttttgagtgtttcacctggcaggtgttgtgtgtgttaagtactggtaatcatttgacttggatgtcttctgaaattttgtcaatggtatgctcttaagcttcctatacaaagaatgtatctaatttgatatgtrcagatttctcattcgtctattatcaaacccttctgcccaagaaataagaatgtcaagagcattcactgttgccatagagataagagtgtcttgggaggcagggaagttggaattctttttgtaatattctctacttaagcttctatttttaaaatgttttttaaaaaacttgtttttcagatctttctctttgacactttgcaataaaaaagggcagtgagattgaataggtaagggtgtaaactattttataattttgaaccaaaatataagatttttataataattttctatctcattaaggtaccaatattcatatatttttcaaatattcttgctggattgcaagtaaattggggggggtgctcagattatttttgttttcatttttatttttcttttaatgactgagttaaaataaattaatttagcacaaaatgcttgcctgaattgttaagatcaataaataagttgttttaatatgttttctttaggtgttttgtggattaactcttcattgattatatacaacaaaaaatagttatggcgactttcagaaacaatcacatgaagactaaagcatctgtcagaaaagtaagttcactctattaggtttcttttagtgaaagttttaattaaaatgttgatttttttttaagtcctacagctatgatgttttgtttaaatgaatcttattatttgaattagtaacattgaactactgcaaagattggcatgtatgaaaatagtgatacaaaatcatgattacagtgattttatttcctaaagatcacagtgctttctccccattttttctctacacatagatatccatgtgcttttttgcaatataggctgtcaggtgtaagctttcttatatacctttagctttaccattcattcattccttcattcagcaaatacacacttgagttcttataagccagaccatatgttagatgttgggtaatcagtaacaagcaaacaaaatatgattcttaatcctttcttccttctagtctaaggaggaacctcctcacttcctttcttaaaacaatttggttaaccttccatttcttgacatttttgtctttgctaaaactttggaggcactacccatgaacaaagaagggaagaatggagcctggaagataattaacagtctttgttatttctttttctggacttcatcttctgcattatatgacaccattgaccaatccttacacattaagacaatatttgattttcattataggtttttcttggtttccttctcttttatggtaactcttgtctcctttgytaatctttccaaattctaattatcagtgttcctatgagcttctgggcctgccattcatttatgtagagagctaaaagatgtataggtttgactgctaagtctaagaggatggcttccaaatctacaggatgcctgcaaaatagaaagtaaacttatccttaaacagtatgttaattacwtttttttttttgggacacagtttcgctctgttgcccaggctggagtgcagtggcgtgatcttggcttactgcaagctctgactcctgggttcatgccattctcctgcctcagcctcccgagtagctgggactacaggtgcccgccaccacacctggctaatttttttgtatttttagtagagacrgggtttcaccgtgttagccaggatgatcgcgatctcctgacctcgtgatctgcctgcctcggcctcccaaagtgctgggattacaggtgtgagccactgcgtctggccaattacattttaaagtaatatgctccatatgttttgaggtaaattacctttamatttaataggtccactttttaatttgaaaaaagtacaataaaaactattttctgtttctactctttgtaaactatagtgtatttattatactttttcagattagcaactagacccatagctttaaattgattatactgctggctttaaactaataactaataatatatacaaaatataatagcaaactgataaccatggtcttcaagaatgatgctacctgacttgaatatttaccccatacattgccagagattcagggattagacagcagctgaaatttcatactattattaccaggttagtgtcttttgttattcaacgtattgtccatattaggcactcagtaaagatttaatttgaattcaacttgaattattggaatcccttttagataaaagtatgtgaatccagatattacatactgtttatataaacagttatgcacacacatacaccaccttctacatcttggtgcatcttaatgtcagacacttccctattggctactgtggaaattgaaagatatacttgaattctttagatttcactttaatttgcattaaatatagagatacattaaatatttattgggaattaatgttgcaaaattaaaaatagctatagtttctaccccagtaattttttctaacattttattatgaaaaatttcaaacacatagaaaagttaaaagcataatacacacacaaacccacgtacctaccacccatattcaacagtagttaataatttgtcttgtttgctttgtgtctgtgtatgtgtgtatttactttcaggcagtaccatttgcaagttatgatcataatgtttcttcaccctgaacacttcagcatgcttctcccaggaataacaacatcttcccacataacactaataccatgaacacatccaagaaaaataaattcccatatatctaatactcagccatactcagatttcctgtattacccccaaaatatcttttatagttcactctgcccctgtttggatccagtctagcctcttagtctctgttgcctttggcagttaggacttagcatttcttttggtttgaaagaatttttcctttttttctttatattcaattctgacatcttgaataggccaggctagttttattttcttgtaccatgtttcacatctggatttctctggttgttttctcatattgctatttaatttgatcctctcccttgtatatttcacataaagtagaagttatgtttaaaggtttaattggatcaggttaagcatttatggcaagaatactttatagggtgatgtgaggacagaatttcaggttttcccatgatcagtgatgctatgattgatcagttgactaaggtgataaccctgctagcatttccattgtaaaagtacattttctgttttttggttagcacataatctgtgatgatacttggctgtgtgcaaatatcctttttttcccccaacaaccattgagctaatgtttttggcatcccttgcttactctttcctgaattcattatttcatgggagttgcaaaatggtgattttcctaattctaccattcctttcacatttatttgctggtattaaagaaaagcttccctcattcaccttagatgaactatataatatctcctatagaggcagggcaaatgccctttaattaccagttttcagattaatgacagggcatcatagttaacaccagtggtagcaagtgagtttatttccccacattaattcactaatttatttgtaatgctctggactcatggatttttgcagttctatattttataaccttttatttctttacagtcattaattcatctatgtaagttgctcaaatttttccaaaattgatacctgagagcccctccaagtaggtacctatatccttttgtctcaggctcataactttgattgctttttcactttcgggttgtatccttttggtacaggatgacctaatttcacctactttaccttcctcagacctgaaattggctattttttttttaaagaaccctgaatagtatttaaaacccaagatctggatactaggagttgcctttgcacttaccatgtcatgagtttatattgacagttcacgttcagatttcacatattttttcctgttttgatttcctgtttctaaattagtgtgaaaatccccgtttattaaggaaaacaaaattgtttaaaatattgaatattttcaagcccacagaaaagttgagaaaaaaacctagtacaatgagcacctcatatagtcttcactcagattcaccctcggttagcatcatacctttaagtatgtcagtatcattaccacctctttgaaaatcattaattcagtaacatcatctagcatgcattccaaacacagatttccctgtgtctcaagtatccttgtaactttttccttgcttctcttctaggatccacactgtatttggtcaaggttcacacactgtatttggggattgtatctctttggtcttccccattctagaccattccaatagtctaaattcttttctcatgcagcaaatcttctgaagagtctaggccagttgtgttgtagaatatttttatatttgggttcatttgtttttccctgtaattagattcaacacaacacctgaaaggtgatgttgtgttcattccggtctatcagatctgaagtccatattgttgatgttaggcttgactaggtggttaaggtaataaccaccagatatctccaatataaatgcacataatctctttatgattaatacacttaataaactataaggtgatcctctgagacagtatgagtgtccttttccccagcttttaacccagtagatttaggatacatggataatcctttcctaaatcagtaattgcattgggagtttacaaatggggttttctaactttgtcattctgtccatactagccagcatttttaggtaaaggagctcctctgactttgtctcttttaatggactcacagattttttttaatccagtagtcataattcattaccattttcattcttcttgattccacattgtcccatatttggccagtgggaattctttcaagctggcttctgtgttttttgaaattaccctattagtctttgagcatttccttgcattctggcacagttagatgttccaggctcgcttcatacattctcagcctcagacctggaaccagccatttccccagggaaatctagttctttttattggtgatagatatttacagaccaaaagctgggtgctgastatgctcattgccactgaaggtcattgtttctaagacttttcagtggaaaaaaggtagtacatgtattcaaagaattacgaatttgtaatgacaggtcagattcaaatgtaacagtacagctttttatcataaattctttgagtttatatttgtacctcttagactaaagatttccatttattttaatttattaagattgcagctgtttgagttaatctagtgtgaggttctgaaatatggggaaacaaagtgagtgaaacacagtctgtgacttccataatttgttttaatgggtaggaaagaatctgattatagtaattatatgttttttgttttcgagacggaatctcactctgtcgcccaggctggagtgcagtggcgcagtctcagctaactgcaacccccacctcccaggttcaagcaattcttctgcctcagccttccgagcagctgggattacaggcacgtggcaccatgccaggctaatttgtgtatttttagtaaagacgggctttcgctatgttggccaggctggtctcgaactccttacctcaagtgatccacccgcctcccaaagtgctgggattacacacgtgagccactgtgcccagccaataattataatatgttttggtgtggattaaatgatcttagtgcacaacatacagcaggaactttgagagagatttattaggactaaggaatggaaaaatcttcacaggtcttgggatgggtaggatttctacatgggaagactgggaagtaaggacatttctgattgaagagcagattgacaagtcagtggaagggggcataaggtagaaggaaataagtgttctatttatgcctgactataatactcattattttctttatgtaactttttccttgtacttgtgacaaacatctcaccctgaaatttggaatcccctctcattttcatcagacagcttccttaagatccatggaaaaccttattttggattattatcttatttttctgtctccaactttgttaatggagtaatcactgttgttaagggagtaatcactgttgtgcaccttaccatagctcccacatcatctcattcaatcatataaattgttgcttttgttctacgccagtgacttggaaatcagatatgcagtttgttaagttttagtgtaaggtaagagtaagtgaacctggtatgagatctcacgtgatcttctagtgagttgaatgcccaggctccagtagtatgtgttttgggcatgtgaaactctgcctraaccttttcagctgaatggagcttttcttctcagtggaattgagttccgcattcagtatcaaaaggtgccagtgaatattagttagagaatgagtgactatctaaaacatctccaggatctcttacccttgtcttagaattraataaatttgaaatatctttgctttctttcccctgcagagcttcagtgaagatgtgttccagtctgtaaagtctttattgcagagtcagaaggaactatgcagtgtaacagcagaggactgtttacagcaggatgagcatgccaatttaactgaggtttaacatactactttctaaaccctttcctaataatgcacagcatattttcatgcatctttgtaggactctatgatctatttttaaaatgcctaaaatctctatttgttgttacatgtatcagaagtacctgttttgtgggcgggagaggggaaaaaaaagaagtacctgttttaaatactggctaaaataattttcttaattgacaatgaactcaaacaaatgagcacatttattttatgcagagtactaattggatatatagcattacattagatgatgcctactatattcagcaactgatactttaatatgaatttttctactctgaaacatagaacaaatgcatgattcttatgttgattttttgggttattttcttgactgtttaaattcagtgctttgattaaaaatgaaaaagtagtgataaatttatctttgaaattaagatacttactctattacttgaggataagataatataccttgctcacctatttctctgctacatccagtgtttcaaatctttgtttgaatttattattataaaaagagtaagatccttttctataatatatccatacttcatcatcacatttgttaccaaatacgagatgtattaggtcgttgcagctcacaactgatgaatatttgaagttaaaacattttattttgaaataagcgttctaataaaatcgtggttatagatagatgctcctggacttatgatcgagttacatcctgatagatccatttttcatcaaaaatattctaagttgaaaatgcatttaagacctcataaatccattgtaaagttaaaaagtcagaagtccaaccatcataagttggggactgtatgtattctctttcgggtggatgattttcttaatattccttgagaaattctctatttgacgtcatttcataggaagatgagcatatgttttaggcctgtagtgttctggtgcctcatcctctttttgtgtcagcttaatttcactattattttctttgctaacctttttcattttactttagcaaaaccaagccactcttaatctacttggttgtttccaaataaacagtggcagaacataacaggcctaatacatatgctcatcttctatgaaatgatgtcctgtgtcctgtcctccagtggttttccagctcggataggtcgcagtgcttttccaagcccacattccttggtgaggcctttcttgaccaatgggaaagataaaactcccccggcatcttcaaaaccctatgccagcttattttctctcttgtattcagtaaagcaaacttgaaggaatggatggaatttctattccattttagggtgtgcaaatctctgagtatcttttcaaataaaggaaggaaattagttatttgcctatctgttattgagtgcctgtaatgtgctaggcactttcctctacattatccagttaacctcacaactatgagagggaagttgtattgccttaagttttacagataaggagacaggctcctagaggttagcaattcacctagatgcctagaagttaactgtatgtaacacttacatgaagtaatagccataattaatcagaataaagatctcagagtaatataagattctgacttgcttctgaatcatcagaaatagatcgaaaatatattcagtgttgctatattctgactatactattgtccccacattcttgagaatcgattattaatattgccgtcatttaagtattgcatattttttagccacagtggttgcttagtggacagtttactacactgtcttcaaatggaaaaaatgtcttactatgatgccaaatacatagagaatataaatgtaaaaagtaacactttttcaggttataaaagtagtatatatatatttttttcttttctttttttttgagacatagtcttgccctgctgcccaggctggagtgcagtggcgtgatttcagctcattgcaacctccacctccagggttcaagtgattctcctgtctcagcctcccgagtagctgggactataggcatgcaccaccatgcctggctaattktttgtatttttagtagagacgaggtttcaccatgttggccaggctggtcttgaactggcctcaagtgatccatccacctcagcctcccaaagtgctgggattacagacatgagccactgcacctggccagtatatattctttgtagaaaaataagaaatactcaaagtagaacaaagaaaatgactatcattgatcttatgacttagggaaaaaatgcagaggggaaaagaatgggaaaaaaatagctccatcatccagagttaatcactgcttatagtttggtgtattgccttccagtattattttccatgcatatgtttttaaaaataaggttgaaattgtatgcaggctgtaaatcatttttctatgacttgtcctttttacttaataatgtgacagttcttcatgcattaggtattctttagaaagtctgtttatataaagttctgcagagtaatctctacataaggatattgaaggaaataaatggtggtatcacagagtcaatgaagaagtagcctcaggagtctacccagggggaaggcctctctgaggaggtgacacttgcatcgaaacttgaagaatgagaagccaggcatgtaaccatccaaggaagagagatccagattgagggcgcaactgtgaagtccttaggcaggaatgtacagggcgtgttccagacccagaaagggggctcgtgtgtaagtgaaaatggtagaaggatgaaagcattaggtaacctcacttaggattttgccatgggaagcatggaggagtttgaatagggaggtggcatggtaataggaccaggtgggagaggattgtactagtgtaggtgagaagggtggctggggaatggagagaagtggatatatttgaaatatgttttggggttagaattgattgaacttgctagtgagggagaatggatgaggtttaagaactgcgttttggagcccaatctttggtgaaaaatatttttgggtcatctttgaaaaaaatccttttcaaggcagacagcattttaatgctttgtctgttttttcctgtttgtcagctctgtcaccagcctgaaagatttaaaaattcaaattaatggaggtttatttgttctttactcaggtcacatttctgggttttaatgaagagacagatgctgctcatatacaggtatggtgaattttagcatttttactgagtattcttgtcatggaaatcagctttaggtttgaccacaaaagtcatttatctgagaaggttgcaaaccgcagactgactttttctgcattctgtgtataatacagaatgtatgacttgtttgtttattttgatggctttaataattttgaccttaacagtaaaaattcttatgtttttagttaagattgagttaaatttaaaaggtaagatttgtaaaaattaacaattagccaatgcaaaaatttagcctgtttgatttaggcagttattgacagagggactgatgtttgagattgggatcagcaaaggaaagcttcacagttacataaacagtggttgaagttcctgtasatatgataggcatacttttctttttccctcgtgctgcttcttaaaaatttgtgattcctacatatttccttttgtggcagtaaagtgtctcctcatagaggaggaaataacatttttaggtctttctgaataatgcatatcaggtgattatggacaaaaactgctgtatattttgattgtggccttgcttgaaggaaataatttggacagaaggaacaagagaggatatattcttgagaacatacatagctggaaagagaagtattccaagatatttctttaatgttcttcttctcctttaagagttactgataaaaccatgtttataaaggaaagtactctacaaagggtcaaagactttaataattctttagctgggtaaaatatttgtgtataaagggcaaacaagaagaagaaataaaagcgattttcttttcctttaatcttcattaaaattatcagttaaagtctaatacaataccttggagaggaaagatagaaaaacggattatattgtacagagtttttaaaaaaaagtttttaagatgtacattctctagcaaaaaattttgtatgaaaaaaatttcataaagttaagttaagacctatatgttgacattgctaaaaactattaaatgcttaattgtcatggatgtgttaggtaccctgtacaatttttttatagcttgatatcagtacattttaaaggctacggggatagccagtatttaataattttagtatattttatttttgaatttttgaaaaattatctgtgaataataaactgtatatgttaactattatgaaccaggaaattcactagccagtagaccttaaaatttttggatagggtccacattataggaaccttaacaaaagtgttactctacagtgttacttattgttattattttaaatcaggatttagctgcagtttctttggaacttccagatattctgaattcactccacttctgcagtctaaatgaaaatgaaattatttgtatgaagaatataaataaaccattagatataagcagtgatcctctaaatcaggtaacttttgtagataatttctaatgagatttttagggcaaattttactatatttgataaagatgattaaacttttaaatgcttggatgacatttgttttttttaaatggtatctcaaggaaatatgattcataagaaatataactcatgaagcattgacatccctgaaggatataataattttggtcatatcttataaattatattttttaactgtgaagttccgtagatggtatgcaagtacatgttaattttttctgaaaatttattatttctggatttcttgaactacttttacctttgtataagctacagtgacttttccctattatggccaatttcaaatttatataaatgttacgctatatgttttagagaatgtacttcagttcattttctggtttaaaaaaattccatgtaaagtggacatctgatgtgttctttataaataaaaatgttaccatttcttacaggtggttagttttataatattcagcatttagttctttaccaagtatgattttgttgataatgcatcagagaaaatgctttgcattctaagagataagacatatacaattgaaccagaaaatttaaaatttggattattttagttttaaaaaaactgctatgttgttctttataaggtctgccaataaaactagaactgcttgcttcatttccttaattatgttctttattcgtatttactttgctttatttgctaggatataagaggtgataagctattatatttgatttctagttttttgaataaataatttcatcagtatttacttgaaaaaagtagyatgagggggaaaatctggttacttgtatttttaaagctataaacattgtaagttgtaatgctagggaaatttaagtaaaaggagtagacttttaacaattgtgataggaaggaagatggcatcatacttgaaactacgggaaaatgggattaaaaataaaagaaaatagaacttggttgctgcccccaaacaatttataatagttagtgagataggtgaatgattaaggaaaatcatagggctgtacagtaatacaggaaaacataattgctcaaaggaatggatagtaagtttcataacatttcaggagactgggtagaatttgaatacctggataaaagaagatgggagaaaaaaggactggaaagtgaaaaatgtagagaaagaattaagaagtaaacattacaaaaccaaggagcttttcaggatgcatgaatttcttgtttgtttttttctctgagattgtcttatatctaggctttacttcatgttgttttgtatttgaaattaaaattgtttttattaycttttatctttcccaagagtcatccttctggaatgctttgtgtcatgagagtgtcacctacatcaccragacttaggattgattttatctttagtctcctaagtaaatatgctactggtataaggtayaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggtttgtttttcattagactttttcctaaaatagggaattaaaatttttcagttttgaaaattttaaggcaggcttgttcagttgaaatttatgttgagatttgattcaatttaaaccttttaactttttttctgattacctaaggaaattccttatgatttttaagttcattgtaatctggttttcagttttgcttatttcaggttttcatatttagttggtgctgttcacgcactggttacatcattaagtgtctggaacattcctaggttccaattttggaagagttagctggcagagtctccacggtaatttttctaacatgcgtgacagcatgcaaaacatcccatagaccaggtatccctagacatagagtaaactgaaattattttataaacagtatatttactttcaaatgttacttgggtgaatctttctgttaaacatagtttagaagatacacataaatattatatgtttaaagtcagtttattccatggatttaagttaatttccaaaaagttttgttcaaaaataatttcaccatttcattcttttcctataggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcrtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaamggagtctcttcatgtaccaatgctttgtaccacttagccatcaaattgacatcatctgttttgcagatggcatttgatgagctgagaaggcagcgtgcattttcactaaaagaaygtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccataycatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgracrtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacmccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttmatgttttcaaacaaagagcaccaccaagaagcagacaaaaagagacaaagtaaaagaaatgaaggttacttttgtaaaaatcaaacttgtgaaaggaccctggatccatatagaaatgaggtctcccaactgtatagtttttcaacctctctsgttcacagcataacaaaagatgctaaggaagagttgacagcctctctagttggcctaccaaaatccttaacagattcttgcttgtttgaaaaatctggatatgaagaagataatgagtgtcacgttacaccagaattgcctaagtctcttcagccttcctcacaaaatcacaggttttaccacagcactggcagtttaaatggatatggttgtggagacaatgttgttcaagctgtagaacagtatgccaaaaaagtagtggatgacactctagagctaactctaggatctacagtgttccgagtgtctgagaccacaaaatcagcagacagggtcacttatgcagaaaagttgtcacctcttacaggtcaagcttgcagatactgtgaccttaaagaactccacaattgcactggaaattcatctcagcactttttcagacagggttctctcgccagtagtaagccagcttctaatccaaaatktagcagcygctatcagaaatctaggatttttcatctcagtgtccctcagattcatgttaatcttgataagaaggcrgtgcttgctgagaagatagttgctgaagccattgaaaaagctgagcgagagctgagcagtaccagcctggcagccgacagtgggatcggacaggagggtgccagctttgctgaaagccttgccacagaaaccatgacagcagctgtcacaaatgttgggcatgctgttagcaggtaagtttcacgtttcttttggttgttaatgataaattaaaaagataaatgtgatcctatatgtcttaggtcctgttcataaaggaatgattatttttaaccctacataaacaaaagttttccctgttgcatttatgtattgtttcatatcctacacatgactttaatatattttggtctcctgatcccttttgagggaaggtgttatccatttacagagctggaaaatgagggttggagaaaataatcaccttatccaagttcatagagctatgaaataggtaaagttgaattaaataaatagctagagaattttatatagtagtccccccttattctcaattttgctttcctcaatctgaaaatgttaaatggaaaattccagaaataagygattcgtaagttttaagttgcatgttctgagtagcatgatgaagtctcacaccatctcactcaggatgtgaattacccctttatccagtttatccatactacatgtgctgttcacctgttagtcacttagaaggtatctcagttatcaggtccacaaacctggtatgtacagggcttgatgctatctgcagtttcagacatccactgggtgtcttagatcatatcccccatggataaggggggactattctatagtaaatgtagaatattactatattaatttactattctgagattaaatttttgtacacctttcttcattcacaagggtaagttttcttataaagaccatggttaaactactctgaagaagaaagtgaaaattctttacatacttacaccatttctcttgattggttcacaatctaagaggacagttctttctggtagtcctacagtgtcctgtttttcagtagctatctcttgtgctcagtgattctttttttttttttgagatggagtctcgcactgttgcccaggctggagtgcagtggcacaatctcagctcactgcaacctttgcctcccgggttcaagcgattcctgtgcctcagcctccctagtagctgggattacaggcacccaccaccacgcccagctaatttttgtatttttagtagagacagggtttcaccaagttggccaggctggtcttgaactcctgaccttaggtgatctgcccacctcagcttcccaaagtgctgggatcacaggcgtgagccaccgcaaccagccatgctcagtgattctttaataacaacttagttacagtttttcagtttaaaccttctttgtccctgagaagatatcaggaccaacttgtgttattagttgataggatgatatttgtaagtcctgcttgaaagagaaaatgctttaagttgaggtggaatttaattgagtcacatgatattccagatttttgagtagcttctgttaaagccatgacatggtctgcctcttttcttatccatcttaaaatagggagatatagcttggccaggattcttgaatccaattgctccatagcgtctacttgagatgagagatgatgtaggtttctggtgaactaggagaggtctctatttgccctaatcaggcagccttctttctcctagaccaggggttggcaaactacagtctgtgggccaatgtggcctactggttgtttttgtatggactgcaagctaagaacagatttcatgtttttttttaatggttgaaaaaaatcaaatgatattttgtgatgtggaaattatatgaaattcaaatttcagtatttataaataaagttttattgggacaccaccatgctcattcaattacacatttctgtggctgcctttgtgctataatggcagagttgagtagttgggacagaggctgtatgaccagcagtgcctatgtacttcctgtttggcctgtattagttcattttcacactgctataaagataccacctgagactgagtaatttataaacaaaggaggtttaattgactcacagttctgcatggctgggaaagcctcaggagacttacagtcatggcacaaggcaaaggggaagcaagtgttttcttcacaaggcagcaggagagagagagaagggggagctgccagacacttttaaaaccatcagctctcatgagaactccctcactgtcatgagaacagcatggaggaagccgccctcatgatccaatcacctcccaccaggtccctccctgggggttacaatttgagatgagatttgggtagggacatagagccaaaccatatcatggcctcttacagaaaacaattgcgaacctctgtcctagatccacattttcgttttcactacataccagttcctagtatgataataaacataataaattgttaataaatattctcatgaataggtaataaattaggcctttttacaattgaaataattttcctcatacaggttgcttcaggctattttactttttactcctcctcagttcagtcctgtctgccctacggacccatccatccccctttcctcccaccctcatgggaagaaaagagactgtcctctaaagtttttaagacatcactctcaggggctagcaaatgcctttgttattgattttctcagtaatttccacttttccttcttagagttgggtgagtagatagcccctaaagttcttcctgtaagccagtgctgtccaatttcagctttttattaaggctggagtaattattttcctgcttctcttcttaataattgtgctagggttctgtaaatactgactaaggaaagctgactctagtgtgtagagtttacgtttaacattttttatttctaaagttaaatttgtctttcaaacttgaaaggagattcattcagatggattattctttaaggtattatttcacctgatgtccctttttgtttgattcatgaacatgaccataaatatttcacaaactgtaatgaacagagaggtggcatgtgaatgcaattgggaaattatgtgatagtacatttttattcatttttgtttgttgttgtttgtttgtagagatgagatctcactatgttgctcaggctgatcttgaattcctgagctcaagcaatcctcctgccctagcctcccaaagtgctgagattgcaagcatgagccaccgtgcctggctgatagtgcatttttagccaacaaaacgattatattctaagctatcattccgagccaaaataacctcacagtcattataaactcttctctggacctcatcctttgggtcatttcagccaaaaaccatgagaatgtggcacatattaggaaaagtattcaaaaaaacaaagtagtaatctatcaatggttcagaactataatgtgcctatgcttggaatgctcagtatcattctgtatcttacaaaattagaatagctgaaaaaatggggggcaattcaggggctattctcaggatagcactagggatacggaagtaagtaaaacaggcaaaaatctgcattctcttggagcttatgttatagtggaataagacaataggtaagtaaaatatatagtatgtcacatagtgataagtgctttgggggaaaaataaagcaaggtagggagttagggagttagagagtgctggtggtgacagtggcggtggccattagggctggtttacagttttggataggtagcaggggaaacaatactggcaaagtgatacttgagccaaaaaccaaaagtgaaatgagaataagtcatgtgggagtcaccgagaacagatttccaggcctaggggtgggactgtgcatgtttgggaaacaacagagaggcttgtattgctgaagtgggagttgtgggccagggagaacataggaggagtgggccagggagaacagtaggagttcagatggatgttataagaggggacaggcagtatgttttaaggatttgggctcttcggcttggtgggaagccattggaaggttttgatcmgaagactgacattttttctttttatggaaacatcactttgaactactttgttgaacataaaatgtagtgggacaattaaaatagttgagcagtgaatggactttcttgtgatgatggaataaaagtataaatgcctcttattgagaaaaatgaaaggggttatgatctatgttcaaaatcttgaagagatttggttagtttgaatacaggcttggttgacaatactagaatttcttgaacgacttttttgttcttaaagccagaaagagactcctttaacataaataaaagtactgttttacaaagcagatgataacttaggaacttgtactgccccatggtatctcagttgaaaaatgaactgctttaagtagaatttagagaaataatgccctagggatagatccattgtagattaacaaagtaagttatggctgttggtgggtacctcagttaactttgaaattaatacgctatcctacagtctgtttgttggcagactcaaataaaggattacatgagccactggtctgattccgaataccatttcttgtttttatcatctttgtcatcaaattgatagtcttgtaagttcagaatctgggatgctttcaatttgattttttttctttttttcttctttttagttcaaaagaaatagaagactttcagtcaacygagtctgtcagtagccagcagatgaacctcagtattggtgatgacagcactggtagctggtccaatttaagttttgaagatgaacaccaagatgaaagcagcagttttcatcatctaagtgaaaggtaactacacttttgcrtataattgtgtagtttaggtcctcagatcttagaagtgagctataaatttacattattatttaaaaattctaaatttgaaaatatgctattactttcaaaatgtattttattattcacaatgtatttctaattgtttttaacacttatttaatacagtaagtagcccagctaattttattggggtgtgccaatagttgatttgaaaaatattgcatacatttaattttatgccttttaagcttctcccaaactttttatgaacttctgaggaaaaattttttttttcactttaaaaagggtacttttttttctttaaagaacaagaaaaaggacaggtatctgtaaaaggcatcaaagtagccctgtacttttcctgacattagttaaaatagtatctttttggtggggcgagggtccctgcttgtcctgctgttaggaacaaaatgacctggaagacttatgcttgaatgattgaaaatacgtaagtcaaagccattataaaaatgtgattttgtatagcacaaggcacttacctcatatataacttttcttagttaactttgttcataacagtggtgtttgaaatattttattaattatgagacagttgtttcttatagtcttaacctctacctaaaggcatttctgactaacctataaaattctataaactctttatccacattaagtgataactggaaataatagataccatttgtagcagagtcttgagggaggaaagggttcttagcatattgctggtttcaggcatgtgtggaaaggacctgtggaccatcagttgaacttagcccctggaaatggcaaactaggtgtgggagggaaggcaactcttggaaaagggaatgaggtagcataaggaaaggaaatggcttttcacctgatagaacacttcatctcgaagagttttgttcgatgcttggattaacctggaaatattaatatttttgtaaagtatattttgtcatagtttattatggtgctatataaaccaccaatatttcttaaaatctaggtccaaaaagacartgtttaaaactggtagaagcaagtgggggcaatgtcacaaatcatgatttggcccttttctataactttatctagaaaaggatactaacatttagtttcttctctcattttgagaaacacaggcttctatgatttcagtggggttgacagtgttgcctaggaaatcctggcgttaaaatgggagattgaggtgtgggtagaggctttaagcattaagaggacttgtagtcagttgaacaactctgtgctgaatattatctaatttgatgagaaaaaggagtcgtcttaccggtttctgtccttggttctgtcctccttagcattatttattaatgatgtggaatactcatttgtggatgattcaacacaggctgaaaaaagaatctcattaacagaacaaaggttaaaaagaccaaatcaagctgaggttaaaataattatgtttaacatggataaatgcatttaggctcagaaaattaatgattaatatttgaacttaagtggggagcaaacctggcttgatggcattttgtcagaaaaagacctgtgtttccattgaccaaagttgtaatgtgacttaatgtaatgctgcgtggcattaaggttctggcacagagaaaaagcggggctcatccaggattggtggtgtgctcgttgcatatacagtgtccagggtctcacctccagagatgaagatttatgaagtcagtgaagggtcctgagaatctgcatgcttgataagcatcacagatgatttcagtgcaggtgattcagagacctcacttgaaaatatattgatttacaagatatgttgcatctgttgatgacaattgatatctatactgttcttttctgctacagagatcaaggtaggagataaagacttcggcgatttgggctgggcgcggtgattcacgcctgtaatcccagaactctgggaagccaatgggggtgggggtggatcacttgaggtcaggagttcaagaccagcctgggcaacatggtgaaaccccgtctctaccaaaaatacaaaaattagccaggcgtggtggcaggcacctgtaatcccagctacttgggaggctaaggcaggagaattgcttgaacctgggaggcagagattgcagtgagctgagattgtgccactgtactccatcctgggcgacagagacagactccgtcaaaaaaaaaaaaaaagactgtgacaatttgaaaacaccttgccagtttcattataagcaggaagttcagtggagggcaacaactaaaaaacacactaatttcagattttcaaaagtgtttaggaggattatataattatttgatcagaaaagaactggtcbctgtgactgtcttaaatatttaggtagtttgttattctcttaggaattatgaattagattaggttaagggatggggccagatttgcagaatgtttcagataatttttataagatgtatcacaatcaagaccagtcttgatatggctaaaagctgcaataaagcattgcagtactggaccactgtagtacttataccactggttggagtactcctgtgctagacataggaaatatgaaaagacataaaagaaagtgatggaagcagggtagtgtttcaagagtgaagtaggaaaactcttaagtgaagaaattaagttttttaaatgttgggttaatacagggtgatcatacttcccacttaggatagtttggcttatttctgctgttctgttgtaattattaacggtgaggtctttaaaaaagtgtcctggttagatgaaaaatgtatacagtcacctagttagaagtggcattttatgaagaatgacttcaaatacccatttggaggcacaaagagggaggggtgataaggttagagggaatttgaatttttagtctttacttcgtttagctgtttttttttaatgtttatgtaataggtaggtgatggattttattaagtggaagaatctgtgtgatgggtagaaaaattttatatttttttgttataatcattctattaatagaagtaaatagagtgtttgagatgattaattttctttttctcctttgctcacagctgtctgtccattctttgtttgtatattttcttatttttagtttatctgacaatgaactacatgggttttaacagttttataatagagctatatttgtttgaacatatgttaaaaagaccctgctcagttttaacttttactctctaatacatcatgatttgtgacagtttgatcatgttagagtgaatataactatgcaaattatttgagattgcttggaagttttttagaacttgaagtaatcacctttttttgttaaccataccaacatttactgatgtacataaaatgattttatgtttacttttttagaaccaaaattttggtttgtataaatattactttttataattgcctagcataatattgggaaaaatcgctgcttatcactgcaaactaatgtgcttactaatgtttaataattagaaatgattagaatttttaaattgcatgctgagggttttaatctgaaaatttgaatttaattttatttctgaacatggttgctttttttaaaaattgctttgctgcagttttagaaagtagttgctttcttcttcagttgattaggtagtgtaagacattatctgtatgtggcatttgtgactggccaactagacaagtgtaatgcttgattaagccttggctattctagctgtattctgaagaaaatgtttgttatttgccatctactgaattatacataatatatgaaatgaagataattgacataatagtattttaaaatctgagaacatgttttgcccaaatagttagaaaaggtctgtttgggactatgtctttatagagtcttccatcccatctccccccaacatcccctcacccatacctgtcactgttttgcactatctaaagacctgagagaatgttaacctgttttttttaactttatccaaatagaaaggtattggcatttcacaaattatagttcaagattggtcctaagacattaattttcctgtgaaacttattacttcatgcattcatttgctgtcctaaaagtcattctgttaatctgtaaaatataagtttagataattttcatgatctgttgagaagaaagaaaaaactcccgaatctctgaacttgtcaggcaccttttagcataggagtgatggtcaatctcctctctggatgttccccttcactgtggcagcttcagaacatctgcagttatcaaggacagaagctgttccgaggaaacaaaggtcttttctactattcattttctagttcagctctgttcttttcttcctctggcagtaatggtaacagcagtagctggagcagtcttggtttagaaggagatttgtatgaggacaatttatcctttccracatcagacaggttggtccagtctagaaacttaaaaactgatgagtctgtcaccactaatgcatgatgtcatattcttcaaagaatgtgggttacagtgccagtatgtatcaacctgcttttctcctatattttgacatgattctgcttgatgaattcacatctaatgaaaaacttcaactgtgctaagatatgactgacatctaattgcaaaatgtgtcactgttatgcatgtgttgctctgcttgctatttttcattctaccaattatttcattcaaaagagcttgcttcctacaggatttctgttgggtttttttgttatgttttatttttgtgtgtgattttattttatatataagaaaagtataggtaaaaagtgtttttactgtattaaaaatatatataaattgcatcagctaaaccattaacaaatattcctggcattttgtaatattcaaatgctacattaaattagtagactatttcaactttaaatgattttaaattgaatattatgaaattacatggcactatgtatcatggtaaggtaggatttcttggttttgataactttagggatcatttgcaattcagattttaacatgaaatgatgtgagaagcaaagcttccttttttaattgtcatttctcccctttctaaatgtcatatgtcatattgtaacattcattcattaccacatttttaagaatttgttttgataccattattaattaaattttttttgtaactgcttctgctattttattcataagtgatggaccagatgataaagatgaagagcatgaggacgaagtagaaggtaatttgatttgtttttcaaagtgttggcatgtgttttgtataaggtttcctagaagagtctttatgcattttcatcagataggctctaggttatcagtgtaaaacattataaatcagggtattcttgaactaattttgtttgtccacttttggatcctttgttgagtagttttatttgattgctacactaatgaaattgtcattggtataaagaaatactgggcaggcacggtggcttacgcctataatcccagcattttgggtggctgaggtgggtggatcgcatgaggccaggaatttgagaccagcctggccaacatggtgaaaccccatctctactgaaaatgcaaaaattagctgggcgtggtggcgggcacctgtaatcccagctatttgagaggctgaggcgcaggattcacttgaacctgggaggcagaggttgcagtgagccgagatcatgccactgcactccagcctgggtaacagagccagagactctgacttaaaaaaaaaaaaaaaaaaggaatactttatgagaattatttgactatttgagagagattaattacagtctctctacataattattttcaaaatacaaaagctaaaattcttactcatgttataagataatttattataactatggcatattattttcataatattttccttccaaactggtaacttgtagaaccagggtttcatgtcaaacttacgtgagtcagtaagtaatatttttacttaccttgttttctaaaagatatttctaaattaattattcttccctcccccagttccagtgcttcactcacgcatacacatatttgaagaaaatactcagatccttccttaatgaacatagttccaagtatgtcaatactagatatcactggccacagagttttggaccatagtttgtaatccttaattcatgttagagtatctgagtttattcatctgagtgaatttagaaactttactttgaagctgagttttcattatattcaggcggttgttgaatttttttctgaaagtctaatttttttcttaattttgaaaataccaataatgtcttctataaagtgcacttataaaagtatttgtactctttgagatatttgtttttgaactagtgatgttttaaaaattgcttctctagaagcaggcaaacagaaaatagctaaaaagaatttctcgaaatttactttatgacacctgaattttcagttagtttmacaccttgtttagggaagtcacatcccagtttttaagctgtaatcttcagacttaagattattattttttagttttaatgcctctgtaagtagacattctttatataaggcttctagaagtcagtttttctcatcagatataaagtcgagatggggcaatatttttagtgttattgatatttgatattgatattccccactgcaatatttgtttcattcttgttcactaaaaaagtgttgactttgtttataaaagttatgccttttctcaagtaacatctgtgaacagttattctaaaggctatacatcgtataaatgcatgtggttacgtattctctaatgaactagcgattgtttagctttactgaggaatgattaagaaaaaagaagatacaagttaatgtaaatatgaaatttatcttgaaaaagattacttttggcactaaccaggctgttaaggatttcttttgtagttggtagaaatcaggagattaattatatgttgatatgtcattactgagtttttgagattataggtatttctcattatatagaaagttacagccagctttaaatttgttagagattggtaaattaggagctagattggtctggatttatagaaagattcaaaattatggaaatcccaaggcaacaaacttatttttttaaaaaaataattttgtagttgcaggatgtcagtccctccccttttcactaatggttagagacttctctaaagagagagccgtttggaggttcttgtaggccaggcaaccaggagtcctgaactgagaaaacaccagcagtgcaaagaagcagtgggatgattagcttctagccccctgaactcctcaggattgcagaaaggcccagagaccatgccttgtaccatggtatgccaaacctatttttgattgagagtgttggagagaggggagggaaragacaatacatttatttttagagagtaatgtggaccaaatctttttaattaaaaattagggaccaacacaactcctaaaaataattaatagtggtctagaatggcctgcaagctgtagcagagaatcagagacatctgtcaacaaccttccattactggtacatgttggcatgatgtctgccagcatgccctggtgctcacctcttgtggtgtgtgttaaggggtggaggggtcctggtctcagcactccttattgctcaggtatcattaagcagcaggaatgttaaacgcatgatattggcccataagtcattatttctgtcaacagagatggatccctctttgtgatgaaaacataattatcataaaaaaagaaaataaatttgagataatcttgagactagaagtataccagaaaattccctgatctggcttttgggtgtaagtggttgcatatggcatttccccccacttttgtctgaagaatgagagattaagagcatggagccagactgcctgtgtaaatgtcctggctcagccacttccccactggaagactctggggctctctttgcctcagatctctcacctgtagaatggagacaataatagtttctacctcatagagtggttgtgaggattaaaggagtttgtacatataaagagcttagaacaatacttaggatggaatatgtgctgcacagatgttgctgctcttctttatttgagatttctgtttttttgtggggttttgtttgttttttgggacaaagtcttgctctgttgcccaggctgggtggtgcaatctcggatcactgcaacctctgcctcctgggttccagcgattcttgtgccacagcctcctgagtagctgggactacaggcatgtgccaccacgcctggccggattttgtatttttaatagcgctggggtttcaccatgttgggcaggctggtctcgaactcttggcctcaagcgatctgcccacgtcggcctcccagagtgctgggattacaggcctgagccaccatgcccagcctcatttttatttttattgtaatgatagctttatagttttattttctctctaacccactggtcataatttatatcaaattatggcatttatagaacttgaattcagtatgttaaaatgatgttttatatttttgcaatcaataaatgatcaaagttattcctttgttttacattattttgccctttagaagttttagttgaggttatggtgtggttagaaaaagatggatatttttttcaccattcattagaatcctaagaaccagaaaatatttgtatctacttgacaaccagagtattgagagttaaattgatgagttttactttatattgtttacatttaaatattaggtttggggcaagatggaaagacactgctaattacgaatattgacatggagccatgcacggtagacccccagctaaggattattcttcagtggctcattgcctctgaggctgaagttgcagaactttattttcatgactctgcaaataaggagtttatgctagtaagtacctaccttacagagtgtgaggatacatttaacagtatatgatgttcttgtcatgtgattggtctaacaagatgcctggtgatggttaaattcttaggctgtagtgtccwacagtttgggttcagacatcagctctgccactttctagcagtataaccagaggcaggttcaccagtctgtctcattgcccctaactgcactatgcaaatgaatatagaatctaccttacaggggtttatgaggattaaatataatgttaaaaaaaatgcttggtctaatgcctggcataacactaagctctcaaaggtagatgctattaataagcattgtgtgtgttcctatgaaaaaattgaattattctctgtatttaattgatttgtaattrtacctaatgattaatatatctgtttctctgataatccagtttcatttgtatgagcagctgtcataattaaaagccgataaaagtttaaacaagatgcttactatgtgccaagtaccttattagtcaagattttcagtttacagtcttaaggtttttgttccataattttctttatcagaactttccttttggggtggtagaaatattcgaattgtggtgttggttgcattcaacttggagaacatactaaaaaccattgactaggacactttgggtgaattgtatgttatgtgagttttatctcaataaagctgtttttaaaaaggttaagcatatatatgttacacaaaattaaagtagtttttcagaatttaacttacagatctttcaaaacttaagagcttttacagaacttagtagaaaaagaaatgaacaaaagcatgtcgtgagtggtgacaacaggatttatttaaacctgtatttatttatttatttatttgttgttttgttgttgaaacattaacattctttaacttagaaagccatgtttccattgaggctagagtgtgtattccagaaaaatgccacactatatgttgtggaaggaaaatccacatccttttattgagtttgacgttgtctttattattttatgtcctaattgagggtgtggcagttgtatttagttaggtgaagaatttcctgtagaaactcagcctctgcatgtccatgcagactatttgcttggtgaggtttgtggagctctgtctccagcgatcccaaagtgtcattctctggaggagatgtgtttataaaggggaagaagggaaaatgtttaatttgggtaaaggggtagcggtttagaggggaagaccttgttataactaggaaacggtatttaattgtaaacagcaggattcttaagtttcagctaatattgaaaataaaaataaaagctttgttataaaattgtttttggttaatgtttgacacatctttctttcttagctttcaaaacaattacaagagaaaggatggaaagtgggagacctcctgcaggctgtgcttcaatactatgaagtgatggaaaaagcttccagtgaggagagatgcaagtcgctgtttgattggctcttggaaaatgcatagagcaaaccccaaaccagtatattttagtatttgtttggggaggggaacaagccaataaagatgtttaggataaaatttgaatagtgaatattaacatcgtaagtcagttgggaggcaagtaaatatagctttctgagcgctttgtgttatcactcggtgtatatagttcatacttttgtaatctgtcaaaatactaccttcatttattcttctatacacatgtgtagtgtgtcaagaccctaagaacatgtatttgaaggaaggtctaaccagggggttttcaggggcattgtctgaccacattctttttgtatccaaatagtgctgctagaaactgcactgaagtggctgaggataggttccagtgatagagttataattttgctcctttgcaaacaaatggtatctaattaataactagtctgacatcagaaaataaaattgaggctgatttttaaaaatttctagtagatttttggcctttctttcctgcttttaaaaatcagtttcattttcatatttcatagatcagctattggtagctttttgatttccccaaactatttaatttcttagcagaaacattagtattttaggtttctataaacactataagtgatagtttcccccatcctttcattgacattatttgccaatgctgccagtcattctggcatgaaaggggtgtgtgtgtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatrtggtgttttttttgtttgtttgtttgtttgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagtttcctaaagtttcttcaagtattttttaaggtggagaaatgcaggaattgtataaccagaattgttyctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgtgaaactttgtgtttgaaaatgtttatttctgtttatggtgtaatcattctgaggtgaggcttttcttatttcctttgcattttgctagagctgtgctgagttcagcatttgcttatttaaccactacataatgacagaccagttattaggtattagcatgtgtggtaataataatagtggaacttcacacttacatcaattcagtgcaggggcatagaataaaatattaaatattggcagatgtatgaaaagaagtgtgagttaaaaatattgaatattggcaggtgtgaaaacaagtgtcaaaattcctcatatagagaaaataattttgagtttagagtattatcttttaattaagtgtagtctaaacttaactttctgtaaaggcactttgtggtttttccaaagatgttctagatctatttggttgctctatagtcaaacagctcttttgaagacaactgtcttattttattacaaattggcttgacatatttatactgtaacattgtaatattgctgtgctgtacattttggcccttacgaaatacgtctttttcagaactgttaaagttttgatgtacatcgagctgaattctgtttttaccagtttcaaaaccttcaagtgatatgtggaaaaaagtgaatgagacctctgatagggggttttcagaaccttgttcacaccaaaatgtgacagttctttcatgttttcctaaaccaagttaaaattacatgtatattttggtgttaaggttgatttttaagatacttctgatttgtacaaaaggaatgtttcctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaaaatttcagaaattacttttgtaattatttgcaattaattgttcttttatcttacaattgtttaagcctgtgatctttcttctcccagctaagagttcttcaataaatttaagaaatacctggtcttggttttcattctataatatctcattaactgctctgtactgagtgggactgctatgacagaagaccacataagaggactgaagtgctagatcatggttttgagaacaagagaagttagaaatatttccaattggacactagattctacctacttatagataccccaaatgcagacatagtgacttaaaaggctggttgcccaacctgtttttgcaaagtagaatattatggttgccttgaatatgaacatggctatgaaattcttctggcctggtttgaacactctttccataataagaccatacctctgttaaaccatgtacacaagataacttaaaagctgctgggtttttttttttttaattactaatggatctgactttgtcttaagaatttttttccttttaaatagaccatttttagagcacttttatttagatgcacagcaaaattgagcagaaaatacagagctcccgtataccctctttgcccagcctccttcggtgtcaacaccccacaacagagtgggacatttgttacaatctgtggtcctgcgttgacacacacaccattatcatccacagtccatagttgacattagagttcactcttgtgcatttgtaggtttggacaaatacataattatatgtacataactgtaatatcatacaaatagttttactgtgccctatcttaatgtaatttaagcccagaaattaggaaattgttttaaaatttttttcatgttttaaaatgctaggaaataatagcaaacaatgagaaggtttggttgtaagtgcaccccagttactaagcaaaccaaaagtgctgagaagaagtaagcaagattccatagattataatgccaaaaaggaagtatggctcaaaaagaatgggaaatgtggcaaaggacatttgacagttttacacagagggatcatatgtgatttgtatcttagctaggacagagaggaaggtgagggacagggcttgaattacctcagattttttaaagtgtgagatggagaggtcatttatctaaggatgaatgtactgttgttcctataatacaaagagtaaaaatcagtgtttttgcgtcattgagtttacagcaagaacaataaagagtatattttgcacttttttctctatcctttgtaattttatagtcacctctcattttaacttttggtcaaggagggtaatactttagactggagagagtgaaaaacagtttcaagagggggttgaagccccaattttgagtttaactcatccctctgcacccctacccccttttaaacagacacctaaatgaatttgttaaagcacgggattaaaaccagacttctgtgtactgaattctgcccgtctgtatgttttggtctggtgtagaatcttttaaaaatagttaccaaacttaaaaataaagatttcacatttaaataagttttgtattttcatcttcttgaaacaattgaaagctctgaagcagtgactgggctcttatatggcaacaatttagcaggagctgaatagtgattgcccctttaatcccagagtaagttctctttttgcctctggcatgacttactccaattccctcatttctgttgcctgctggggccttgtagacagttgagatgcacccactgacttaaagcagataagataatgtgcttagaaaatctgaacaacattctagtgactctttcattctctagggttgctcaaagaggggaggaacattctagaaattataaacgctgagtttattgctcctgagtagaaaacaaatagtaattgttaaaagcatagttttatttttttttaagtatgtggagaagggagagccagcataggtttaccaagagcagagtctatcagatttacactttattttcagtagagttattttgacatattagaggatgagagatacagtatctagattttattgaggcatttttatatggagagaaggaatgaataactggcttcctaacgttttgagaaatgtgttcccaaaggcttgtggttaatagatcattgtctacctggaggtcagtgctatgtgtctatattagttcttgcattgctataaatacctgagactgagtataagaaaagaagtttaattggctcacagttctgcaggctctgcagaagcatggtagcatctgcttctggggaggtctcaggaagcttccagtcatggtagaaggcaaagggggagcaggcacatcacatggtgggagcaggagcaagagagaaggatgggggaggtgctacacacttttaaatgatcagatcttgtgagaactcactattgtgaggacaataccaagaggatgatactaaaccattcatgagaaactgtccctataatccaatcaactcctaccaggccctaccttcaacactgaggattacaattcagcatgagatctgggtgaggacacatcctgatcatatcagtgtcataggccatttcatgtatggcctttttatccagccgtggagtgaagattttgttggagtaagctcctcaaggatgtcaaaaagcattagagttattacatagtaactatactgagggataatattcaaacagttgaaatgaactgggagagcggataagagacttttgagtctatttcttccctttgtcctttgaccagccacagatttgacattctcctccaaaggtggggaggttctgtgtttacatactgccattttataactaggacttgaatattttccttcaaatactatatttttatggctttcttgatataaacttagttatttccctgttacttagtaaattatatgaacccgggacttctaaatatatgggaactgatgctaaggaatcctataagagcttaaatcctataagagcttaaaatgctgtggacttttgaggagtcacaaggctatcagaaaaaaaaaaggccaccagaaccactaataatctacaattaacctcttaacctcttttctgtttataacgggatgtgggtggctgtggcaggtgaatgtggattccaggagatcgtgatgttacaatagcgtttccaacctataaatcttctttgagtcaactttagatggcttgtgacaaacgctgggaggttaagctgcttaatctgaaacccagtggacttcactgtccttgaaccctgagaagccatggcttccagaaggagggggcccttggttgagtgacaaagtctgcagtgatacagagctggtgagacagtatgtgggaagacagatccaattaggccttcatagacccaaatggctaagtgctctaataaggtggggtaaatactaggtcttgcataagtacagagtggtaggagatgaaaatagtccgtgcctttatggagcttcttgtttagtgaagcagagagtcattaaatgagtgactgtatacagtgaagtcctcgcttacgtcattgagaggatcttagaaactgcaactttaagcaaaatgccatataatgaaatcattattttctcatcaaccttataatgaagtgaggtaaatatttaattactgttgttcaaaggtgtcggaagctaaagacgggaatctagtcaaagcttccctaaagccgttctgaggcttaagctaggtttgaactgagtaggaaccagacaaggggagttggagggtggaggtgagaagggcaggtggggagaagaggtttccactagagaaaaaccatgcacaaatgcccgggagtataggacttctttggaaaaccaaagaccagtttggctggagcatgaagagaagtgacacatcctgagaaacacacatctagctggctgtcagccaggtggtccaagaaagtgtttgtagtttgttacaccacaagtcaccggttttaagtccaaggcatggcggatgatcgtcttcacttgacactgtgctttccagaccatgcctagagtattgtgtttagttcccgataccattttacaaaggacagagatacatggaaccatccacatccatgactgtctaatgaggccaaggagctaaaaatgtattaaatgagttcagtgaaagacaaaaaggctgtttggcctaaagaaggagagatgtaggagtaacctcaaaactgcctttaaatatatgaagtgcttttagtggagacagattaaaacctgtgaccctagtggaggggatgaggtcccatgaggagaaattagcagtggatttcagcttgtgctctaaaaattggagctttgcaatatgggcgagacccccttaatgaaaaggagcatttctggcccttggagaggtttccacagtgctggctgatcactcctgcaagttttgataagaaatccaaacagcttataactttggattaggtgacctttgtgttccaacacgtcctttcccacacactacttaattttttccacagtcgtttagtgaagttgttaagaacctgggctctggggtcaaaagaacttgatttaaaatcccagagcaaaggcccaggatgatggtatcttgggggattttcattttcttctggcaggtgcctgggggcacagctagtcttggagcaccttgatttaaattcaagctttgagggttttggatccctctggtggcttgatgtgctgcatgtccaggtcagggcctgtgtctggaaggtgtagccctttggggttacaagtagagaggggatggtttatgcgaatctctttgttggagggggtggggagaactgacttttgcctttctggccttgtgagtctgccaaaatactatcctgtatcacagtcttttttccttcaggtttgacaaatattcttaggatgaaagagtggctttgaatgctcagtggtttacttcttggggttctttgcttttgctagatatttgacccattgcatcctcaatatcttactagctgtttaaatgctttcaagaaggtgtttcttttttttctgagacggagtttcactcttgtcgcccaggctggagtgcagtggtgcgatctacattcactgcagcctctgcgtcccaggttcaagcaattctcctgcctcagcccctggagtagttgggattacaggtgcccgccaccacgcctggctaattttttgtatgtttagtagagacggggtttcaccatcttggccattctggtctcaaactcctgacctcaggtgatccacgcgccttggcctcccaaagtgctgggattacaggtgtgagccactgggcctccagatgtttcatattttatccaacttaattacttctaatattttaatttacatgaaggacttttattattattattttttttgcttagctccatgtgattaactgttaatatccttttaattttcttttacattttaatttatcttcttgaaagggttatatatgcatatggtattaaattccaaaaggtataagaatgtatagtgacaagtatccctctcaccactctctagccaccaagtacccccaccacccccagagataaccactgttaccagtttctgttccatcagcactgtgctatacaggacctttcaaaacttagattggcttttgtaacttgtagttggatacaaatctgaaagtttcaaaaaacaggaaatgaccaaatcatttagtaaggatagtggttacttctaggggagaaggaggtacaggagcctcccatggtgccaacaatattctgttttcttgactttggattgtggttaaactgcccagatagattctaagcaattctgtgtatatatttcacatcatgcatgtgtatgcacatgcacacacatctaaaaaaaatctgcaaaactgatcatcttgaagacaaccagagagaacaaatgggttacctgaaaaacaaaattgattcacagtagtgtgctcaaagatgatgatagaagccaaaaggaaataatgtcttcaaagtgctgattttaaaaaagtcagtctagaatttcata

SEQ ID NO: 10726 - DNA, 14363 bp, Homo sapiens
  misc_feature (1)...(14363): n = A,T,C or G, or insertion/deletion polymorphism (see Tables 1-2)
ccgcgcagcccggggtcagtcctgcagcccgcgccgcggccgcctccgtatcccgcctcttccgtgacgtcgccgcggcgagggccgcccccggcagggaatggcgttgagctccctctgtccgcagtctcggaaagacgggaggagctgtgaggaataaaaaagcaatatttggcagcgtcgacgtagggcgttttgtgtgatgacgacaggcgcttaagggaaataaaaaacgaaggtgagaagatgtgtcatctctgttctcggcagccgagagactcacgctcccccggcctatcgtagtcactcccgtggcttcggttgccaaacacacgctgagtctccagcccagacttgtccctgagcttcacccctgtgcagccaagtatacagcaagcatcctgcacactccacagacgctgcaaatgcaacgcgtccaacacgggtcccaccaccatccccctaagaactacacctcctcctgtgttccctgtctctgtgaataaatggcaccctcacccttcagctacccaagcgcatgtgcgtcatgcctcacaccaagcaggtgctcagctccataatgtatgtttattaaatgactccacggccactcccacaatgaacatgaaagatcttgccatttcatacactgataacttccaaatcacaacttcaatccactttctcctggactccagaatcctacatatacgattgcctattcggtatttccacttggatgtcacctaggcatagcaaacctaccatgtccaacactaagctccaacacgccctccccacgaaaattctcccttcatagtctttgctggctcaaatgacacttcattcttccaggtcctcagaccaaaaacctcgtcatccagacccttctgggttgttttttcgttttggtttggttttctttcttttttttttttttttttttctgagacagagtttctctcttgttacccaggctggagtgcaatggcgcgatcttggctcaccgcaacctccacctcccgggttcaagcaattctcctgcctcagcctcccaagtagctgggattacaggcatgcaccaccacaccaggctactttttgtatttttagtagagacaggctgtctacgtgttggtcaggctggtcttgaattcccgacctcaggttatccgcccgcctcggcctcccaaagtgcagggattacaggtgtgaggcactgcgcccagccccagcccttctgtttctctttcatcatatcagcatccaatctgtgaaaatctgagcagtgcccactttctccactcctagtacctttgactatgaagggagactatatcctagattactgcactagcctcctcattgtttctctgtccatcctttccctccctataatgtattttattttatttttgtgccccctctcccaccctcctataatgtattttattttttttatttatttacttattttgagacggagtttcactattgtcactgaggctggagtgcagtggcgcaatctcgcctcactgcaacctccacctcccaggttcaagtgattcttctgcctcagcctcctgagtagctgggattacaggcgtaatcccaccaccactcccggctaatttttgtatttttagtagagacggggttttgctacgttggccaggctggtcttgaacttctgacctcaggtgatccacccacctccgcctcccaaagtgctgggattataggtgtgagccaccgcgcctggccaacgattgttttttattacgagagaatgttggatttttaaactgcttttctgagtttattgagataattttccatttttcctttattaatatggtatattgcattaattttcatatgttgaaccaatgttgtattcctttttttttttttttttgagaacaactcttgctctgttgcccaggctggagtgcagtggcacgatctaggctcactgaaacttctgcctcccgagttcaagtgattctcctgcctcagcctcccgagtagctgggactacaggcacaccaccatgccaggctaatttttgtatttttagtagagactggccaacatggtgaaaccccgtctctactaaaagtacaaaaattagccaggtacggtggcatgtgcctgtaatcccaacactttggaaggagaatcactggaacccgggaggcagagcctgcagtgagccgaaattgtgccactgcactccagcttggacaacagcacaagactctgtctcaaaaaaacaaaaaacaaaaaagaaaaaaacaacaaacaaaaaaaaaatcaacaaactaggaatagaagggaacttcccctgcctaggcatctgtgaaaaacccagggctaacagcactctcaatgatgaaagacttttccctaagctttctcctaagcttttcccctaaaatgagaaacaagacaaagatgtctgcttttgccaatctattcaacattgtgctgaagtaactagccagagcaactgggcaagataatgaaataaaaagcatccagattggaaaggaagagataaaattatctctatttgcagatgatatgatggtttatatagaaaaaccctaaagaatatagacacaaacttttagaactaataaatggccaggcacggtggctcacgcctgtaatccgaacactgggaggctgaggcaggcagatcacgaggtcaggagttcaagaccagcctgaccaacatggtgaaactccatctctactaaaaatacaaaaattagctgggcatggtggcactcacaggagaactgcttgagcccgggaggtggagactgcagtgagccgagattgcgccactgtactccagcctgggcaacagagtaagactgtctcaaaaacaaaacaaacaaacaaacaaaaagaactaataaatggttcaatgaagttgcagaatacaagatcaaaaccaaaatcagttgtatttctatgtactagcaatgaacaatccaaaaatgaaattaagaagacaatgtcacttataacagcatcaaaaagaataaaatacttgggaacaaatttaaccaaagaagtgcaagacctatatattgaaaactattataaacactgttaaaagaaattaaagggccgggcgcagtggctcacgcctgtaatcccagcactttgggaggccgaggcggacagatcacgaggtcaggagtttgagaccagcctggccaatatggtgaaaccccgtctctactaaaattacaaaaattagcctggcgtggtggcaggcgcctgtagtcgcagctacttcagaggctgaggcaaaagaactgcttgaacctgggaggtggaagttgcagtgagccaagatcacgccactgttctccagcctgggtgacagagcaagatctgtcaagaaagaaaagaaaagaaagaaagaaggaaggaaggaaggaaagaaaagaaaaggaaaagagaaaagaaaagaagtactacaaagctacagtaatagagacaatatgatactggcataggatagacatatagatcaatgaaacaaaactgagaatccagaagtaagtccatacatgtatggtcaatgatttttaacaagggtgccaagatcattcaatggggagacagtctttttttttttttttttttttttgagacggagtcttgctctgttgcccaggcttgggagtgcagcggcccgatctcggctcactgcaagctccgcctcctggtctcagaccattctcctgcctcagcctcccgagtagctgggactataggcgcccaccactacacccggctaattttttttttgtatttttagtagaggggtttcaccgtgttagccaggatggtctcagtctcctgacctcgtgatccgcctgcctcagcctcccaaagtgctgggattacaggcgtgagccactgcacccggcaggtcttttcaacaaatggtgctggaacaactaactgactatccatatgcaaaagcatggatttggacttctacttcacatcacatacaaaaattaactcaaaatggaccacagacctaaaaatgtaagagctggcactataaactttcatgcttcaaagaacaccaatgaaggacatgaaaagacaatccaatgggagaaaatattttcaaatcatgtatctgatgtttctagtacctagaatattaaaaaggacccttacaactcaacaataaaaagacaaatagagccaggcacagtggctcatgcctgtaatcctagcactttcggaggccgaggcgggaggatcacctgaggttaggagttcgagaccggcctggccaacatggcgaaaccccatctctttaataaaaatacaaaaattagccgggcatggtggcgcatgcctgtaatcccagctacttgggaggctggggcaagagaattgctggaacccgggaggcggaagctgcagtgagccgagatcacaccagtataaaaagacaaatagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaagacaaatagagctgggttcagtggcacacacctgtagtcccagctacttgagaagctgaggcgggaggatcactggagcccaggagttcgaggctgatatagtgcaccatgatcccatctgcactccagcctgggaaacaccgcaagacaaacccaccccacacacacaccccaccctcgtctcaaaaaaaaaaaattaaaccccaaaaatatattaaacaaaagacatatcccaattttagaatgtgcaaagaacttgaaaaaacattgcatcaaaaaagacatacaaatggccaattatctcatggaaatatgctcagcatcactaatcattagaaaaataccaatgaaaaccacagggtaccacttcacacccactggaatggctataactaaaaaaatgcacaataacaagtgttggtgaggatgtggagaaattggaaccctcacacatggcttgtagggatgtaaaatggtgcagtttctgtggaaaacagtttgtcggttgctcaaaatgttaaacatacagttatcatagaacccataaattcctctgccagcatatactcctaagtatataactaaaagaaatgaaaacatggtgtggtcactttagcccaaagactctcaggtttattttgtgggccctttggactgtaactccataagatcggtacggcgcaagccactaggactgttttttgttttgttttgtttttgcttttgttttgagacagtcttgctctgtcgctcaggctggagtgcagtggcgtgatctcggctcactgtaacctccgcctcccaggctcaagcgattctcctgcctcagcctccccagtagccgggattacaggcgcgccccaccacgcccggctaatttttgtattttttagtagagaaggagtttcaccatgttggccaggctggtcttgaactcctaacctcatgatccgcccgcctcagcctcccaaagtgccgaacggtttttgggttttttttggttttttggggggggggttttgctgactttcttgttttgtttgttgcttgccacgctgccatcaagtgctcactgtcgcaaaagaaccgtccccatgcagtactgtacttttcttttcccttctgccgtcaacctcggagtagcttcgctcccagaaggcctcaaagcgcgaccaaagagcgtgacagagcgctttacgacagttgctttgaggcagtaccggaggagaaagatggcggctaccttactagctgctcggggagccgggccagcaccggcttgggggccggaggcrttcactccagactgggaaagccgagaagtttccactggggtgaggaaggaatcggggttcataggacgtgcacaaggcctgacgcgatgggaagataaagcctgagtggggttgagagatctggcaggggtggagaggaggtggaatgtgttgtgctccaggaatggggagaggtaccccgaagatggtggagtggtgcggtagcttcgtagtgggaggtggagggtgggctgaagtttgaaattctgaaatcctgcgaggctagtgaggatcttgggcttaagtacgggatkagtcttttgagatttgagggttggcattctggtattctgcggggtgctgaggcccctataagatttgaaaatggttcagcgacggacagattttgtattttnggaactaggtagagagatcattgaggtttgtgtctgctggagaatgtagacttactcctttttcccttttcccagaccactatcatggccgtgcagtttgacgggggcgtggttctgggggcggactccagaacaaccacygggtgagctcaggacagatttgtgaaaggtcttcccatcttccttttcctttcctgcctgccagcccaccctgcctgcctccacagaccactgtgggaagagaggtttcttctctctctggagatayagatttgtcccaacttttgttactttcagttcccctcactcgttagtggaatccttacaaaagtctgttctccagcccgcttcagtttggatgagaataagcaatactggaggccaggcacggtggctcacgcctgtaatcccagtactttgggaggccgaggcgggtggatcacctgaggtcaggagttcgagaccagcctggccaacatggcgaaaccccgtctctacyaaaaaatacaaaaattagccgtgcgtggcggtgcgtgcctgcagtcccagctacttgggaggctagggctagagaatcgcttggacccaggaggtggatgttgcagtgagcagagatcgcgtcactgtactccagcctgggcaacagagcgagactccatctcaaagaaaaaggaaaaaaaggcaatactggacatcctatccctgagycctaagagagtgggtagtgatgggatggaggtggaagacaggtgggctcctttcctcactattctgccatcctgcaggtcctacatcgccaatcgagtgactgacaagctgacacctattcacgaccgcattttctgctgtcgctcaggctcagctgctgatacccaggcagtagctgatgctgtcacctaccagctcggtttccacaggtgcttgtgggcaggggaggggcaagtatctgaagggagytggaagctgaggagctaaatagcctgacttctaggtcttgaaactttmtctgtgacttccctgaccctctagcattgaactgaatgagsctccactggtccacacagcagccagcctctttaaggagatgtgttaccgataccgggaagacctgatggcgggaatcatcatcgcaggctgggaccctcaagaaggagggcaggtcagatccccacccgaccagagcacacttgagccaggacttttatcctctcccmagccattttctttttctttccagtctctacctcacttattcttactattaacgtgcctcagaccaatagcagaatggacaggtgaatgtacgtgtgttggagggaggatacgactggtgactcctctccttctatctggcaggtgtactcagtgcctatggggggtatgatggtaaggcagtcctttgccattggaggctccgggagctcctacatctatggctatgttgatgctacctancgggaaggcatgaccaaggaagagtgtctgcaattcactgccaatggtgagagcttaggcttctgggcctatgagcttcaaccccaactacccaagccaggccagcattcctcattccttgcagtgatcccggcatctgaatctgaacccagctttcttcttttatccacagctctcgctttggccatggagcgggatggctccagtggaggagtgatccgcctggcagccattgcagagtcaggggtagagcggcaagtacttttgggagaccagatacccaaattcgccgttgccactttaccacccgcctkaatcctgggattytagtatgcaataagagatgccctgtactgatgcaaaatttaataaagtttgtcacagagaatctttgtactttggggttcttttttttttgacttcaagtccgaatttgtctggcccattcctatttgtaaaaaccattgcactgaactcagagcaagttggagaggagatgaaaggagtttatgaatgctttattccccagtaaacttttacatgggtggttttcaaacmmcttctccaaattgccttcccccaaacttcctttcccccaccatatccaggtccttgaaccactggattgtggttggtgttgggggtaccagcaacacccactccctgttcaagcccaaggtggaactcggaattctgactaaaactggagtcaccttccttcagcctgcttcctgccagtcatcctgggtgactactgtccctaaggccacaaagaccagcctcctccagcccagcctcatggtcccctctctccacacttaacctctgttacctcaccttgtggtcagcagtagcactgtgacttccttggcttttgggagaaaggtgggccttgtctgcaaatggaatttaagatgaatgatgagtgggagaacaaaaccactgggagtggtttggccagctctggaagccaccattcccatggtagggggtgtgatcaacctcttggatgagaggctgaaaatagactctggcccttccgaagctgtccccactcaagccagggacataaaggagctcgatagctgggactacaggtgtgtgtcacctcacctcaggctaattttattattatgtattttttagagacagagtctcgctctgtcatccaggcagcagtgtcactgtcatagctcactgtaacctcaaactcctgggcttaagtgattctcctgcctcagcctaccagtgtgctgggattacaggcatgagccactgtgcccatcctttttttattttatttagttatttattttattttttttgagatggagtctcactctgttgcccgggctggagtgcagtagcctggtcttggttcactgcaacctccgcctcccgggttctggcgattctcttgtctcagcctcccaagtaggtgggattataggcgggcaccactgtgcctggctagtttttgtatttttagtagagatggggttttgccaagttgaccaggctggtcttgaactcctgacctcaggtgatccacccacctcagcctccaaaagttctgggattacaggcatgagccaccacacccggccttaaatattttttagagacaaggtctccctatgttgcccaagctggtcttgaagtggcctcaagagatcctcttgcctcagcctcttgagtagctgggattataggcgtgagccactgcacccagctctttttaaataaattttttttttttttttttgagacagtgtttcactcttattgcccaggctggaatgcaatggcgtgatcttggctcactgcaacctgcacatcccggattcaagcaattctcctgtctcagcctcccgagtagctgggattacaggcatgcgccaccacattcagctaattttgtatttttagtagagacggagtttctccactttggtcaggctggtctcaaactcccgacctcaggtgatccacctgccttggcctcccaaattttttttttcttttaagacagagtctggctctgtcccccaggctggagtgcagtggtgtgatctcggctcactgcaacctccacctcctgggttcaagtgattctcctgcctcagcctcctgagtagctgggattataggcgtccaccaccacgtctggctaatttttttgtatttttagtagagacagggttccaccaagtcggccaggctggtctcgaactcctgacctcaggtgatccacctgcccgggcctcccaaagtgctgggattacaggcgtgagccactgcacccagcctaaaattcattttttagatcagttttaggttcacagcaaaattgagtcgaaaatacagatatttcccatgtgctcctctccccacgtgggcaacctcccccactgtcaacattctgcaccagagatggccatttgttggaactagtaaacctgcactgacacatcactcccagatttccacatggctgctcatcattcagctctcagctcaaatgtcacctcatcagaaaggcctttcccaaccacctgaaactgaagaatcaccaccccccaatcccactctcacatgaccctgtttcattttcttcaaagcagcacacatcaccatcttgggttctgcttagctgttacctgtgtatgattgtctccctccctctactagcaagtcagttcagtgagaagagagaattgttccttcctggttcattgatacatcctccacgcctggcaggggtggacactcggcatttactgaatgaatatgctttctcatcccatctgctatcctgccctgcccccagccaccccagcctgccttcaccacactcaaccccgaagcttgacgtcagccaattcttactttcccgcttgtcacacctgggctctgcgttaggtcagctgcctcatattcatcattcgtgtgtctcactcccaccgtagacaacacttcccatctcagccccataacccagccctgcagccttggccccatctacacccccagcacacacacacacagcacttagcaactatgaacacatttgatgagaaggttagaaaggacttggggaggtggacattaggatcgctgagaaatctggggaaggaagcttgctaagccttcctggaggttcacctcctcgtcgtccccttcaaatggtggagtcattggccgatgctatgtcatgcagctggtggcggaaggagagtcgggctttcctgctgaagtaggcaccaggccctggcgagggtacccctccctcagccatggtgggggctatagctggactgggatctggaggggcagcaggactcaggcctaaaagattggaggaagaaggaagttgtaggtcagggttcacctcctccctcacccccaacccagggttgaggagggaagaagcaagggaagacacctggggcctgggggctggtgaggagtgttggtggcagcagcagggggagggagaggggctgttgcagagcaagcaggactggctcgcacacatgtgacctgtgcagttgcataggatcctccgactcagaagggccaccatgcttggcataggtctctgctgtcaccatcttgaaattcttaatttttttttttttttgagacagtctcactctgttgcccaggctggagtacaatggcactatttcggctcactgcaacctccgcctcccgggttcaagtgattctcctgcctcagcctcccgagtagctgggactacaggcgcccgccaccacacccggctaattttttgtatttttagtagaggtgggtttcaccgtgttagccaggatggtctccatcccctgacctcgtgatctacccaccttggcctcccaaagtgctaggattacaggcatgagccaccgtacccggccgaaattcttaaattgttaacaaggggccccacttggtcatttcgaactgggccctacaaagtatttagcctgtcctgtgaggacttcggtgatccatctcccacccagggagacagatgatccttttccctttgctggtttgagcatttctctccctgccatgcagttgtctctctgtctgcctgacagccccgctttaccctcagtctactccatacctgctcctctttcagtcccccgctgcctccggcacccgcaccatgggaaacaccatgcccccttcagacccatctcaacagtggaggcgatcagagctgggaatggccaggagggcccccgggagaggggtgtggtttccaagcccccccaccatgggcaaaactaccacttagcctcagaccgcctggtgattacaggcgccagggatggaaaggggagaggagggaggaagaaaggggtgggggtacactcccattcagacacctatttttatgccccattaatttgggggtcctttctgatccccatggagaagcaggaggtggttgggagaggtggcacggcagggacagacgcagaggtgctgtgacagacagatgcagtcacatttcactatggcaatgcccgacaacttggcgccaggctggacaccgctggggattcctttgtattttagaatgagaattgaagtgcccaagatgtaaactttcaaagaatactctatttttttagaataagaaactttattattcagggaaatgttagattctcattaaatggtctgatagttcctgtcccctgttatgaagatgattgtaattgattaattatgctgtgtcaggtaaatgctagagacttttacatgttgtctcatttcacttaatcacgtcaaagatcttttttttgggggacagagtctcactctctcgcccagggtggagtgcagtggcgcaatctcggctcactgcaactctgcctcctgggttgaagtgattttcctgcctcagcctcccaagtagctgggactacaggcgtacaccaccatgcccagctaatttttttgtatttttagtagagacggggtttcaccatgttagccaggctagtctcgaactcctgacctcaggcaatccacccgccttgtcctcccaaagtgctgggattacaggtgtgagccaccgcacccggcctcaaagatcttttgaggtaagtccctcactggttaggtgagtctatcctggttttacagatgtgaaaaagcaggcactgagaggtaaggtaatttgcccaaggtcacgcaggcagttattagccgagtaggaaccatgcccagctcacaaccctcaccttgagtcagtctgaccccaaaaatctattgttttttttaattttttttttttttttttttttttttgagacagagtctcgctctgtcactcaggctggaatgcagtggcgcggtcttggctcactgcaaactctgcctcccgggttcacgccattctcctgcctcagcctcctgagtagctgggactataggcgcccaccaccacacccggctaattttttttgtatttttagtagagatggggtttcaccgtgttagccaggatggtctcgatctcctgagctcgtgatccggccacctcggcctcccaaagtgctgggattacaggcatgagacacagcacccggcctttttttaatttttgagatggagtcttgctctgttgtccaggctggattacagtggtgcaatctcgtctcactgcaacctccgtctccagggctcaagcgagtctcctgtcccagcctcccaagtagctgggattacaggcacccgccaccatccccagccacattttgtatttttagtagagatgggctttcaccacgttggccaggctgttctccaactcctgacctcaagtgatctgcctgcctcagcctcccaaagtgctgggattacaggcatcagccaccacacccagcccagaatctactcttttgaccagtacactgagcttctgaagcatgtccccaagcaagcatcgatgccctcagacagtttggggtggccagagccaaggctgggagcatctagtcaagagcatcctagccaaggactctaagtgctcttaagtaaagctgtggaagtgctgtgttttttttcttttttcttttttttttttttgagatggagtctcgctctgttgcccaggctggagtgcagtggcacgatctcagctcactgcaacctccgcctcccgggttcacgccattctcctgcctcagcctcccaagtagctgggactacaggtgcccgccaccacgcctggctaattttttgtatttttaatagagacagggtttccctgtgttagccaggatggtctcgatatcgtgacctcgtgatctgccctcctcagcctcgcaaagtgctgggattccaagcgtgagccactgcgcccagcc

SEQ ID NO: 10727 - DNA, 40185 bp, Homo sapiens
  misc_feature (1)...(40185): n = A,T,C or G, or insertion/deletion polymorphism (see Tables 1-2)
cacactggctgatggtacagaggaggagaagggaggaggagggagaaagaagtcaggcgtgttcccatttgagcagctctcccctgcgggggctgacactctcggaggtgctcctgagcaccccagagccccgggcttgggctctcctcaacccggctcacctggggtgtgggtggcggtaggggtggtgtgccaagatgacgtgctcatctcaggacgacgtcagcttctgttgtgcagctgagaggtcttatgcctcacaaagatgctctggaatttccactgcttaagaaatgcaactttttaatcataagaaatgatatatggtgattgttgaaaatttgcaagatatgccaaggatatggaaaaataatctttaattttgccagccagaaataactattattaaaattgtttaggccaggcgcgatggctcacacctgcaatcccagcactttgggagccccagccgggcggatcacctgaggtcaggagtttgagaccagcctggctaacatggcaaaaccccgtctctactaaaaatacaaaaattagctgggcatggtggcacatgcctgtagtcccagctacttgggagactgaggcaggagaatcccttgaacccggaaggcagaggttgcaataagccagtagaaattaggagcttctgcttcttgttataaagcacttaagggttgcttaattttgtattagcaaattagatatttagaggacttgaagaaaatatataaaataatttttttttgagacggaatttcgctcttgtcacctacgttggagtgcagtggcctaagggatttgtcactcaattttttgctcagatatgcctttacgcatagtattaagcattttatttattcatatatatttttaatagagactgtgtgttgctgtgttgcccaggctggtctcagactctgaacacaagtgatcctcctgtgttggccttccaaagtgttagaattacaggtgtgagccaccgcgcctggttaacgaagcattttagaggcaaattgtgccacttctactatctggttttggtttaactctggggtcctgtttaactctattttttttcactgtggtctttttttttttctcttaagtttgcttcttagaaaatttcacacagcctgttttctgtaatatagtacagtttatcatttaatataaaatttcttctagacaaacaccagaagttgaaaagacaaaaagtatgaaataaatcctcaaaatagagtagttaggaaaaagaattataaatctggggcttttaaaatagttttttttccatctcagtcagaaactttaaagcagtcactttatcttccctgactcagtttctccacaagtgaaaagacataatagtccacagtgactagttaggatcctttatagtcaactgtgaatggctggaaacgtggacagctaatatgattccactattgtatgggagaggcatcatgtgaattagtgggaatcacctttattagtgaagaaaaaaatcacttgatgatttgtaggaatccggggagaatgctgagaatttgtggctgaaacttctcttaggaaaagagagagattgagtgagagcgagagcgagacagagagagagagagagagagaaagcgagaggcacatgctagaacaaagctcctttcatttgttcctgggagtggctgggtgtgtcaaatcatccctcagcctcgatgctgagtaatcaagtataatatttgcaaagcttcaacctataggtaagaaaaagcaccaacaaaacagtctcctaggttattaaatatttagtccaatgattacttgtgttgaactagaggaagttattgcttcatacaattgtataatgaatgaatgaataattcattctttgagctatgtatctcccctccaaaaaatctactcttttaaatatatagtcaataaaatggtttttgtggcaaataaagagaggggaaaacattatggattatttttgaaattatagagcaaatgctttttcctacaaacaggtgtattctttgtcactaaatttttttaaataaatcatttatttggttgggtgcggtggcttacgcctgtaatcccagcactttgggagtctgaggcaggtgggtcacaaggtcaggagatcaagatcatcctggctaacaaggtgaaaccccgtctctactaaaaaataaaataaaaaaaaaattagctgggcatggtggcgggcgcctgtagtcccagctacttgggaggctgaggcaggagaatggcatgaacccaggaggtggagcttgcagtgagccgagatcgtgccactgcactccagcctgggcgacagagcgagactccgtctcaaaaaaaaaaaaaaaaaaaaaaaaaaaaaaaaaaaaaaaagaatcatttattttacaaatgtaaagtgtttgggatgaatcagatgtactggtcttcatatacaaagagaactggaggaaaggtagctggtatttaaggaaatgtcaaactgacttcaaattttgggttgaattcatccttagttgaattcctgtcgggtagggttatttcccactcattcattctctacccactatgtgctaagtacccactatgtgccagatactattctaagttcttggactacatcagtgaaaaaaacagaccaaaaaaatctgcttagatttcagctgaaggaggccatcaacagtaaacataataagtgaattgtatagtatatcatatagaaaactataaaatctggccttatatctgcttcttataggttcaaagttcatcaagaagaagggagatcaaaaatactctggagttgactattcatgggcccacataaaaagcttttcatgaggcaagagactgaagattataacaggataataacaccatattgttatttttatgttgttgctctctgagttattagtatgagtagaaccttttttcttataagtctgatgcttctaagtccacttgttaacataattgacatgacaactttgttctttccaggcatttccttcaggatgtatgttttttttttttttttttttttttttttacagtataacaattagtgtaggtatctgacttatagaaatgcaaagctaaactgtagtcggcttgagatccatagttaggtcttattctgggtcttgcccagggtctgacacactcaaaaaatgcttattcagtcaatcacagactccaatcaaaatgtccagttaaaacagggaagcagagtagaaacctattgaatgcagaagactttattgaggccactctttcctaaaattaatcagcaggcatgttctccagaaactagtttgaaattctgtaatttaaaaaatgtgaactgcttgtataactccatcctctcccacttttctgttttctagtgtctttttaggtagaattctaaagaacttaaaattttggctgccgtggaaaagaatattactgggaaatgggtcttctcagtcaaatagaatcacagttttaatactctttccactgaatgggaaccacttttttttttcctgcaattttgcctaaatcaacagtgtgttttgtcaatgatgttacacctgagacttgtgagtccttgccttacttgggttcaatgagagggtgagaacattcacgtacagggtctgacctccagagatacttcaacaagtgaaagcttttgacaggaaatgttctgtttaatcttttgttaacatatctgtccaatataccttgtatcatcccagctctggacctccgttctcaggcttaaatggtctcctgatgtccaatgatgctgcctccatgatccttccccagtcatagccagactgaaaaggtcacacccatctctgaactacttttgtcatttgcacctctcttaagtcccttattacatgcctccagatactttcttttgtttcttgtcttcctactgtaccctttggggagagggaacatgtcttatagccccagtcgaatggtgcctctaattttcacccagttagaatcacccaaaggcatttcactttgctagaacttccttgggtattgttgaattcctgtcattggaaatgtttctgccccggttgagcaagcactgaacaggagtgttttagagggaattaaaacttcaaaaaggagaatagagaggctctaccatttaaatgcaagtcgcttgaaatctgtagaccacagtagcaagcacgaagcaggtattcaataaatgtggtgaattcaatgtcaataacatgctccagtcttttgtccactattccccgagcctacctaaccaatgggcaaagtggtactaattgccatcattaggaagcacatgctatgtgtcagaaagtatgtaagaattgtctcttcatccatctctgtctatatctcattttatcgatcttattgacaaatgagaactatatatagatctcattttacagatgaggaatctgaagctaaagggattaagcaatttgctcaggatttctcaagcaatgagtggttagacttagtttgcaaatttatgactctgctcccaaattctcattttccctcctacagctggataatagaatttttaagaagcatccttccacacctcctcacctatgaccttccctccacttgctccactgatgcctaaaattctgtttttggagttcacttagtttatgactttgattctggttaacattaaaatacccaggacatgggggaggggaagctgttatcaatcttagtttagtcagttaatatagcgagttgctcttattcattactcaacaagcacttattgactgcatactgtacatcaggtctgtaccaagctttggtgttataaaaatgaatgaagtttggcacttacctttaacattgttgtagtcacatataggagaatgtaagagattattatgaaacaatgtagtaaatgtacaatagggaattctagataagcacagcagagaagcaaccagctccgtttcaggtcctttcctgagactgattcggctggaagggagtaggtcccgccaaatgaagaagctgtgggaagacaggaggacaagaacaggctccacgaagagatttcagagcagagctgcgtactcctttttctttttgtttcttttgctctgtcacccaggctgaagtacagtggttagctcacggctcactgcagctttgacctcccaggctcaagtgatcctctcgtctcagctttccaagtaactgggaccacaggcatgcatcaccacactaggctattgttttacattttttgtagagatggggtctcaccatgttgcccaggttggtctcaaactcctgggctcaagcaatccgctcacgtcaacctccccaaatgctgggattacaggcgtgagccaccgcgccaggcctgagtaatcctaatcacaggattttaaaaagaaacttcctgcgccacccattaaacaatatctcctaccaatttggtagtaaatattttgctaatagtacctaatttttaggtaggcactgtgtttatacatatatccattccttcttttttgattgtctttctgtttaatgggcagctacctctcttggcatctagcagaatgagctgctgcagtttacacaaaaagaatggagatcagagtactttttgtgccaccaacgtgtctgagaaatttgtagtgttactatcatcacacattacttttatttcatcgaatatttcaccttccggtcctgcgtgggccgagaggattgccgtacgcatgtctgtacgtatgcatgtaactcacagccccttcctgcccgaacatgttggaggccttttggaagctgtgcagacaacagcaacttcagcctgaatcatttctttcaattgtggacaagctgccaagaggcttgagtaggagaggagtgccgccgaggcggggcggggcggggcgtggagctgggctggcagtgggcgtggcggtgctgcccaggtgagccaccgctgcttctgcccagacacggtcgcctccacatccaggtctttgtgctcctcgcttgcctgttccttttccacgcattttccaggataactgtgactccaggtaagcaaggtggggtagcagggctggtgacttccttttttcagggaaattcataaatatcgttatttgagctgatttgagatygtgaacaaaatggacttaggtccattttggggctgttttcaaagacgggctgttgggttgagtactgtcgcctctcatcccccatgttggcagtatttccagctcccaaccctttgagcaccaggaacactgcagagggagtaaaatcacttaaccatacaaggtaagaatatgaagaagtcacgtggctcggaggttttggtggtagaggggtgcaaccgtgattcacggaggagaaaatacttctgaggacattttcaggcctactttggaactcagaatgaattttgcaatgctagtttcagaaagggtgtggtacccgcaaactggggaaagttgagaagtattggtgggtctggctggctcttctccctggctgacgttgtaaggctgagatttaggcatatggactgcccttctttttggcatttttaagcatcagatcgctgttcatctacttgcaactgcattcttctaagcggaaattattctcccttcagttttctgggtttcagcataactttaaacaagttacacatttcagatgcntattcttggacttataaattgtaatagctgcttgtagtttcttactcatatgctgtacactttttcttatggcttcatttaagcatatcatactaaaaaccaacatgccaggytattccagagacttgtaaccagatcctcagagctgggggctcttagacatatttcagcccagccccctcattctgtagatgaggagcagaactcacagaggtgatctggtgtccaaaggcacacagcttgtaagtagcaccgctgagatcaaatcaggccttcacacttgcagctcgggatgtttccacaacaccgtgggttctgttaccatctttttcatcccctacatctcccgggaggttttcgataatgggttccaaacctcagtccctgtcagttagtgtaagtgttcgatganttccttcatgggtggagatgaagcctgtctgaggaaaggagtctccaaaggaaatgagtcagcaggtttatatctttgcttcctaacgccttgaattgtgccacttcaatccctctgggttgnggattgactttggggctatgcagtctcagcgatttgggccattctggtgtggctgagtctggctgtaagtttactgcttggcaacagtgggctgggtcagtggtcaagatcaggcttctaaagagacaggagcagctatgatgcttcagancaaagcagacgcccccctgccatgggaaattaaagcaattactaatagctgtattgtactttcttgcccacaaagcacttttcatatacattgattcacttaatcacttcgtttagtcctcatagtctttcacattgcagaaacttcaaaatatcctattttcttaatcctgcacatcctttgctcctcaaagacttagaatgtggacaacagaggttgtgttttttggcattccattactgatattataataggcaaggtttctcatggcattccctaaggactggttataccaaatacttgagagatgtttttcaccatgtctttccatctttaaaatgaggcaggccaggctaaatgatatctacratactctgacacagtaaaaacgtagttttttttttttttttcttgagatggagtcttgctttgtcacccaggatggagtgcagtggcacgatcttggctcaccgcaacctcaccctcccaggttcaagtgatttttctgtctcagcctcccaagtagctgggatgacaggcacgtgccaccacgcccggctaatttctatatttttggtagacacagggtttcaccatgttggccaggctggtctcgaactcctgacctcaagtgatctgcccgccttggcctcccaaagtgctgggattacaggtgtgagccactgtacccggccaaaagttaaggttttaagggatgaaaaaactatactcatagctctgtttaaatatgcacgcccgtgatgtgtgggtgaagagtgtggttgatggtctataagtaaaatgaacatatattgttcaaatcaggatatgtttgagagtaaacggggcactgttatcaatgtcaagacaacagacataaaccaggattgtcccaggcaaagtgggatgtatatatcctacccacaggacttttttctcacctaaatggtctaaagacaaaaaatgtgaggaccattggctcagatgcataaaaaacttaggaaatcttcatacaaagaccagtgacaagctataagtctagagaagtgagcacggccctacccccagcccagtacatgcgtctccattcactggggcctctctgaattgagtcagttctccctgtcccacgtttttgcaaggctaactcctacttatcctgtaggactcacctttaatgtgacttactcagttgtcactgtctctgaggaggtgtcactgaggtttctagtatggggggtctatcactcctggggatcccatagtgacttgggtgctcatcaaaacacttaaaacagtcatcataccactaactgacagctccttggaggcaggggctatgtcgttttcaccttttcttaatgcttaccctgacacaaattaggtactcagttaatacttactagatgaaagcaacgtcataccaagagtttacaacataagtggcagaaagggaacaagggcttcttcacgtaggaaaatcatagggaagaagttttgtgtcgattgaacaaaccatgcaggatatgttgatatcttcaaggggagacttcaggacatgcaggatttttggaactcgagagacttctgagagaacaaatgccagcaaagatgcaattaacaagaaagcaggtgatcaggtgtggcggggaagtgccaggctgggagctagaagcaatgaattctaggtctggttttgccactctcactccctgcgtgggtggcctgggagactcacttcatctttgtctgcctcattttcctcatctgtaaaatgaagaggtgtggccagcctagatcctctccaagatcttgtcccactttcaaggtttataatttgcacagattgcgaaagcaaggtacttggaaataagttcttaaaactgcatttgtattactgcttgaacttccatctatctcactttcctatggttaaaataaagttccttttaaacttttaagtgctgaaagatgtagcgttttctacattgcaactataaacgaagttctccttgttaaaatggttacagggttttcacagaaatggaagaagacccttgtgacaaggcaacagaatgaaaaaaaatttgtagcaattttagcactttcaacagaagtcattaggcacattaaatttattatataggaattgctaatctctactctggtacttgcaattttatagcatttgatcatgcaaaatggtctgtgtaggaagtttgtattttttccaggtcatgtattgttaacattgctgaggtttgtttaaatgctttgattgtcttgcaacacagtcatgtggcaactgtggccaaagtcatcttttgagctacctcagaccagatcaactttatagtgtttttaggtcacttgggactaatcacagagccactgatcagatttaccgggcagtatttgattgattacttagtgggtgattttttgcaactacaaccttttccatgtacagaccttttctgtttcctttagccagcatcaaacaatgctcttgccactgggaccccagatactaagggctgtatgaccttcccagacatgaaggagaattttctgagaaaggagccagtcagcataggaacaggaaggcagatctctttgcgttcatgcactgaggattagcatgcaaaggaagggactcactcaaagggaaggtccgccaatggtgagagaaagccccagagatgttaggatgtcagatgtgcactgatttacatctccaacagggacctggatctaagccttgaattgcaacacagcattaattgtattgtgtaattaactacactaaaagccacaatgatcttgtatccacaatcatttagactaaatgtatctcaaaatgttgtgacaagtgaatgaataatgctttagtgaaataaaatggtaaaatgaacatctcctcaccatttgatccactcctaagatccatttgtaggtgtttgcagccaaactccctcagcacattaagatcttaaacaccatctttctatacaaaggaaatcactaaaagtatagtttgttattgactatgcaaaattattctagtttctcttggaggataataaatacgtgcttggaggagctacttgtgtttgttaaagcagtttgtgtgttttcatattattatcagtgcgattagctctccactggtggaagtgttaagaagctttcagggatctgggtttaggcttctctatttggtgaagaaataactcattacttcttgtacatgttgagttttacttgtagatgaacttggcattactaatattaaatgtgctgtggaaggaagccaggtttcctattctgaaagtctgtccacagattccccaaaccttttgtgaagagtttctttatgttttcccagtggcaggcacactgggtgaaacactcaacaggctttcatttttgcctcagtataccctgctgacctcagtatacacctaatgccagtcacctttccctggggtgtgatgtcacctgtaggcccttgcccctgccctgaggggagaaggagtaaggttgtgggctttaaagaaaagtgagaggcccacctgacttcagggggcctcgtggtatatttgcaatgggaactggcctgagcgcatggctgtacttatcagggacatatggagaaggaggaagcccatggaaatgaccagtgagcatgaacagagtcaataaaacattatttttggataatgaactcgctttttcagactctgagatataatcgatttaagtccatcctacacacaagccatatatcccataaaagggagaattctgaagaaatgtttaaagaccaggagtcctctcctccatcttattctcgtctttgcattctgaatttgtgtccaggtataaggtgcaaattgcaatcctattcatcatgcctttgactcttgacacacgtttgggtactggccaaagggagtcctctatcttaagcagtggagcttactttctaatgccagggtgcatgtcctacctgaagaccttcaatgtcacattcggcccttgtgtctgtgtgtgtgcgcctgaggctttgggggaacacttcgagtttaatccctgtactgctcaccccggggtagtaatatcaattcatttcccttagaaacatgctgtcctggcttaggcagaacctcaggagttcatgtagttcagctctgctcccagaaagggaagccctgactgcctgaatttacctaattgtctttggagtcgatcagtaactaccagactaaataggtaggtagacctttattagaacagtgaagctttttaaatctgaggaccctgttacactcttaaaaattaccgaggaccccaaagaactgtttctttaaaaaaaatgtagattatatctatcactatttaccaaactagaaatgaaaaccagatacattttgaaatgttcatttactaatttattaaaataatataataattaaatactaatatgaataatatatatattaaaaaacattttctaaagtgaaaaaatgtaatgagaagagtgatattgtttttcatttttgcaaatctccttaatatttggcttaatagaagggatgtcatatagcctctggaaaactccgctgtctattagagattgagaatgataatgtcttagtattatcatgagaatagttttaacctcatggacctcctgaaagggtgttagggactgccaggagtcaagacacaacactttggaagttgctgtgttaaaattaaagagctctgagatgtgacaagatgcctagttgctgctatatccactttaccaggctacatattttgaaactgttccctcttttctttaactcccatattacttattataccactcacatgtcttgggcagctctgtattctagttatttgtctgcatatctgcccaaagagactatgagcttagagaaggaggaggtccactgatccttgtaacactctgggtagtgtcttacacacagatgcgtattataaacgcaaacaataaccgctgctgtttattaagtattgttatgtgctgggtgtcctgcaaaggcattagttactttaagggttttctagcacttctcacaaagcaccacaaaccaggcagcttaaagcaacagaagctttattcacccacaggcttggaggccagtactttgaaatgacgatgtcggcagggtcatgctgtctcaaaaggctccaggggagaatgttccatgactttctcttggtttctggtgttgccagcagttcttagcattctttggcttgtggaagcatccctccaatctctgcctccattgccatacggcatgcccttcacacaggtgaagacatttgtgtcttcacatcttccctctgtgtatgtctgtttctgtgtctctcctcttattcctttaaggacaccagtcatatcggattagggctcacctaactccaatgtaacttcatcttaactaattatatattagttaagaaataggacataccctgtttccacgtaaggtcacattcacaggtaatggggattaggacttaacatatctttttgggggacacaattcaacccattacacttactaaatattaaactgaacaatgcaaaactgctgcaattcgactgtttttgttttataaaagttttaactttgtagtttaactgaaatcctaatggaaacaatatgtgataaataaaaccaactgatgttgattagtgctgtcaacttttctgacatatgctggagaagagatgtgaccactgggctcccgacaatggccactgtggctgagcaggcccaagactgcagagtctaggcagagctggacacacagaggacctcacatgccttcagacatttgcctggaagtttcttcacaactgatcttacttttgaatttacagaaagttccytgtttcttctgagatcaattactttgtttaaatagaattcttatagtgttggcagaatgcagttgagaagacgttaaagatgctttagaaactaactgctcccttgtccttgcttccaggccckcaatggatgccctgcaactagcaaattcggcttttgcygttgatctgttcaaacaactatgtgaaaaggagccactgggcaatgtcctcttctctccaatctgtctctccacctctctgtcacttgctcaagtgggtgctaaaggtgacactgcaaatgaaattggacaggtaagccccaaaaccttgtttctactttaagtgggaatacagttattagaacccataggcagtgcctacggaaaaaaggaatgtagactttgtggccagaattggtcaagattcagaactgtgccattccaggactctcttaatcttttttttttttttttttttttgtgagacagggtcccactctgtcacccatgctggagtgcagtggtgcgatgttggctcactgcagcctccaggttcaagcgattgttgtgcctcagcctgccgagtagctgggatgacaggcgcgtgccacaacgccaggcaaatttttgtatttttagtagagacagggtttcaccatgtggccaggctggtctcgaactcctgacttcaggtgatccgcctgcctcggcctcccaaaatgctgggattacaggcatcttaatttatttttaaatgtgaaagctcgcttgtaggtaatgcaactcacatctgggacaggcaccaggctgtgatggagaacctggagatctgctgggtaatcacagctttttcattctgacttataatattttcaatttacaatggttttattgagatgtaacctcatcataaatcaagcagcatctgtatcgttttagggtttctttctggctatggttgattatctagctttgtaaagttcttagaccttcaaatgagacaattttcctgattgttccgttttaagtcctcakgtacttttacataataggtgaatgttcttctaattctatttcattattactcttaygctaatcattctaggttcaatagaatttcttttctattagctcataagcatttaaaaaggcaacaccttcttgtattcatatgtgtccagaaagtatggcccataaragttatttaggtaaggatgaagaatttacacttgggacttgaagcagcttcactcctgygaagaggagatgtatcttgacatcaagccacatctctgaactgcgcaactccactatccctacccaatctcccattcctcatttctcatctaccattagagaaaggccagcgaaagagaacttccgggtagtgggtctgttcctcagtaattcctcaagctcttctcagtatatgcaactggttccccagcagtagttacctgggctcttaaattttctggtctccttcatccatctttaggcatgagagttatgcactgtctgggaccagcatttgaccctgcaatgctgaggctatgtaattcattgggacaatgtgccggtttggcagcgttcgttatctgggttgtggaatcacagcatggccattatgagttatggagcgaggagggtgtcatcttatgctgacattacatgttgtggtgttgcaaggcagaaaagatgctggactattgsttggaacaataaaaaaaaaaaaggaamaaaatacaatgatttaagccctccaaatgatagtatcctggttttaaatggcttacaatattattacaagaataattaacagtttgaatccatataatattttacgtgttttacatataagtaatcctcattaacaactcaggaaagcaggtattttcagcccattttacggagaggaaaggaggctctgaagagttggagaagattctctgaagagttggagaagaggtggtgaaggctgggattcacaggcagggccatctgactctagccagcccagggcagcccaccatttattgtagctgcccatcagaaatgacacatctatttacctggcatttgctaaagcacccagagggactagacagactctggctagaggcacttgtcctgaaatctgattcctgcctgatgatggtgtctcttgtatcaatctctctctctggtctttgaattggatagaaattataacccagcttcatcgttctccaagtttggaaatccttctgtgtgagtattaagggcatcactttgaagaaaggacaaatgttctcgatggttgatttggaagagtacctttatggtagtgtttctcagtggggacaatttgtcctccccttcccactctgggataatctggcaatgtctggagacattctgggttctcacaaataggaggaggatgccactggcatctagtaggtcagcgatgctgctaagcatcctgcagtgcccaggacagccccacaaagactcatccagcctgaatgtcaatagtgctgaggtygaggagccttactttacgggaactaggcaggaggagtctgtatgcccaaggacgttggtcattatcacgtgtccacttcagtacagcactactcagaggcaatgntttttgggtaacggatttttctcttaacaggttcttcattttgaaaatgtcaaagatrtaccctttggatttcaaacagtaacatcggatgtaaacaaacttagttccttttactcactgaaactaatmaagcggctctacgtagacaaatctctgaatctttctacagtaagttgtttaaagcaagtagcaagacttaactntttacaaggagtggcattttcatgctgttagacctayaactttttttcagtgaaattcctttctaggatgttcacttgtgatttgaggctttaaataaataaatcctagtggagaggttgagtatagtgggaatcaattgcagtcacatcttctaactcaaaatacagagaagcttatgggctttccttttctctctcaaataaatcttaccctttcttttaccttcctctgagagaatggagaacagagtaattaactctctaataaatgtagctccatagacaatgagctgtcttacagagtgtaagacagctaatgatttaaacttctttctccttaaagagcagggcatatggcctgggacaatgttttaagctctccacctcattttttatgcacacattcttctgatgtttctcaaaatcagtaagaaaaataataactatgaattcacaattttcatcagtcacaaattagttttgttggctgggctgrtcagatggggatctccacaggcagctctggttatataagtttagccattgctctaaggaatcatacaaacaccactacggtacccattgttgtaatatttaaaaatctgtatttgaaacacacagacaatattctagactacatgmagtttccctctgtacttcagtaacacagagttgatttagttcctgtttggatggtcagaatttcaaggtttccaaatcgaaaagctagactaccagcttttaaatattttaccatgattttgcaactttctgcagtaggtatttttgtggttaagatcttttgaggacatgggttactagatattgtgagtatattttttgttgcttaaagatacatacacacaaccatttttcttccaacaatcatctgaagaatttaaaaaaaaaaactgagatgtgagttgaagcctgagcatacaacatttctagaagctccctaaatgatcattaaagagacaattaacacatttttattgctggcagtgaggacaatggaggccctccttcatctggctgaggctttctaatgttttcaggtgagattggttctgtcagtcaatggtgacagtgagtcccaaggttgatttgcaattaactgaagctaagttaattggctaaggctgaagctgctctgaagaaattcaagaagccctgtgcttggaagtgaactgacatgacactgaatcaagttatatttagtttcactgaacttccatgcaacatctggaatgatcttaaccagactaggagttgtaaagttttgttttgtttttttccttggagatggagtctttctctgttgcccaggctggggtgcagcggcatgatctcggctcattacaaaagattttttaaaagactgctttccattgctcctgctaggtgcacagcatctgcaaatttactagttaaaggtccaaacaagtgtgctctgtggaggatctcttgcataagaactatctgggtgttaaaagggcaagttcttcaggcccttttaacacccaggtagttctgattgaacccaggtagttctgattaaacccaggtagttctgattgtcaaggtgggaatggggtttagggttgcacattttaaataagcattagaataagaactcctgttatgttctctcctgcattgtgtttccaaccttaatttgcagatggcacacctggaaattttgttaaaatgcattctgattcagtatgtctggggtggggtctgagattctttatttctaacaaggtctcaggtgatgctgtacaccaccttggaccacagtttgagtagcaagggtctacaggatatttagttcagcaaagacaagagttttctgctcataattctgttttctatacatttcctatattctaatatatatgtatctgtagacatacaaaattttcatgtttctgaaattacaacccataagagaattgggcatatttaacatagtgttttccccaaagctgatattaaattgatagatgcatttaataattgaaattgtcttataattgaaaaaaatgaaacattcaatacaaagaaattcactgacttctacatgaggtttcaattcatatagtgttaccaattttgaaagtgtacatatagcagttgatattyaataatccttttgttagaagagaataacaatgcaatagcttgactacagactctgattttatgaactgcatgtttttcaggagttcatcagctctacgaagagaccstatgcaaaggaattggaaactgttgacttcaaagataaattggaagaaacgaaaggtcagatcaacaactcaattaaggatctcacagatggcaagtaccctttaattgttctgctatcaatcaccaagtaaacagggccttccatctcataaatgtttgctccaaggataaaaaaaacatctggaggattctctggatatttttactacacaagctaaattctttcccttcaagcctgtaaacaacttggatttctgggcaattcttgtatcatctcatcacttggtagaaactgttgatgcttcagtgttagtttactttgtcttgctctctgacgagctgtcacaggccctagtggaatcctagctgcgcctctaacaaagtatgactttgggccaatcatgaggccatttttcagtctggaaatagagggactggattataacttcatgatccccgaggcccctttcagctgacaaattttacaaatttgttaaggaaaaagggacataggcaacatatgtaaaagaaaaaccggctggacgcggtggctcacgcctgtaatcccagcartttgggaggccaaggcgggcggatcacgaggtcaggagatcgagaccatcctggctaacacggtgaaaccctgtctctactaaaaatacaaaaaattagccgggcgtggtggcgggcgcctgtagtcccagctactcgggaggctgagacaggagaatggcgtgaacccgggaggcggagcttgcagtgagcagagatcgcgccactgcactccagcctgggcgacagagtgagactctgtcttaaaaaaagaaaaccaaaccaaacaaaaccgtagtgtcagcttgtcctcggtgccgcagctccccatgctggtcgttcctctgatagccccggggtccaagaagctcctaggttctttctccggctcagtgcttcccccaggcgtctccctcgtcggactcctsgtccctcccttaaaattgccggtgagtcgtcttccttgctggaaaagaattagggttatgatgattttgagggcaaatcagtgactttgtccccctccccagtggatatatttataattgcatctggagggacccgttgggaggccgggccgaatctagtcatgaaagaatgaagcctaggcagtcgctgctgtctagggagggatacacttccggggcaagggagacccacttcctgcgagaatgactygcgcccccagctactctgtctctgtactgactgaggaagttctaacaggacagtaactgcaggatgagaacatgggaagaacagggtctctggagtcattcagcacctaggttcaaatccagacactggtacttactaactgatatttggacacaaagcttcaatttactgaactgtaaaatgaggcacatgttacctgatttartttttaaaattgtattatattgtgttttatttcaataggttttggggaacaggtggtttttggttacatggataagctctttagtggttacttctgagattttggtgtacccatcacccaagcagtgtacactgtgtgcaatgtgtagtcttctatctctcacctccttccactcttcccccaccccacaaagtccattatgtcattattatgcctttgcatcctcatagcttagctcccacttataagtgagaacatacaatgtttggttttccattcctaagttacttcacttagaataatggtcttcagaccaggcatggtggctcatgccataatcccagcactttgggaggccaaggcagctggatcacctgaggtcaggagctcaggaccagtctggccaacatggtgaaaccccgtctctactaaaaatacaaaaatcagctgggcatggtgtcacgcacctgtagtcccagctacttgggaggctgaggcaggataatcgcttgaacctgggaggcggaggttgcaatgagctgagatcgcgccattgcactccagcctgggtgagaagagagaaactgcgtctcccaaaaaaaaaaaaaaaaaaaaaaaagaataatggtcttcagctccatctaggttgctgtgaatgccattctttctttcattttttttttgagatagaatgttgctctgtcgcccaggctggagtgcagcggcacgatcttggcttactgtaacctccgcctcccaggttcaagggattctcctgtctcagcctcccaagtagctggggctacaggtgcgtgccactacgcccagctaatctttgtatttttagtagagatggggtttcaccatgttggccaggctggtctcaaactcctgacctcaggtgatccacccgcctcagcctcccaaagtgctgggattacaggtgtcagccaccgcatccagccatgaaaagacttctgagtttgaaatgggaggctcagggttgaagttgaagctctgtcgtttaccggctcccacacttctttgttcttcaggtttcttcaataacactaatatatatttaacatattatatagcattggcaggaccagttacataatttgcatggtccagggcaaaagtaaaaatgctgggcttcttgtttaaacatttattaagaattttgaggtagtgacagctgaacattaaaccaagtgcagggtccttcacacaggggtcacaggcctgtgaagtgggccctgaacattggtctgaaaattggagattaggtgaatgaaaaccctttataaaaaacctgtgggctattcaaatgtgaggagttctttttattaagggatcactccccttgaattgttttggctattgggatttagctttataataactgcaattgtgattgagccctatggtgattacagttgaccttgaggcaatcagcctgcccgcaaggagtgcaattgagagagtggatggagagctgtggggtgaaggggacaaccttcagacatgttttccagctgaggaaactagaacagctccttggcctctctgagcctcagtttactgcactgtaaaatggagataatgatctttgccttataggaccattgtgaaaagactgagataatatatgtgaaattctgccataaagaaagtgattacgtattttcattcaagagcacaggctttggagtcagaaagagctggctttgaaycctgaatccacccttgtttatatatcatccttgaaagtgacttatcatcgctgagtctcagcttcctcattcataaagtaggaagaaatatatataatrtgtatcaaatagcttgtatactgcctgacacagaataggcattcagaatggtagctgtgctttccttcttatttctcttcctttcttccctgctccttcattctcctctgctgacctctttggtagatctggttgtgtcaaggtagaaggagagaaargagtccttctgaaatttgatggttggaaccatcaggccttacatggtgtgactccatgaagtggtaaatactcagtgaatatgcatgtgaatttcagatgtagtttggaagaataattctgctacttgtgttttcctaaaattgttgcaggccactttgagaacattttagctgacaacagtgtgaacgaccagaccaaaatccttgtggttaatgctgcctactttgttggcaartggatgaagaaatttyctgaatcagaaacaaaagaatgtcctttcagastcaacaaggtatgtggggcagcrtgtagcagtaaaaggagcccaattatagatgtgaaaaatgayagggacagagtggggcataaatccattccaatgaggaacctgagggcacggccggcaaagtgcctttcctgagatgaacagctggaaggtaagtggtacaaaaagagccagaatccagaggccccccctcctcttttccataatgtcttcaaggatctgagctgagtgaaactttatagaatttgtaacccagcgaggaaagctaagtcaccagctgaaaaatagctacaaacatctgagaactttagcagaaaaggaaaagaccaaactctgttatcagaggactttggattatcatgaaaccttgacatctaggaatcttgttcctgattgattaacttctctaacatctcatttccttatcggttgatagcgaagtatattgttctgggattttaatttataatttataagatgctttgatggctgggcgtggtggctcatgcctgtaatcccatgactttgggaagccgaggagggcagatcacctgaggtcaggagttggagaccagcctggccaacatggtgaaaccctgtctctactaaaaatacaaaaattagctgggcatggtcgtgggtgcctgtaatctcagctacatgggaggctgaggcaggagaatcagaccctgggagacagaggttgcagtcagccgagactgcaccactgcactccagcttgggcaacaagagtgaaactccacctcaagaaaaacaaacaaacaaacaaacaaacaaacaacaagaccagatgctttcaggcacttgttggctgtgaaaaaacaaagtatggcttactcattgacatcactggaagtcattatgggaagaattaagggcctgttttgcaggccagtctcattgatactgttgaagtaaatatgttaaataattaatagagggtgggcacagtggctcatgcctgtaatcccagcaccttgggaagtcgaggcaggcagatcacgaggtcaggagtttgagaccagcctgaccaacatagtaaaaccccatctctactaaaaatacaaaaattagctgggcatggtggcatgtgcctgtaatcccagctgctcaggaggctgagacaggagaatggcttgaacccaggaggcagaggttgcagtgagctgagattgtgccactgcactccagcctgggtgacaaagtgagactccatctcaaaaaaaaaaaaaaaaaaaaaaaagaaatgggtaaagtacctcttttgtaaatgagaycaaggaactgagactggaaatttgacccattttattggaaaacccagacatctatatgatgatgtgatgtggtctccgtgggtgggatctgacttgtgttagactggaagcagcacttcagttagtacaatacttgaaggtagcttagttacctgtagctcctacgcgtcagttctagttttcatgcttctcccagtagttagagtacttagcatcaatatcttgtttttgccaaatatagtagcaccttcttaatgctagcatccatgaggaaaagccctgcaagatacaatctatgcctgggttagccggatggcttccattactctttctttctttgttcccatggaatttttattcatactctcccctgtccactgccagaatttgcttttccacagtgaaatctgtttacttacatagatcccctactagcgcatgggatttttaaggtagggacaatgccttattcacctcagtgtctacaatttctggccaagtccctaacacatcagtaggtgctcagcaaatttgctgaatgaatgatcagtccctaagggtcagtttgcttaaacaatcaatagcagacaaaacctgactggcctttgggactaccatggtttcctatgcaagacccattgggcattttcactgggagaagacaatgatgactgttactgctccttaccaactcaaaatatccatgggagctgagggatgggtaggaggtcctcctaacttcctgartttagcttcccaactgcagtggtcttctcaaagctgactgcagagacaggattgaccctgcacacaagaggtctgtctgagattctagagacatagcttatgctcttcacactcttgtgttttgcacacacaggtccttgagttttaagcatggctttttgaccttctcagtattgtcttttatctggagtggaagtggaacgtgactttacccagcctctactgtgagttagggaggggtgttggccccactggccctgacggcatccacacagcctttgctgtcatagagtgacccttctggctcctttgattagtgattggctctcctccatagcaagggctggcaaagggttcctaactctgtttaagtgaaatctgaaacrggttgccaatggtgcctctcttcaagaccccagagccagcctggaaggaacaccatgaaaatgttgcaatagtcaatgagtagaatgtggacttttgtgtcaaccacactaagggtcgtacttttttcattaagaaagtattaacgtgtgttttttgagaagggaggaagaatgtgtgctattcctttattcttgctattaaatcataaagctgggttatataagatcctggaaactcagcctttatgaacagaattaataaaagtttgaaatgtcattgatctctcagtgtttcacttgataaagcaataaaatgctattcayagctgcatgaggctacacccttcttttgaatgcagatgctattacttctcctttgttttctttgaattgctttgtccaccctagaactttttgagtgacattactaaaccttttcttatgccccgtggtgtctccggtaagggttagactaaattggtgaagttatatcattaaaagtttagtatagtacttattctgataaagatatctatccatatatatctatattagtatatatgttgtattatattttctggggtagatagtctttatttggtcctcttttcagaagatatgtcgtctcaacatgtgtttcagaaaataaagtacctgtagtcagtgccgataagtgaaattgatgacagtttttggaggccacaactatgtgcacattcagaaactatgagcagtctaacctgttggagatttttagacaaatttctttaggaggaatatattttaagacaatatcctctttaggagaaataaagggaagaattatctgttaacctccaaagtagtatgttttcctataattctgtttttggttacacatagagttgaagtcttccattatttatcagccaaatattcagtgasaaactacaagctggggtagaaaatgagacttagtttctgccttgactgtattctagttggggtgggaagtggaaagacaatcactagataatatttctaacactgtggcaagtgttaaaatagaggtatatacaaaagtaaaataaataacgtttagctctgctggagagaggtattggggaaggttcagcttagtatttgaagataccagatgcaagtttactggagtattatccttgcaggcttgatatgaagyttgaaatttctccccaaagagatttagttaacaggcaaatatcccatgggaggtatatgtcaataggttatacaacattactgtcagtcttttacaacttagcgtgaattaattttccttcaggaaatcagtcatctctggagcagagacaggaggccaggtgttaataggagcaaagagaagaaaaggcctgggcagtgcttggasataaaagacctgaacgatcagacccttccatgggctccctttaagaagagcagggagagaccaagggctaaagttgggagactgagaaaatgcagcccaccggggcattacttatttctccagctctgatccgctgttgtactaggggtctaatccggcctgtgtctgcctccttcttgaatagcccagagcattcatctaaacagccttcctacagcagctccccactttaggtgtggccagacaggagttctagaccaggttgtctcctgggacattgacaccgcagccaagtttattggtgctgaggcagacacagttggtgtggttggttcaggggctagcattggaatagcgtttggcagcttgatcattggttattccaggaacccatctctcaagcagcagctcttctcctatgcgattctgggctttgccctgtctgaggccatggggctcttctgtttgayggtcgccttccttatcctcttcgccatgtgaagctctgtgggggtcacctgcctgtccctgctgctgcggctgcacaccattcttggtgctgggctgtgctaagctttaccattgaacacaacgtttctgaaaaaaaaaaaaaaagagccaagcatacagtggagctcaaagggacttagagataattttaaaaagacttagagataattttaaagaacattttcctttttaaaaattatgcaatactccaagcattcagaaaatgatagagaataataaaacgaacacccatataccgatcaatcatctttttgaacttaatattttgccttaattatttcagatattttaaagaaaaaatataacaacagttgcattgctttgtatgtatcccttcactgctcactccactgtcctgttcctctttcttcctccccagtggtaaccattattctgaatttacaakttcttcattctactgacaagaatactgaggcctggagagattgagtgatttgctcaaggccacagaatctgtttatgtcacatttgggactaaaaaccaaggttcttatcttcaatttagactttgttaattagctcagatctgagtaggtggcagtacagtggggagtgggcaattcaaaccaaagacaaacagagaggtcacaacaaatattgttttgttctgctatgtgctaagtttgttgttgttattgttctgttttgttttgagatggagtctcgctctgttgcccaggctggagtgagtgcagtggtatgatcttggctcacaccaacttctggctcccaggctcaagcaattctcctccctcagtttcccaagaagctgagattacaggcgtgtgccaccatgcctggctgacttttgtattttttagtagagacaaggtttcaccatgttggccaggctggtcttgaactcctgacctcaagtggtctcccaaggtgcaggattacaggcatgaggcaccgtgcccagccagtttttgaaattaggcattttattaggaaaagccgtataaatggttatgtgggtttgcagtagaatttactttcaagtcagctccacyaggaatagtttaaagatctcataggcatctgtaaagaataacaaacgttgcctatatktacagccatacagtcttatttttaaggtttgatctatgcaaatacagtattatatatacttcatgtaatgtgtaacatgtagattataaagtatatgaataacttttcaaaggaacacaaactcttcacaggacagtctctggtttcagtgcaatacagtttggatctgagtggatgatgaattataagccataataatctgacactgtgtcaagagcaaatttgtgtatatatatatatgtacatatatatttatgtgtttgcctatatatgtgtatatatgtgcatgtgtrtatatatgtatggggtatatatatatagtatgtatatataagtgtgtatatataggtgtgtgtatatgtatatgtatgtatatgtatgtatgcatatatatgtatatgtgtatatataggtgtatgtatatatgtatgtgtatctgtatatatataggtgtaggtatatatgtatgtgtgtctgtatatatacatgtgggtatatatrtgtgtgtgtgtgcgygygtgtgtgtrtatatatatatatatatatttatgcatgtgtaaattgaaaagtaagcagtccaaattttcccttttacagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaaggtaaggagaaggcaggtgctctccacaaaggcaccccctgccttggcaaagagttgtgccaacaggtctgtgtgggccgtgagagctgggccggtagccctcccttattgccactggctcagtcacctccaaggacccatggttctttctggggcctttcctccttaatattaacaacagccaaaatttatttggcacttacagtgttctagggactgtgctaagttgcctaygtgcattatctcatttaattcttacagcaggctgatgagttagagactgttaccacactcttgtttaccagtgagggagctgaggcacagaggggtgggtaactggttacataattagtcaagggtgtgtgcaggatcaggatttgggcccaggtagttggagccaggttcttaactgaaggctagagtgtctccctcacctcctaggcagttaaggcactacgttgctacgcactgccaggtccactatcatgtgacctgatgtcaagcatcctctctcttgctctttctttttttttwaaattagtagatgttatttttagagtagatctatgcctacagaaaaataagcagaaagtacaaggagttcccatatactccccttcccgtcccaggcctacagtttcacctgttattagcatcttgcattagtttggtatgtttgttacaattgatgagccaatactgacatattactattattattattattattattattattgttttagagacagggtcttgctccattgcccaggctggagtgcagtggcatgatggtagctcactctaacctcaaactcctgggcaggctggagtgcagtggcatgatggtagctcactctaacctcaaactcctgggctcaagtgatcctcctgcctcagcctcccaagtagctgggactaaaggcacacagcactatgcctggctttttttttttttgtaaaggtgggatctcactgtgttgtccaggctggtcttgaaatcctggcctcaagcaatcctcagcctcagcctcctgaagtgctaggattayaggcatgagccaccacacctggccttcacaatttacgttacggttcactctttgtgttgtacatttatgagattttaatacgtacacatatatgcttcaaaattttgaattatgcagatactattttatagtacacattatatataagtattttattttatatgataagggttattatattattttatttatatagatttttaaggcacaaagtttaaataagagtagcagttttctctgcaggtgaatggagttttagcttcctctctgctccctcacctctgcttagctggctgaggcctgttctccctttagtccctccctggcttccattctagctccaccccgcctggcctcaacccttggccaggaaggaagaaggggctctttgaaggcctggatcacttgctatatatccacatgggcctcagtgatttgctgactttccaggggaccatccagtctccagcttgctcctttggttgccattatgttttagccaccactttattaactgaattataattcctgtccttcttcttctttggtgcattaytctctctgttttttttctttccattttatgctttgatctttcagccattatccagctgtcttggattttacctttcgttcttaaaacgccctccaataaacatcaattattttcttcttcttcttctttttttatttcaataatttatttttcttttttttaattatacattaagttttagggtacatgtgcacaatgtgcaggtttgttacatgtatatacatgtgccatgttggtgtgctgcacccattaagttgtcatttatattaggtatatctcccaatgctatccctcccccctccccccaccccacaacaggccctggtgtgtggtgttccccttcctgtttccaggtgttctcatggttcaattcccacctatgagtgagaacatgcagtgtttggtttgttgtccttgtgatagtttgctgataatgatggtttccagcttcatccgtgtccctacaaaggacacgaactcatcattttttatggctgcatagtattccatggtgtatatgggccacgttttcttaatccagtctatcattattggacatttgggttggttccaagtctttgctattgtgaatagtgttccaataarcatacgtgtgcatgtgtctttatagcagcatgatttataatcctttgagtatacacccactaatgggatggctgggttaaatggtatttctagttctagatccttgaggaaytgccacactgacttccacagtggttgaacttgtttacggtcccaccaacagtgtaaaagtgttcctatttctccatatcctttccagcacctcttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcacatcctttgcccacttgttgatggggttgtttgattttttcttgtaaatttgtttgagttctttgtagattctggatattagccctttgtcagatragtagattgcaaaaattttctcccattctgtaggttgcctgttcactctgatggtagtttcttttgctgtgcagaagctctttagtttaattagatcccatttgtcaattttggctttcaattattttcttcttaaagtatagaactaaagaaaatgaccttttgagttttggaaatgattttttttttttttttgagatggagtcttgctctgtcccccaggctggagtgcagtggcatgatctcagctcactgcaagctccgcctccygggttcatgccattctccttcctcagcctccygagtagctgggactacaggtgcctgccacgacgcttggctaattttttgtatttttagtagagacgggctttcactgtgttagccaggatggtctcgatctcctgacctcgtgatccacccacctcggcttcccaaagtgctgggattgcaggcrtgagccactgcgcccagccgcatctctctcattttttaaaacagctaaaatggatgcattcactacctatgaccctagggcatggctcagagttagttcaaattcccattaaaaaaaaaaagtaactttagctttaatttaattttctaaatctgatgccattcctagtacatgaatattctggatttcctcgtagagaaattacaataagcattcaagaaatatgtgtaaaaagctttctaattttatattcatttcactattgtgtatgcaacatcatgatccaggcatttgtttctataaatctactctctaacttaaggttgggtgcggtggctcacacctttaatcccagcactttgggaggctgaggctggcacatcacttgaagccaggagtttgagaccagcttggccaacatgatgaaaccctgtctctactacaaatacaaaagaaaatttagctgggcatggtggagtgtgcctgtaatcccagctactcgagaggctgaggcacgagaattgcttgaacccaggaggcagaggttgcaatgagcgacgatcacactattacactccagcccgggtgacagaacaagattgtctaaaaaaaacccaaacaaacaaacaaacaaacaaaaaactactctctaacttaaaatgaaaaaacagaaccctgtcctcataaatttcagtgcacatggaacactgttataggctggggaggaggaggacacagctgggtggctgctgggtctcctgagtcacataccaaaaacttctgggccatctttgatgttccacccagactgctttgaarctgggcttatcataacaccttatgttttcaatngagccaggtcttttacagttggaaataaataaaaataatttcttttcatttttgtccttcagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagygaagacacatctgatttctctggaatgtcagagaccaagggagtggccctatcaaatgttntccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgcyttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctahaaatcamcaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccrtgttgcaggttcatggattacttctctataaaaaatatgtatttaccaaaaattttgtgacattccttctcccatctcttccttgacmtgcattgtaaatagsttcttcttgttctgagattcaatattgaatttttcctatgctattgacaataaaatattattgaactacatgtcttgttttttttttcctattaagttagactattttgaaatagaaccaagccgtgcgtttacaaaagcatccctgaagcaggcagatcacaaggtcaagagattgagaccatcctggccaacatagtgaaaccccgtctctactaaaaatacaaaaattagctgggcgtggtggcgcccacctgtagacccagctactcaggaggctgaggcaggagaatcgcttgaacctgggaggcggaggttgcagtgagccaagatcaggccactgcactctagcctggcgacagagcaaaactccgtctcaaaaaaaaaaaacaaaacaaaaactcaaaacataaaaacaacaaaaacaaaacaaaacaaaaagaacaaaccccaaaaaaccccaaagcatccctgtaggtaaaatgctcttttgaagattgaggcagactaaaaagaaataagaataattacttcctcttttcccttgttttcctttcttcctagccctcagctctgacttctttctcccacactcctttcatcctagggagtaaaagaccagggcagtgctagaatgactctcaactgcataaacatctataatggaatcagacaccttgggacatagagatcttcccagcccttttcactctaaacccaccctcaaaagtcattatattaggacactgtatgtgcttaaaacattgtttcttcttatgaagagtgtttttctcaatgccatgcacatttgttttaaattagttatggtgtccctgaacctaatattcaacatagcctcttttctgtccctattgtgtgcttgaactaaacgtgtctcctctttcaacaaatgatgagtacaaaagctgacaaatgcccccacatccttaaaagattatttgtgtgggattgctgggggtggtcaaagccagattttgcccgcttggttcatcatccctcttatccaggctatgaaatacaaaatgtgagatgactgtgaaaaacattagtgagtttttagaggaagggagagatttgtgcctctttaaaccaagaatgcagggagcttaaagtgtctcctgcaatttggaaaacactgaaaattttggtcatcttatctgggacagtcttaattcagtgatttttcaaccaggggaaattctgccccctaggggacattttcattgtcacanctggggtactgtcatctagtggatagtctggggggttttgtctaggatgaggaggaagatgaaagagggtcggtttggaaaggaagaattcagtgcattctgcaagcaccctgcccagcccagctcactagcaaactggtcacaggtatattatctcattttgtcctctccacagacctttcaggaggaaaccatgatcccatcttataaatgaggacgctgagacagagaatggatagacaacctactcaaggtcacagagctaatgcatgttggtggctatatttgaactcatgaagacagactccagagctggacttcctaacctctctgctccatgccctcttccaactgacagcgatccctgacaggggtcactgaatgaacctgaaagaattcctctcttccagaccttctctatttaggaggagttccaaatatttgtcatatcctggcagtcctttccttgtcaactaaaacatccctagagtcagagacagtccaccagtaaggggcccaattactgcctttgcttattctcacagtgaccctgaagttaagggccatgcctatctattttatgaggaaatatgggcttagaagaattggataatgcctccaaatgggtaaatagcagggcttggatttgtgaacattatgactatgaaaacatatatttagttatttccttactgatgaatattcagctagtttctggtttttctgttatagataatattactatggacacctctatacttaatcatctgtaattattattattattattattttttgaggcagtctctctctctgttgcccaggctggagtgcagtggtgcaatcttggctcactacaacttccctccctcccaggttcaagtgattctcatgcctcagcctcctgagtagctgggactacaggcatctgccaccccacctggctaattttttgtatttttagtagagacggggtttcaccatgttggctaggctggtcttgaaatcctgacttcaggtgatctgcccgccttggcctcccaaagtgctgggattacaagcgtgagccactatctgtttaagatttctaaaatctttgtgattgatatgttatgaatatatcacaatttattcattctactcttgatggacatgtgggtatttccaggtttgggctattacaaatagtaccattgtgaatattctagtacatgttttttggtgaaatatgtgtgcattcctgattgttacacacacacatatatatattatatatatatacattttatatatatataaaatgtatatatatattttagtggttttcccagtgcctctctatctttcattatgattgtataataattatgagtgattactttttccaactatgactcctaccatcaccactgccattcttggagaaattattatgagccagacactttgctagacatgacatatgttataattcagcttccacagcaaccctatggggcaccatttgaggtgaaaggtgctaaagttcagacatgcgacacaaaaaagcttgctgagcacagatggctactgagttatatggttaggacttaaaccccagctctctgactccacagtccatactttttaatcactatgatttgattatattacaaaacttacttgtatttggccataaaaaagaattaaatcatgtcatttgcagaaacatggatggaactgaaggtcattatctgaagtaaaataagacagattaatcatcttaggtgaaataacccacataaaaagacaaatattaaatgttctcacttatatgtgagagctacgatatttgatcacatggaggtagagtgtggaaagatagagatcagagactgggaggggtgagctgggggaggaggggaagatgaagaaaagtggcttaaagggtacaaacatatagtgagatcgaaggaatagagtcaatgtttgatttcagagtagggtgactgtacttaacaaaaatgtattgtacttgggtgatggacagccacataccctgacttgatcactacacattttacacatgacatggaacaaaatttcatgtgtgcccatacatttttacaaataaaaaatgaaagagacctaaagtccctttagcctgtttagtgttggttgctttgcatcaagaaattgatgattcataggaaaaaacaaaacaaaaagcttcaagggcagattttcctctatgttaaaaatgaaatgttatgttgaatagaagacaaatgaatgtagataaaaataaaagttaaatgtttacataataagtaaacattccataaatacttgcttttcaaatatgtctggttaaatgtaatttttggaaaattctgtttctttctcaggagtcctgttcagtcaactgtatggcatttgtgatttatatcagattaaaaagacttcccttctaagttttagctcttggactagaaaccactagcacaacattcttaccctcaaccccaccctacagtcatggaagatttaggtgatgggcgtttccctgttcttttgtccttgtcaccatcctctgccagacagtaacagctgcttgagtttgtgaaagctttttgagaaaagagatcaaactgtttcactaacggcaaatgactattcctctcccaaggcctggaacagacaaaggaaatggcattattctccattagagatgagatagatacagacgtgtccctggaacttctgaccgcatttgaggagtcttgccagttgcacgtggcctgaaatgacagccctccctgtctctatcacaggctgctttgcacttctcacatctcctgggacaggatctatcacacagtaaaataaataccaaggcatattttcaatggatggaaaatagagtttgaatgggcaggtgatctatgtgtttgtgttggttgcctcttgcatctaatgagggcttctctgatgacataaaacaagatcgtcttgtgtttctgaaagtgtgtctggaggaacagtagttgtgtagggtatgagaagctgctatgaaataggagtccgtggttgaaaaatcttgaaaaagctgttttgaaccaaattaaacaggttctgcagtactcttcaagctttcaagaagttgatgtggccgggcgcagtggctcacgcctgtaatcccagcattttgggaggctgaggcaggtgggtcacctgaggtcaggagttcgagtccagcctggccaacgtggtgaaaccctgactctactaaaaatacaaaaattagctaggaggctgaggcaggagaatcacttgaaccaggaaggcggaggttgcagtgaaaggagattgcaccattgcactgcagcctgggcaacagagcaagactctgcctcaaaaaaaaaaaaaaaaaaattgacgcagttgacgtcttttctgaatatctggaggagggtacagtgtctcgttccttatttattttattttatttttagagacggagtctcgctctgttgcccaggctggagtgcagtggcatgatctcggctcactgcaagctctgcctctcgggttcacgccattctcctgcctcagtctccagagtagctgggactacaggtacacgccaccacgcccggctaatttttgtatttttagtagagacggggtttcactgtgttagccaggatggtctcgatctcctacctcacgatccgcccaccttggcctcccaaagtgctgggattacaggcagtgagctaccgtgcccgtcctggtttcttaaatttatacgacctctaaacctggtagtcaccctgcatcttggaggacaattgtttagtagagtgagttttgggaaaagtcaacttagctgggaaatagacttagtaagaaaaatcaagatttttccggttgccatgtggatactatggaaagaaccctggtgtgggaggaagccctggattccagcaaccaaaccactcctatcaatacctgtatatgagggagggagggtctttatctcagggatttctgagattcctcttgaagctaatagttcacggggcccaaacaaatcctccatcctgagccatccctcacccatccatctatgtggagacggctgccatttccatccctaaaagcatggtcaagggtctgacactcctctctgacactaggaacaaaggttgtcctcccaaaggtgaagaggcatgattgctatgtgcgccgcccccctccccccaactttggcaggaaaatgagaacaagtgaggcaaagactcacttgttatgtcaattctaggaccacatattagtggtgaaatgactttttctttccagcaatcccaaagttactgagggaggtaggaaatgtcaagacaatgcaaccaacttctcttccacaccatatagctgcttttcccctgcccaaatataaacacagacttgcctctttcttgcaggctgcctagtcttttactgtttattcaggctgttgcccacacgagcaccattgcatacaggtgtgtaggtagatccctgcacaaggatatcctacagagatggttagagggagctgaagtcaagcttgtagtccacttgcatagcagggctccagggtgtggggctgtgcctgtctgagaaagggtcacctcttttgcattcacaaaaagatagggtataggctagcagtggccctgttcagtactcagaaaaatttgcagaagaaaaaagagcatcattacatcttcagtactactatcattaccattactgacatcatcatcatcaattcgatatgttaccttgctaaga

SEQ ID NO: 10728 - DNA, 21250 bp, Homo sapiens
tcccttctccttccctccctctccttctcctcccttctcctaaaaaaggccgtccttttaaaagcctgttccagtaacttgtaacagactccagaacactcctaactctggttggtgtgtcttcccagttcaatcctcacatttggcttccaataaatgtttttcaaattatttctgcctcagcagccttagtttcagtagacaaggcttaaagtgggttcagttaaagcaaactaataacacttgaccctttccaacttttcttcctctcagccatgggtccttaagccatcttttttggatccagagccaaattatatttctatgcagccaccatggttctagcccttatctagctttcaaagatttttccttgatcgccccaagcaaatttcctctgctctgttcagtttaaaagtgtttctattctttttttaaacaaaaaacaaaaggaaaaaaacagctttatcaagatataattcatataccataaaaatcaccctttaaaaatatacagttggtttttttttttttttttggtacattaacagaactgtgcaaccattgccattaatttcagaacattttcatcacccaaaaagaaactcctggctgctctgcctatggagtagcccttctttattcctttactttcttaataaacttgctttcacttttctcaatggactctccccaacttctttcttgtgtgaggtccaacaaccctctcttggggtctggatcaggacccctttccagtaacatcttcctggcaaaccatgaagcaactaaactgaggagactcccaacccaaaggaaatagaccgaagcaccacaattggctgactttggaatcaagaaaacttttcctttgagctatttatagcttttaaaaattgagtaaagtatattcctgtgaacaaactttggagcatattagtctctctctacctgttttctctagaatttggaaactatatcaccttttgtcagaactcaagagttatgagtggccctcaccatactgatgctttctgactaagctcctctctactctgaatacaagagcccctcatagttaggcaggaatataattgcccctattcatcctgaaaaagtgacagaaaatggatcttcatccctctacaacccttaggattaagggttcccttgtaaaagggtgggggaatatgtcagaggcgtttgaactagagcaactccatctttaataggggctgggtaaaataagactgagacctactgggctgcattcccatgaggttaggcattctaagtcacaggatgagataggaggtcagcacgagatacaggtcataaagaccttgtggataaaacaagatgaagtaaagaagctggccaaaacccaccaaaaccaagatggtgacgagagtgacctctggtcatcctcattgttcattatatgctaattataatgcattagcatgctaaaagacagtcccaccagcgccatgacagtttacagatcccatggcaatgtccagaaattaccctatatggtctaagtcggggaggaaccctcagttctgcgaattgcccacccctttcctggaaaactcataaataacccaccccttgtttagcatataatcaaaaatgaacttaattaagtattatcagtagagcagcccaaactgctgctctgcctatggagtagccattcctttattcctttactttcttttttttgagacggagtttcactcttgtcgcccgggctggagtgcaggggcacgatcttggctcaccacaacctccgcctcttgtgttcaagcgattctcccacctcagtctcccaagtagctgggattacaggcacccgccaccacacccagctaatttttgtatttttagtggagacagggttttgccatgttggccagctggtctcgaactcctaacctcaggtgatccacctgcctcggcctcccaaagtactgggattacaggcatgagccaccacacccggctcctttactttcttaataaacttgcttttacttaaaaaaaaaaaaaaaaaaaggaactcctcatccagtagcagtcgctcctcattccaccatcctcccaagcccctggcaaccactaatctctctctctctttaaagatagagatgggatctctctatgttgcccaggctggtctcaaactcctggcctcaagggatactcctaccttggactcccaaagagctgggattataggtgtgagccaccacgcccaacctactatctctctttataggcttgcctattctggacatttcatataaatggaaccattcagtatgtggtcctctgtgtcttgacttctttcacttggcacaatgttttctcttttttgagacagggtcttactctgtcacccaggctggagtacagtaagtggcatgattgcagctcattgcagcttcgagatcctgggctcaagcgagcctcccacctcagcacccccaagaacctgaaactaaacacatgcgccaccatacctgggtaatttttaaaattttttgtagagacgagatctcactacatggcccagtctggtctcaaactcctgggcttaagcagtcctcccgcctcagcctcccaaagttctgggattacaggcctgagccactgcaccccgctccttttaatctttttaggaattctaagtcattgagagtagactgtattaagaatggagtcccactgttagattgtggaaattcctcccagtcaccaaaaggcttgtctcctttcaaagctgatgctgacgggtgcctatggatgcttatggatgcttattgtgcctaataagctcctgttttgagctgagagatgtttcaaactttaagcttattttcacagggtacaagctctagatcatggagtcattactatgatgtcctccttccttccaagggaatggttttccagtctgcaagccacattataatattaaaattattggctgggcatggtggctcacacctgtaatcccagcactttgggaggctgaggcaggtggatcacctgaggtcaggagttcaagaccagcctggccaatatggtgaaactctgtctctactaaaaacacaaaaattagctgggcatagtggcaggcgcctgtagtcccagctacttgggaggctgaggcaaragaactgcttgaacccaggaggcagaggttgcagggagctgagacggtgccactgcactccagcctgggcgacagaatgagactgtctcaaaaaaaaaattaaaattaaaaataaaaattatttcacagattttatatacacgtgtttttgtaaacacacagaatatctttgaaaggatataaaagaaactggtacaaatggttgggggacaggtgtagaaggctcactttctggctgggcgcggtggctcacactttgggaggccaaggcaggtggatcacttgaggtcaggagttcaaggccagcctagccaacatggtgaaacctgtctctactaaaaatacaaaaattagcccggtgtggtatcgtacacctgtaatcccagctactagggaggctcagacacaagaattgcttaaacccagggggcagagattgcagtgggtcaagatcacggcactgcactccagcctgggcgacagagccagactccgtctcaaaaaaaaaaaaaaaaaggaaaaaaaaaagctcccttttaactgtgtattcttttgtaaatcattaaaagtaaataaaaataattacttcataaataccaaacaataacttttgctagaagtatgaggcttgtttattttaaagggacatcttgagttataacacactaacctttcaaaacacacatattttcattcctcaagcctttgtttctgctgttccctcagcttggattatccactcctccttactctccccacatctccctcaaaatctgacaatttatgtaatttttcagtttaccaagtatttttagatatacgattgaatttttgctttccaagcaaaaaagacacagtaagtattattattattttttgagacggagtcttgctctgtcggccaggctggagtgcagtggcacaatcttggctcactgcaagctccgcctcccgggttcacgccattctcctgcctcagcctccggagtagctgggactacaggtgcacaccaccatgcccagctaatttttttgtgtttttagtagggacagggtttcatcgtgttagccagaatggtctcgatctcctgaccttgtgatccgcccgcctcagcatcctaaagtgctgggattacaggcttgagacaccgcacccggtgttaagtataattattttcatcctcatataataaataagaaaactgaggttggaaaacttcacaattattaagcttcagagctagaattgaaatgtacttctaacaggtccagtgttccttctacttttttaagctatgaaatcctatacatttaattaggcaactggacaaaaatatacacaaaagagtgttatttacaatatccacaaattgtaaataacctatgtgttaaaaaatagaggatcaagttatggcacactcatacaaccattatgtaaagacaggcgctgtggcgtgcacctgtagtcccagttactcaggaagcagaggtaggaggctccctttgagcccaggagtttgagggtacagggagctacgatggcgccactgcactccaggctgggcgacagagccagaccctgtcacaaaaaagaaaggaaagaaagagagaaagaaagaaacaaacaatgaataaaagaaagagagaaagagcatcatactaaaaaatttatatattactactaataatagattaaatgcactttaaatgcttactatgtgctgaatactgggctaaatttattttatatgtattgtctcatttaatcctcacaaccaccaatctgcccaaagccttgctgttaataatgcagcagaacttgactggtattaaaatccaaagctcaggctggggacggtggctcacacctgtaatcccagcattttgggaggcccaggcagggggatcgcctgaggtcgggagttcgagaccagcctgaccaacatggagaaaccccgtctctactaaaaataacagaattcgccgggcgtggtggcgcatgcctataatcccagctactcgggaggctgaggcaggagaatcgcttgaacccgggaggtggaggctgcagtgagccgagattgcaccattgcactccagcctgggtaacaagagcaaaactccatctccaaataaataaataaataaaaatccaaaactcacgatcttaaccactagatcacgctatcgcaagtacgaagaccgtttctttcacaatcacaaacatctatgggatacttctgaaaattctgttcaaacttctcttgcccaggtctctgtgttcctataacaatgtgtatctcttacagcacttgcttggatccatttatgtacctctcacagatcttatgctcctgcaggcctgaaacttaagcccactttctatttttcatagctcctggtgcagtgctttttactgtgtaggcgctcattagtattaaactgaatgtgcctttaacttggcttggggtacgttgaattgaggatgagcgctcacacaatattaagaatttctttccaagaaatgtgctcgggtcaaacacaaggcctttctgtccatgatccgcctgaaaccatggtttccttgttttcgcctttatcccttctgccttgccagtcctccccgccagcggggccgagagcccggcgactcttgcgtgaccgagcgggctccgctgcctacggcagcccacccccagcccctgctctgaggcaccgagaaacgaggaggcccgtggcgagtctccacgtgggtaccggcgctctcggcgcccgtagccacccgcccgccggaagccgacatctcgagttctggcagaagcaatytgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggtagtaagcgctacgccaaaagcctgcaccgcagtggcggtgatgcctgtgctggctgtgtgtggggaagggagttggggagctgcgggccggagggaggccccactgctcctcaccggcttcttgctcctgggcgcgaggagccgggcagcttgggaccttagccctaatcgtcaccccgtacttgggatgggaagtaccgggaagttaccktaggtagcgtagtttcctcttgctgaaaacagggtccggttttcacaaatgtgggaaatttggcttcttttgctaattgctccctcttgsccgctcgcgtgctagcatgttaacccctctttctttcaccaggagcagttggttctggtggaattatcaggaattattgattcagacttcctctcaaaatgtgaaaataaatgcaaggttttggtgagttttctagacttggggggattgttctagagtgtcttaaatgtaaaacaagaatcaatggtgaaatacctatccgcaagtattgatatatttatttcaccttacaaagtagtgaactctaaggataagaagtatactaagtataattaattaatatgtaattaagtataatgtagaagtacagcggggactatgggagcagataggagaaaatggctaactttgcttgcctgtttgaatgtgtggctgaagagaaagttacagatttggaggaagtaacattgtgatatggaacmgtacatatattcctgtattctcagcactttgggaggcagaggtgggaggatcacttgagcccaggaattggagaccatcctaggcaacataacgagaccccttctctaaaataataatwaaaaaaaatggccaggcgcggtggctcacgcctgtaatcccaatactgggaggccgaggcgggtagatcacgagsycaggagttcgagaccagcctggccaacatggtgtaaccccgtctctactgaaatacaaaaattagccaggcatggtggtgggcgcctgtaatcccagctactcgggaggcygagacaggagaatcgcgtgatccctggaggcagaggttgcagtgagccgagatcgcgccactgtactccagcctgggcaacaaagggcaaaactccatctcaattaaaaaawaawaataataataataataaattagctggggatggtggcatgcgcctgtggtccctgctgctcaggaggctgaggtgggaggattgcctgaacatgatcatgccactgcattccagcctgggtgacagagctagacactgtctcaaaaaataaatagatgacagatagactctttgcactactgttgacaaaacttcctctgtttttagcttactcttgaacaggatgttgattgaaataaaccttgttacttgagtatgaattaagtagtcttcaggttgtaactgctgtgatcagagcagttgtagtttatcctgtacttggtaggacaagatgctctagaggttccccagttttggagattagtttccttggtagcaaggttacaatgttgaagcctttttctaatkatgttttttttttatgatcctttattctgttgtagggcattgacactgagaggcccattctgcaagtggacagctgtgtctttgctggggagtatgaaggtaggaggatgtcagatagatggaactctttctgatatgggcttttcagagatggtagctcttctcaacaatttgcctttgtatttttctgcagacactctagggacctgtgttatatttgaagaaaatgttgaacatggtaagtgattgctagcccagccctttttaatacgaactatttcaatcatacttaagcataataaatatctcatgtatccactgtctagctgtatcatatcctatcattttcccaaacgtgactcagattatagttaaaaaaaaaaaatgccaggctgggccaggtggctcaatcctgtaatcccagcactttgggaggccaaggcaggcaggttacttgaggccaggagttcgagaccagcctggccaacatggcaaaacctcatttatactaaaaatacaaaaattagctgggtatggtggcatgtgcctcccagctactcgggagactgaggcacgagaattgcttgaacctgggaggtggaggttgcagtgagccgagatcgcaccagtgcacttcagcctgggcaacagagctagataaactgtgtctcaaaaacaaacaaaagaacccattccagatacatttgaagtccttctatccccctttccaaacttacttctttccctctgtcttcagagatgatcactctcctgaattctttttttttttgagacagagtctcactctgtcacccaggctggagtgcagtggtgcaatcttggctcactgcaacctccacctcccaggttcaagcagttctcctgcctcagcctcccgagtagctgggattacaggcgcctgccaccacgcctaggtaatttttctatttttggtagagacrgggtttygccatgttggccaggctgatctcaaactcctgacctcaagtgatctgcctgcctcggcctctcaaagtgctgggattacaggtgtgagccaccactcctggccaaggaataaaagaagggctacttcatakrcagagcagcctactttctaaagtatggtatcaatttayactcacagtagcaatgtatggaagtgtctgtgcttcatatccttggctcaagggccttatcctccgtcctgcctaggcatacagttttctgaaagtttcaactccaggcagcaggttggcrgcaatttttttcctcaggctttcatgattgagaatgtccctactccatactttggcttcaggtagtaagtctgactttggtccttaatttgattggtagaattttagatcccaatacgctgtagggtaaaattcctggccccaatttccatttcaaggatgaagcctgttagacctatgggtttaayctcactcataactctgtgtttctgtcccttgaagatgtttgttacttttgaatccagttgtgctttcaactrttaacgtatttttttttttttcttgagacarttttgcttttgttgcccaggctggagtgcagtggyrcaatctctgctcactgcaacctccgcctcctgggttcaagcatttctcctgtctcagcctcccgagtagctgggattacaggcgtgtgccaccatgcccagcgaattttttgtatctttagtagagacgggatttcatcatgttggccaggctggtctcaaactcccgacctcaggtgaaccactcrcctcggcctcccaaagtgcagggattacaggtgtgagccaccgtgcccagcctgttaatgtattttatctatcatttttctatgcttggagcaggagggatgagttataccttgaatttactacactatcttgacaggaagtagtttaatctgactccctacactggaattactaaggcttcatctttgttttatttgatggcataagaagtataataatgttgttcatttctgttcyagctgatacagaaggcaataataaaacagtgctaaaatataaatgccatacaatgaagaagctcagcatgacaagaactctcctgacagagaagaaggaaggagaagaaaacataggttagttccmttattctctgaaaacaggtgatccagtactggctttgacaatgatacattgatgccaggatagtccttgtactttttagtaataactatacatgatttttgttttttcagacagtcttgctctgtcacccaggctggaatgcactggcacaatctcggctcactgccacctccgcctcctgggctcaagcaattctctttccccaggctcctgagcaacagggattacaggcacccaccaccacgcccagccaattttytttttttttcttttttcttatccagacgaagtctcgcactgtcgcccgggccggagtgcagtgtcgcgatctcggctcactgcaacctccgcctcccgggttcaagcgattctgctgcctcagcctccggagtagctgggactacaggcacgcaccaccagggccagctaatttttgtatttttagtatagacggggttttacagtgttggccaggatgctctcaatctcttgacstcatgatccgcccgccttggcttcccaaagtgctgggattacaggcgtgagccaccggtgcctggccacgcccggctaattttttttagtagagaccggattttaccgtgttggccaggctggtcttaaactcctgacctcaagtgatccacctaccttggcctacaaagtgctgcaattacaggtgtgagccactgtgcctggcctcataatatgtttaatatattaaaattgagggtactccatctaaagtaccaagcagagttaaaattcagttgaactctcatatagcttagggcactggggacatagaaatcttttatctgcttggcactggaaatgactgaggagtttttgaagaaacttggtatctaagccctagggaattcagtagtgcttctctgtctctctcttctccttctccctctcccctctttaattaaaaacttccttgtatctttttgtagttcataagcatgatgattatgtttttacattcatgtgtaagatgtgcctccctcaaaccttgttatgatgtcagcatattacctgtctgatgtgtggggggaaaaaacttccttgtgagcaaagtggataygatcacaatagttctgaattcccaaggtgaaatcccctggaaacttctggcagctgcagcagccttcaacaggctcacatctggaaaaagctggcttttttttttttttttttggagacagtctcgctctgtcactcaggctggagtacagtggagccatcttggctcactgcaatctccacctcttgggtgcaagcgattctcctgcctcagcctcccgagtagctgggattacaggcatgcaccactaggcctggatgatttttgtatttttattagagacagggcttcgccatgttggccaggctggtcttgaactcctgacctcagatgatcaacctgcctcggcctcccaaagtgctgggattacaggtgtgagccaccgcccctggccaaaagctggctttaaatgtgggggagactgtaggaccacagttgttagtcctcagtctagtttttgttattattattaaattattttatttgagacagggtctcaccctgtcacccaggctggaatgcagtggtgcaatgttggctcactgtgacctctgccccccatccccctacctcagcctccccagtagttgggaccacaggcgtgttccaccatgcctggctatttctttttttgtttttgttttctttttttttgagatggagtttcactccgtcgcccaggctggagtgcagtggcgcgatctctgcttactgcaacctccacctcccaggttcaagcgattctcctgcctcaccctcctgagtagctgagactacaggcgcatgccaccatgcccagctaatttttgtatttttagtagagacagggtttcaccatgttggtcaggctggtctggaactgacttcatgatctgcttgcctcagcctyccaaagtgctgggattacaggcatgagatgctgcacccrgcctttgtatttttagtagagacggagtctcaccctgttrcctgggcttgcctagaactcctgaagagaccactgtgcccagcctttcttttccttttgacgtttttctttttttctttcctggagacagagtcttactccatccsccaggctggagtgcagtggcgtgatctcagctcactgcaacctctgcctcccaggttcaagtgattctcattcctcagcctcctgagtagctgggattacaggtgcccaccaccacgcccggctaatttttagtagagacggagttttttttcttttttttttttttggagacgaatttcgctcttgttgcccaggctggagtacagtagtgcgatctyggctcactgcaacctccgcctcctgggttgaagtaattctcctgcctcagcctcctgagtagctgggattacaggcacgcaccagcacgcccagctaattttgtatttttagtagagagatggggtttctccatgttggtcaggctggtctcgaactcccgacctcaagtgatccgcccacctcagcctcccaaagtkttgggattacaggtgtgcaccaccgcacccaaccttttttttttttttttttttttaaatagagacaggatcttactatgttacccagctggtctcaaactcctgggctcaagtgatcctcctgcctcagcctcccaaagtgttgggattacagtgatgagttcttaatttgcatccacttattcttcttcacttgctagtcaccacatactagagacttttagactagtgcttctttcacctgaagcagacacgtttgtggagttgaaaaaataataatttgatggtttaaaagttcactgctcaacaacatatttgaaactctagtaaataagattctcatgatgagtatagcttaacaaggaataaacatttgaaggtacattgatcttataaaattaattgtatcatctatatacaactatataataaacccttgttcctattatgtatatccctgaactatccccttttttaggcaccttgtaataattataagaagaaagaggtactaggttctagaataaacttgaaaggctgacttgtatcataagcttagctatcattgggatattcttattagagtgagtttcctcttcctagtctttaataatctgacagatctttgggaatatttgggtgttttgtttagtcaagtaaatgagcaaccaacaattcgagtctgcattggttacctactgctgcataacaaattatccctaaacttgacagcttaaaacaacaacaaaaaaccagtatcttacagtttccgtgaatcaggaatttgggagcagtttaggtaggtggttctggctccaggtctctgataaggttgcagtcaaaatgttrtctaggctgcagtcatctgaaggcttgactaatgctggaagtaaaatggcttattcatatggcttgtaaatttgttttggttgttggcaggaggcctcagttccttgacatgttgtcctcctcacaagactgtttgaatgtcctcctgatatggcagctggcttctctcagataaagtattccaagaaaacaaggtagaagccacagtgtcttttatgaactagccttagaagtcacagtcttggctaggcgtggtggctcacacctgtaatcccagcactttgggaggccaaggcaggtggatcacttgaggtcaggagttcaagaccagcctggccaatatggtgagaccccccatttccactaaagatacaaaaaattagccaggtatggtggcatgcacctgtaatcccagctactcgsgaggctgaggtgggagaattgcttgaacccaggaggcggaggttgcagtgagccgagatcatgctactgcactccagcctgggtgacaaagtgagactccatctcaaagaaaaaaaaagtcacagtcttgtcatttccacaatatcctattcagtatgggacaggactacacaggggcatgaataccaggaaggtgaagatcattggggaccatcttgcagtctggctaccaaacacggctacatgctggaggcaaaacaggacagaggaagtgtgaccsttaccttctaggaacttgcattctaaagtaaattacattgaaacagacatggatgaataagagtgaacatcaaattcattctattttaagtactgtgctaaataacagaataaaggaaagcttcaagattttgagtctggctgactaggagaacgatgttattgcgggaaaaaaatatgaatatctatagttgaagctgaattggaagaaaaaggactaataaccaggcgcagtgggtcatgcctgtgatcccagcactttgggaggtgaggcgggtggatggcttgaagtcaggagttcgagaccagcctggccaacatagtgaaattccgtctctattgaaatacaaaaattagccaggcatggtggcacacacctgtaatcccagctactcggggggctgaggcacaagaatcgcttgaaccagggaggcgraggttgcactgagccaagatcktacccactgcactccagcctgggtgacagagcgagactttgtcttaaaaaaaaaaacattgtagggaagtgataagtttccttgaaggcatgagatggcagagagtgctcaaattatttcttagaatgagctgagaactgaactctggaaaaaggcatggaatagtaatcaaagttggtaacgtagtgattttgatggtacctacctaataggcattccaaggtctccagagaagatgcaaattatattttatcagtagttacagacaccatattccttggtttatgttaggctttcagtttgacatgtattcataggatagaaatttaaattaaagaaaaatatactaaaattcattttttgtttctttttttgtttattcctcatcccctccaaattaggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatayaccttctgagacagaaggttctgtttttatggaaactcaaatgctgccttagaaatcactcctagatgaaatgtttctcataataacttgtcaagaactttttagagttgttacataaaaataattgctgtgtagctttcagtcttttaatattttattgcattttattggctatacacacatatccagtcataacacaacttattgtaccagaatcatttgggaccagacatgagttggatttttaaaatacagtttaggctgggtgcagtggctcacacctgtaatctcagcactttgggaagctgaggtgggaggatcacttgagcagcctaggagtttgagaccagtctgcgtaacatagggaggccctgtctctacaaaaagttttttagaattagctggacatagtgtcgtgtgcctatggtaccagctactgggcagctgacgtgggaggatggcctgggactgggaactcgagggtgcagtgagctgtgtttgcacctctgtactctcgcctgggtgacacagtgagaccgtctcaaaaaataagtaaaatgaggccgggcgcggtggcttacgcctgtaataccagcactttgggaggctgaggtgggtggatcatgaagtcaggagatcaagactatcctggctaacacggtgaaaacccgtctctactaaaaatacacaaaattagccaggcgtggtgggggcgcccgtagtcccagctacttgggaggctgaggcaggagaatggcgtgaacccggcaggcggagcttgcagtgagctgcgccactgcaatccagcctgggcgacagagcaagactctgtctcaaaaaaaaaaaaaaagtaaaatgaaatatttttaaatgactttagggacccttctgagtcctttaaattcaaggttgtattaaggtaagtatataaagttttcctttgaggctgttacaaattactacaaactcagtgacttaacacaaatgtactctcttatagttttgtaggtgagaagtgtgacgcgggtcttacctgggctaaattcaaggtgctggcaggaatgcattcctttatggaggttttggggtagggggcaaatccatttccttgtttatttagttgttggcagaattcagttctttgcagttaaaggatcaaagtctcctttccttgttgtctgttagctgagggtcatttctagcttctgaaggctgccttcattccttggctcatgatccccttttcttcagagcctgcaatagtgggtgaagtccctctcccattttgaatcattcctgttacttctatcatccctctctctgacctacccttctgtcttccatttccactgttaaatgtctatttgattactctgggcccacttggataatctccctttttttttttgagacagtctcacgctgttgcccaggctggagtgcagtggcaagatctctgctcactgcaagctccgcctcccgagttcacgccattctcctgcctcagcctcccgagtggctgggactacaggtgaccaccaccatgcctggctaattttttttttatttttagtagagacggggtttcaccgtgttagccaggatggtctcgacctcctgacctcatgatccacccgcttctgcctctcaaagtgctgggattacaggcgtgagccaccgcgcctggcctgataatctgcctattttaaggttgataactttttttttttttttttgagacagagtctcgctctgttgcccaggctggagtgcagtggctcaatcttggctcactgcaagctctgcctcccgggttcacgccattctcctgcctcagcctcctgggtagctgggactacaggcgcctgccaccacgcccggctaattttttatatttttagtagagacagggtttcactgtgttagccaggatggcctcgatctcctgacctcatgatccacccgcctcagccttccaaagtgctgggattacaaccgtgagccactgtgcccggccaacttttttttttttcttttgagacaaggtctcgctctgtcacccaggctggagtgcagtggtgtgaccacagcttactgcagccttgaactcccaggctcaagcaatcctcccacctcagcctcctgagtaggtgagactacaggcacgcaccaacatgcctggctgtgttttttttaattttttttgaagagatggggtctcattatgttgcccaggctggtcttgtactcctgggctctagtgatcctcctgtcttagcctctggatgtgctgggattacaggcatgaaccactgcacccagccaaaggtgtataacattaattctggccaggtgcagtggctcacacctgtaatcccaccactttgggaggccgaggtgggcagatcacaaggtcaggagattgagaccagcctggccaacatggtgaaaccccatctctactaaaaatacaaaaattagccaggtgtggtggtgcacacctgtaatcccagctactcaggaggctgaggcaggagaattgcttgaacctgggaggcggaggttgcagtgagctgagattgcaccactgcactccagcctgggtgacagagtgagactccgtctcaaaaaaaaccccaaaaaaccaaaaaacattaattccatctgcaaagtctcttttgctaggtcatttaacatacacaggcattaatactagggattagggcatggaaatctttggggcctatttttagtctacaacaaagtattttatcaagaaaaataattcccacttgagaaagattattggaagtcagctgtattagtcattttattatggcagtaaaataaatctgtgctagtttatattttttaagtaaattattcactctttgatactttgatactttgttgagctgtgtaaaattgctaatatttgattgtttccaactacaaaacaacagcaatttcctatagtttaacctagtaccagtaagttaaaacatacctcatgttaattacatctcacaattgatggagatatagctattttaacagattaaagagctaatgttctaggatgaagaattttttttttttttaaatcaagttctggctctatcacccaggctgtagtgcagtggcacaatctgggctcactgcaacctccacctcgtgggcttaagccatcctcccacctcagcctccctagtagctggactacaggggtgtgtgaccacacccagcttatttttgtattttttgtagagatagggttttgccatgttgcccaggctggtctcaaactagtgagctcaagtgatcctcctgccttgacaaagtactataattacaggtgtgagccatcatgcctggcccaaagaattttttcttcaaaaagttttgtatttaattggaaaataccttaataaaaagcattttcaaatcataagcagatgattataagcataatctttccaatgtctgtatgactttttaatttttttacttttgagatagtctgtcactcttgttgcccaggctggagtgcagtggcacgatcttggctcaccacaacctcggaggttcaagcgattctcatgcctcagcctcccaagtagctgggattacaggcacatccctccatgcccagctaataatttatgtgactttttttttagtctcagcttttagtgaacagcttattgttccccctatatgtatgtataggagagaatgctaattgcctgacccaattatctattctccctttttggctttgtatcagaatcccagaatgtattcaggttagcaacgtgcctagctttccttgcagatatatgtggtcatatgactaagttccggcattgacatggaataagaagtgctgagtgatggaaaaaaaaaaacaaaaacaaaaaaccaagaaaaaaacaagtgctgactggtgcttctgggaagtttcctttaacttaaaggcttaagaggaagcagcagggctcatctgttcctgctggaacatggatgtggtagctagagctccatccagcagcattcttggacttcaaagtaactttggaaatagaagtcatgaatggcagagcagcaatatagaagactgggtcctgatactgtgagattacccagtactgctatgagtaaagggttaataaaatcctttctctctccctggtgaaatgacctcgaatttggctttcagcactgtttctctggaaacctactaggcaaggtaataatggaatgtcagctgtaatattaggcaatattgtttatgattaaaaatgagcccttagctgggcacggtggctcacacttgtaatcccagcactttgggaggccaagatgggtggatcacttgaatccaggagttcgagaccagcctgagtggcatggcaaaaccctctctaaaaaaacacacaaaaaagtagctgggcatggtggtgcatgcctgtagtcctagttacttagaaggctgaggcaagaggattgcttgagcctaggaggtggaggttgcagtgacccgagatcacaccatgccactgtactacagggcaggactgtgtctcaaaaaaaaaaaaaaaaaaaaaagacaccttattggtaaactatctggaccaggaagactaacacgtactacaaatgcccattcaaaacatgggctttgggattccttaagtgtggtgttccttattgcaaatatttctggaagcaatactcatgtactgtttcaacaggaattggtttttctggagcataaagcttctaagccaggtggcttctgcacccaccgaaaatgatcttgtttctttacccctcagctgacacttgggaggctggagtaaagactcctgcagaaataagtctcatgctgctgtgttgctgtgctgttccttgttctgtatcctggaatactaagtgagctgggtgccagattgggttccacaaggcttgttggggtcctgtgattgtgaatgtctttccaaacctgtagctattgctgctgtttaggcagagaaggcagaggctttgccactttctacctaagagagaaataagctactctcttcgttaggtcactctctgtaatagccaaacataatactaattgatacatatgtattttatttatttatttttattttttgagatggagtcttctctctgtcgcccaggctgaagtgcaatggcgcaatctcggctcagtgcaacctctgcctcctggattcaagcaattctcctgcctcagcctcccgtgtagctggcattacaggcgtgcacaatcatgcccggctaattttttgtatttttagtagagacggggtttcaccatgttggccaggctggtctccaactcctgacctcaagtgattcacccgccttggccttccaaagtgctgggattacaagcgtaagccaccacacccggcctgatacatatgtattttagaaaacatgaaaaatattaaaaagtaggccaggcgtggtggcttatgcctgtaatcccagactttgggaggccaaagcaggaggactgcctaaactaggagttcaagaccagcctgggcaagatagcaagacctcatctctattaaaagtataaagaagtggaatattcttgagatttgtaatcttgcaaaagaaactcatctacacgatagtgtagttctaccttaaattgaagaggaaaataaaatcttaaattctgacgaaaacatacatgttaagctccttacctatttataagtgtttcaaatttagtaaaataaagtcttattttttaactatgtaatattttgtgagactagaatttcatttatgaatttctttgccatttaattgccttagtaactcactaggattacttaaaagctaatgttagaaccagagtccctgtatagctatcacactaagtactacttttaaaaaaaaattaagtaatattatttttaaaaaatagagaaggggtttggccagttgcccagcctggtcttgagctcccgggctcaagccatctgcctgcctcagcctcccactaagtactacttttgacactgaatgcagtggattgcttttgttgacaaataatacttttcaatttaaaaggatcatatcgttgcctgggcg

SEQ ID NO: 10729 - DNA, 16342 bp, Homo sapiens
  misc_feature (1)...(16342): n = A,T,C or G, or insertion/deletion polymorphism (see Tables 1-2)
atccagggggattgtggcagctgttgtgattattctctccatctctgtctctgttctctctctgtctatatttatatctgtctctgtctctgtctttctgtttcatcctctctctctctcagacaaccccccaccacctgctgcagtagcttcacttcccaacacacctagaaacccacacattctcagctatagagacaaggaggacaacccatggaagcacattgggccaattagtgagggaaattgatgactataaattttatgaattcaaaaagttactgaataatacatgttcaacacagaaaaattagaaaatataggtaaacaaaaaagcaaatgaaaatcactgagtgtataaggaatttttaaattaaataccagtttaaaaatatgagaaaagaaatctatgaatgaaaaccaaatactcaaacgcttcagaagggcatgaaataaggagtgagatcctctgttgctggacccccaagtccccttcccttgagacaaaaaattccagaaatttactctacctgcacaaatgtatgtctctatgcatatgatcttaaaagaaaaccacaaatgggagcataatgttattattgtatttttagtagacatggggtttctccatgttggtcaggctggtctcgaactcccaacctcaggtgatctgcccgccttggcctcccaaagtgctgggattacaggtgtgatcccagcaccttattattctacttaataaattccaaatacctttccatgacagcacatatggataaattgtgaatatggcaaatataccttagtcattgagtgccatgttatgagtaccatgttaatttttgaatatcatgaattatgaataccatgttaatttgtgaatatctctggaatacatattgaagcaacaaagacaagaaaaaaggacactcggcactactgggaaatgatacttgattatttagaatttatcacatttgcgttatctttgtggaaggatgtgacaaatgaattaatttgccttttctctaaactgaccactcccatcacacaaatgctctgtgcactctgaatcactgcctgtctttgatgtcagcagtgacacaatccgcaaaccttcatggcatttggactcattgtgttcaaggacacagagccagagcagggctgcttccctggggcctagatggtgctggtcttgagagcaagtgttcagggaatgggccatgcttactagagttgagcactgatggacaaaggggccaatatattttttaataaacagattttttatgacatgtgggatcttctaaaatggagcggggcccctcctgcccaggtctatgggtgggactctacactggcatgaccgcactggttgttaagatattgaattctgttcatacagttggtaatagatgctgctttgcatcccaaatgatctctccccgtgactccccctaccctggccctccccagaaaccacctcccctgccctcctcatgatccagcaactgaaaggttaatgctgagaacagcaaagggcctctagaacatggctccagagctgttgctgtgcctatttctgttggcacagaagggatggaggatgtgctgatcaggttgttacatatttttattattacccctacttatgagtaaatattcagtgaataccatgcccttgtttctctaaagacaattttgtgtcagagaccaccgatgataaaaacaagatgggtactatgagaaaacaaagcccaggtgacaagctgggatgctataggtcacatccatttcatcaggtggcacattgagagccaccttgaccactttggtttctccggaacaagcatctttggcaggaacccagtggcaaaacaaactggagtcatgaggggtgattaccttgcaactgctgcttgccacattatctcaagagtgatgcttaggattctgaaaacaccctgcctggggccaatagtacaacatttagaaagacatggagttggtgccatttttcctcttcgtctacaactccaatagatacgtcccttttcccctttaagaaatgtggcatttagggtatttaatttaattgggtggattgggtagaagtagaataagttgcttttccctgtccttaattctgttaggtaaccagagaccagttggaacaaaaccaaatctgatttaccaaagataacatctgttagcatgttttcttcttccgggctttttttctatgcatgtaaatataaataagttgctatacttttacaaaattggaattattatgttttatatagtttgtattctatttatacttaacattatatggaaagcaatggccaaatcattaagtattcttctaggacaggatatttaatgtttatataatgttttatcacagggctaaatcacatttaacacttttattttggacatttaggcaattttcaattttttgctaatataagtaactgtatgataaatagtcacatcttttcacacatcctttccttagaataaggaatctcagcttcagagatactcctttttagttcatatgccaactctcaatcttagttgccaccattaggtttaatttctcccacagcttttttatggcctctggactaagcacctcttgaattatctctgaactctcagcagctttatagaaataatctggaagctgaccagcagctctagtttctgggcacgtctgatttacagatttcctagacatggggcagatactggccattgctgacggctccatagtttgtatgggtagtgtaagcatctaataggagatggaatcttttttctcttggcctacttctatcctcctcctcccttctctcttcttcctctctctctctctctctcgctctctgtcatctttcttgctctctctctggaaaagacagattggcataacctgagtcagatactcacatctggatctgtaaaccataggccagataaggtgggttacactgaagaaatatagcaacttctataaccctatgcataatgagaagaagaagaaattcttagaaaatagtgactgggcaaacaaggcaacagggtccaaaacaattgggtttgataagggagggttctaatctatggtctgctagaaacttgctgagccactcagtctccttcgctaggactcaatgtgctcctctttggaatgacacagttggctgggtgtggtgtgcatacatgtaatcccagtactttgggaggttgaggtgggaggatcccttaagttcaggagtttgggaccagcctgggcaacatggtgcaagcccatctctgccaaaaacaaacaattgaacaaaaattagccaggcgtggtgacatgcacctgtagtcccaggtacttgggaggctgagatgggatggatgatcacttgagcccaggaggtagagcctgcagtgagccatgttcatgccaccgcactccagcctgagtgacaaagtcagaccctgtttcaaaaaaccaaaaaaaaaagtaaaaaaaaaaaaaaagacacagttggactgattgattcccagattccctctaggtccttcagtttgttggtggtaaagccaaggctccaaactagggcttcttcctcatgacatatctcctccagctagcagccttctccagtccatgctgttgtttatgatgagttccctggcttccacctccactccaccaggccagaatgaagacactgacctttgcagttaacttccaagaaagatgtgtgtgtttcttgctttaggctgtaggtgaaatatgagtaaatggaatttggggtaatcatttttccctgctgactctgtaattgcattgtgattccagaactctttttcctttagagaatgtgagatattggaaagcccttagaagtcatttagtccaggagttcttaatctgaattctgtgaacctctgaggtctgggaacacactgaaattagaggaagaatgtgtgtatgtacatttttgaatcggtagaggagatcaatttttaaagccaccttatttttaacggagatacaattaagatcttaaaatgtacagattaaatattcaatttgataagtttccacgaatatataacttgagcatccatcatccaaaacaggacctaaaacattttcatcacacccaaagggcaccccttatgtcactttctagtcaatcctcccctgccccccattcccccagcaaccactttctgacttctatttcatatgaccacagtttatttttttcttgttttagaatttcatgtgaatggaactgtacagtttttgctcttttgtcttgcatcttttgctcaactttttttttttgtaaaaagacaacattttttagatcagttttagattcacagcaaaattaagaggaaagtacagagatttcccacatgcctccttcccccagacatgttatcaacatccagcaccagaacggtacatttgttataattaatgaacatacactgacacatcattatcattcaaagccaatagtttacattagggttcactcttagcattgtacatccttgtcagcatttgatgttgtcagtgttccagattttggccattctagtaggtgtgtagtagtatcttattgttttaatttacattttcctgaccaaatatgatgtggagcatcttttcatgtgctttttgccatgtttatattttcttttgtgaggtgtctgctaaagcctttggcccattttaaaatcaggtcgttcgttcacttattgttgcattttaagagttatttgtatattttggataatattcctttatcagatgtgtcttttgcaaatattttctctcagtctatggcttctcttcttattctcttgacagttttgtttgaagagcagaagttttcgattttaatgaaacttattaatgatttatttcatggattgtgcctttggtgttatatctaaaaagtcatctcacacctgaattcatctaggttttctcctatgttattttctaggagtttaatagttttgcattttacagttaggactatgatccttttgagtgaatttttgtgaaggctgtaaggtctgattttttttttttttttttaacatgcagaagtccagttgttccagcaccatttgttccatttgttgaaaaaactatctttgtttcattgtattgcctttgcttctttgtcaaagatcatttaactatattatgtgggtctattcactgtatctaaatggtctctctactctaatacattggtctatttgtctattcttttgccaataccacattgtcttgattactgtagttttatagtaagtcttgaagttgggtagtgtcagtcttatgactttgttcttctccttcaatattatgtttgccattgtattttttttttcctctctatataaactttagagtcagtttgtcaatatctataaaacaacttgctgggattttgatttgaattgcattgaatggatagatcagtttgggaagaactgacatctttacgatattcagtcttcttatccatgaacataaaatatctctccatttatttagttcccctttgatcttgttcatcagagttttgtagttttcatcacgtagatctcatacatattctgttaggtttatacctatttcattttttaagtgctaatgtaagtggtattgtgctttcaattctgaatatcacttattcactgttggtatataggaaaccaatttacttttgtgtattaaccttgtatcctttaagtttatactatactcacttattagttccaggacatttttctgttgttggttaaaaagaaatttctcgatttaccctccccttcccaccgtgctggcctgcgcgcgcggacgtgcgcgctccgccctcgggccgcctgcactgcaattggttggtgtctctgggagggatttgaaacttggcggttaaagctccggctgggacagggcggcgggagaccccgggtgaacggggaagggacatttagtttgagacggtgctgagataggatcatgaaggaagaggtgaagggaattcctgtaagagtggcactgcgttgtcgccctctggtccccaaagagattagcgagggctgccagatgtgcctttccttcgtgcccggggagactcaggtggtggttggtactgataaatccttcacctacgattttgtgtttgacccctgtactgagcaggaagaagtcttcaataaagcagtagcgccgctcataaaaggcatatttaaaggatataatgcaacggtcctggcctatgggcagactggctctggaaaaacctattcaatgggaggtgcatacactgcggagcaggagaatgaaccaacagttggcattattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgggaggatcctaaggaaggcataaagattgtgggactcactgagaagactgttttagttgccttggatactgtttcctgtttggagcagggcaacaactctaggactgtggcctccacagctatgaactcccagtcgtcccgatctcatgccatctttacaatctccatagagcaaagaaagaaaagtgacaagaattgcagctttcgctccaagctgcatcttgtagatctcgctggatcagaaagacagaagaaaaccaaggctgaaggggatcgtctaaaagagggtattaatattaaccgaggcctcctatgcttgggaaatgtaatcagtgctcttggagatgacaaaaagggtagctttgtgccctacagagattccaagttaactcgactgctgcaagattctctaggaggtaacagccacactcttatgatagcctgtgtgagtcctgctgactccaatctagaggaaacattaagtacccttcgctatgctgacagagcaagaaaaatcaagaacaaacctattgttaatattgatccccacacagctgaacttaatcatctaaagcaacaggtacaacagctacaagtcttgttgctacaagcccatggaggtaccctgcctggatctataaatgcagaaccatcagagaatctacartccctgatggagaagaatcagtccctggtagaggagaatgaaaaattaagtcgttgtctgagcaaggcagctggtcagacagcccagatgttggagaggatcattttgacagagcaagtgaatgaaaaactgaacgccaagctagaagagctcaggcagcatgtggcctgcaagctggatcttcaaaagctagtggagactttggaagaccaggaattgaaagaaaatgtagagataatttgtaacctgcagcaactgattacccagttatcagatgaaactgttgcttgcacggctgcagccattgatactgcggtagaasaagaagctcaagtggaaaccagtccagagacaagcaggtcttctgacgcttttaccactcagcatgctctccatcaagctcagatgtctaaggaggtggttgagttgaataacgcccttgcactgaaagaggccctagttaggaagatgactcagaacgacaaccaactacagcccattcagtttcaataccaggataacataaaaaatctagaattagaagtcatcaatctgcaaaaggaaaaggaagaattggttcntgaacttcagacagcaaagaagaatgtcaaccaagccaagctgagtgagcaccgccacaaacttctccaggagctggagggtcaaatagctgatctgaagaagaaactgaatgagcagtccaaacttctgaaactaaaggaatccacagagcgtactgtctccaagctgaaccaagagatatggatgatgaaaaaccagcgggtacagttaatgcgtcaaatgaaagaggatgctgagaagtttagacaatggaagcagaaaaaagacaaagaagtaatacagttgaaagaacgagaccrtaagaggcaatrtgagctgctcaaacttgaaagaaacttccagaaacaatccagtgtgctcagacgtaaaacggaagaggcagcagctgccaacaagcgactcaaggatgctctccagaaacaacgagaggtcacagataagcggaaagagactcagagccatggaaaggaaggtattgcagctcgagtgaggaattggcttggaaatgaaattgaggttatgrtcagtactgaggaagccaaacgccatctgaatgacctccttgaagacagaaagatcctggctcaggatgtggttcaactcaaagaaaaaaaggaatctcgggagaatccacctcctaaactccggaagtgtacattctccctttctgaggtgcatggtcaagttttggagtcagaagattgtattacaaaacagattgaaagcctagagactgaaatggaactcaggagtgctcagattgctgacctacagcagaagctgctggatgcagaaagtgaagataggccaraacaatgctgggagaatattgccaccattctggaagccaagtgtgccctgaaatatttgattggagagctggtctcctccaaaatacatgtcaccaaacttgaaaacagcctgagacagagcaaggccagctgtgctgacatgcagaagatgctatttgaggaacaaaatcatttttctgagatagagacagagttacaagctgagctggtcagaatggagcaacagcaccmagagaaggtgctataccttgtcagccagctgcaggaaagccaaatggcagagaagcagttagagaaatcagccagtgaaaaggaacaacagctggtgagcacactgcagtgtcaggatgaagaacttgagaagatgcgagaagtgtgtgagcaaaatcagcagcttctccaagagaatgaaatcatcaagcagaaactgatcctcctccaggtagccagcagacagaaacatcttcctaatgatacccttctatctccagactcttcttttgaatatatcccacctaagccaaaaccttctcrtgttaaagaaaagtttctggagcaaagcatggacatcgaggatctaaaatattgttcagagcattctgtgaatgagcatgaagatggtgatggtgatggcgacagtgatgagggggatgatgaggaatggaagccaacaaaattagtcaaggtgtccaggaagaacatccaagggtgttcctgcaagggctggtgtgggaacaagcagtgtgggtgcaggaagcaaaagtcagactgtggtgtggactgtagctgtgaccccacaaagtgtcggaaccgccagcaaggcaaggatagcttgggcactgttgaacagacccaggattccgaaggctccttcaaactggaggatcctaccgaggtgaccccaggattgagcttctttaaccctgtctgtgccacccccaatagcaagatcctgaaagagatgtgtgacatggagcaggtgctgtcaaagaagactgctccagctccctccccttttgacctcccagagtcgaaacatggagcaacagaataccaacaaaataagcctccagggaagaaaaagaaacgagctctggctagcaacaccagcttcttctctggctgctcccctatcgaagaagaggcccactgaagttggagtcatcatctctacscccaatctggcttgggagatgctttccagttgcagccagaaggggttttttaaatgacttctctggatttcaggtttcttgccgttgaaaaaaaggaacaaagcattactaaaaagaaggtaacctttgttggatgttgtccctcagtctccatccccagactactgctctctgctctctagaaggctgctaaaccacctgctgaagagagaaccaacagactttcctaatgactcatcaggaaccagtcctcagtatgatcaagttccttcttatttgtgagcagttcaggctatctcctgatggggatgaggccaaggctttcttatcttttggttgtctctgcttaatggaggagcctggcctaggatggaggtctggctcagatctttcactccacctcgggaatggggttgtgatctttcctgtcctgaccccctctgaattgtaagtgtttcaatagtactcttgattgtatgccatgttgttgaagtaaatgaattatttttaaatgttaagtaaataaaccttagcccatctactgttaaaaaaaaagtctcatagactatcatgccatctgtgaacaaagataagttttgtttcgttttgtttttgagacagagtctcactctgttgcccaggctggagtgcagtagtgtgatcttagctcactgcaacttctgcctccatggttcaagtgattcttgtgcctcaacctcccaagtagctgggattacacgctcatgccaccatgcccggctaattttttgtatttttagtagagacgaggttttgccatattggccaggctggtcttgaactcctgacctcaactgatctgctcgcctcggcctcccaaagtgctgggactacaggcgtgagccactgcacctggccattaacaaagacagtttgatttcttccttcccaatgtgtatacttatttccttttcttgttttatgacgtgagctaatattttcagtacaatgttgaaaaaaagtggagagagaggacatccttgacttgttctgtatcctagtgggaaaacttccaatttctcaccattaaatatgacgttagctgtaggtttcttgtagatattctttatcaagataagttcaactttgttcctagtttactgagagttttcatcataaatgggtattggatgtgtcaaatgctttttttgcatctattgatacgatcgtgttaatttttcttttttagcctgctgaggtgattacattgatttttgaatgttgaaccagacttgcatacctgggatacattctactaggttatggcatataattcttcatttcattttcttatgatgtctttggttttgataatataatcacatcatgttttctgagattcattcatgctgttgtgtatattagtagtgttacgggatctctggggtgtagatttttctggccagaaacctctgtggccacagcacctttgcctgggttcttgtccagcgtccaggaagaatgaggtacacagacaagtgaagggtgaatagttttatctagtattagaacagctcagagtgggtagctccctctgtaagcaggttgttccatcaactgttcagctctcggcagagaggagaccctggagagggtggctcctctccgcagacaagtcatttggatgtctctacaggtctctgaagctctcatctgagagggtcgctcctctctgccggcaggtcgtctctgtagctctcagtggagagagtactactctctgcaccggtcgtcccatcacctccagctatcatcggagcgagtgctccgctctgcagctggttgtcccctcgtcgtctctctgccctctccctcctctggctgtcctctggcctgctctgcctgagcgcctagggcttttatggacctcaaaggggagaaagtatgtgctgattggtccatgagcggccatggggagccggaagaggcactacgaattcccactccagtccgcgggactggcagcccagcccccagccttcaggccctccctggcctgagggtggggccttactggggaccctgtccccttccgccaaggaatcaatctgcctcctgctgtcattcatggccccggggctcggccccaacccctgctctgagaccagagcagggcaaagaggggccagacagtggaagcagacaccccccaagcctgcagggactgggagtggggtgggggtggggtgggagacttcctggggccccggagggtgcaggctgcagagatgcctgggtcctgcgcctgggagggcggccgcagctgctcccgggagcttccgccccgccaactcagcccagctcatgcctgcttcctggagtgggaggcccaggtctgcagctgccggtgttgcagatgcttctgcacctgggggtgcagatcctgcctgtccctggcttcgccaagagcacagggaggctcggatccacagctgacgtttgggcggctgtagctccaggagggcggggctcctgcctgctttgtagagcaggaggcctgggtctgcagctgcaggttgggtggctgcagctgcagggagagctcccgtctcaactcagaaggggcagggctcccacagactccatggaatgtgcagccccagtcccgcttccctgctgcagccggcatgatggcagcagccactgccatcagtagttggttcctttatatggctaagtagtagtcaatattatgaatatataacaatttgattatcattctcctattggtgggtatttggattatttccattttatgctattatgaataaggatgtaataaatattcctttatgagtcattttgtggacatatgttttcatttttcatggattaatattcgggaattgaaatgttgggtcatgagtagatgtatgtttaacttgagaagaaaccgacaaacagttcttcaaagtacctacaccatttttatactcccaccagcaatgtaagagagttcgtttttccacatactagtgaacacttggtatggtcagtttttgtaattttagacattctaaagtatgtaaaatggtatctcattgtggtttaaattcgcatttctcttatgactagttttattgagcatagtttcatgtgcttatttggccagttggaaaatttctttcataagatatctgtttaaatcttttgcccatttaaaaccagttggaatgacttgttacttggaaataaaagagttgtcatcaagagaaaatctacatgtgccgatagcctaaagtaactgacactggtgttgagtatagataaatgggtgtttatcaaaatatagaaggtgactctagcagagggagcagagtgggcaaagctacagaagtaaggaacagaatactttgttcagtgaatgaatcataagtagtggagtgtggtggagaatgggatgtggacagcaggaactagagttttaaagcacagtgagacatggagctggagagacaggcattgttggctttatataccatgctaaggcatttgaactcttctaaagatggtatggaatgacttgagttttactcagtagagtggcataattagatacatgttaaaaatttgcagaaaaaatatacctactttatatataccaatggattgagtcatggaagacccttgaaaagatacgctttctggaggctgagacacttgtcactggcatgggataacagatatgtttaagagactatgactaatattgtctagcaaggcatgctgaggtcttggtgctcctcaaaaaagtctgtatttttgcaatggaggcagtttacagaattaaaattttattgttttaaacctcagtatttagaaattatgcttatttgcttttatgtcttcataacatataaaaaacatgtctttcaattttgatgggggactctatcataggttctgagttgctttcatgaggaaaacattcaaaggaaacagctgcattgcctgcatataacaagccagctcagggattgaggacagtgtagaaggttaaagaattacaccttcagcagaaggtaggagaaatgctagaaatatcttatatcagttagggttctcagatgcaaacaacagaatccgcttttgctggtttattcaaagaagaaattcattaaaggatataagaggcttacagaatctcagggaaggccagagatgaagtctgaggctattcatttagaaaccaagcccaaatcacactgtggggtcactacaatgaggacaacactattgctcagcatacatatggtgctatcactgatcatgtgagggactggaccacagaagctgtgctactacggcctcctaaatctcaatactttcattacttcagtcattaaaatatggatttggcatagtgtctgccttctcatgtgattcatttccaaactgaagtctcacatatgtctgactggtagagctagatcacgtgcttaaatctgagcagcaagggagcctgggaaagtgagttctggcttctttcttggagaagatcgacttataacatgttcacaagatattagatggttaaaatgtctataacatattatgacattactcgtctcacatagcagctatctgcaattaaaaggagagtgaaaacacgttgatcaggcactgtctctttctttcttgtaaaattaaaaacaaaacaaaacaaaaaatgtttagaaagggaggagaaatatccctaattttggcaggccctaaaagagattgtatgaatttacttgagttatttgtatgaagttttaaacatctacctattcatcttcctgttctgtagctaagctagcatgctaatagcactgtagtattaaagaagcttttgtgatcggcctgggaaccatcactacttgtaacattgtgccaggaacagagacagcagcaacatcctggacgagactttccactttgtgattgatactttctgctaaagccctagtcatgctgactggaagctatcttggcaggataaaaggtcatcactggcattaaggatctctttaggtttcaataaacagaatccattcaagataacttaccctaaagaaggacatttattataaggatacagagctatctcctggaatgcaagggtaggaagttcaacctggccccatgagggactaagccaggactctgaaaaccctcagaaactaatggaaagtgtgtctgtctatctgtctgtctgtctgtctgtcccagcatcttttgcatgatttgtcatctctgcttctctctaaacatctgcttcattcttttcctctgtacagactgatgtcctctgcttttacgtatatggcagaaaatggctacttcattcagtccttacatgtcctttctgttcaagagccaacaaaggcaaatggacatttccaagtcttgactccaaatgcctgggacagagaatgcctgtactgggttgaatagtgtatccccaaaatgtatggtctacttggaacctcagaatgtgaccttatttggaaatagggtcttcacaggtgtaatttattaagatgaggtcatactggattagtgtgggccctaatccaatgactgaggtctttataggacgacaggcataggagagaatgctgtgtgaagatagaggaaaagattggagttacccttccacaagtcaaaggatgccaaggattaccaggaactaccagaagctaggagagaagagtggaacaaattttcctttgggcttgccatagaaaccaatcctgccaacaccttgatttcagattttcatcctctggaactgtaagagaataaattnccgttgtttcaagccacccagtcgttgtcatttgttatggcagccctgggaaacagagagagtttctttggcccaactgggtccaatgtccaccttgtgcattcacctggtttagctatggccagggtggaggggtcgagccagacactgtgcagaagaatctctaagaaggggatgtagaaggagcaggcaaattgatgaacagatataataattttttttgtgcttccttataaccagaggtgtctgtgggtacctagcagtgatcagagggaacagcaggaccctagatatagttcctaatcattagtactttaagaacaacttacctcttgctatttgtgaaatgggattgcaaagataccttgcaaagatacctgattctgatggccttgtcactgtctttgaccaatagaatgcaaaagagataggtgtctgttctaaacctaagtcgtttttttttctttttttgacagggtctggctcggtcgccccctcccacctcagcttcccaagcagctgagactacaggagtgtgccaccatgcccagctaatttttatacttgttgtagagatgcagttttgccatgttgcccaggctggtctcaaactcctgagctcaagcaatctgctagcctcagactcccaaagtgctgagattacaggcgtgagccaccccgcctggccttctaagcctacgtctttaagcat

SEQ ID NO: 10730 - DNA, 163548 bp, Homo sapiens
  misc_feature (1)...(163548): n = A,T,C or G, or insertion/deletion polymorphism (see Tables 1-2)
ccgacaatagaaaattggttaaataaattatggtgtgtctatacaacaaaatactacatagccattaaaattatgttatcaaatatccaaggtgatgggaaaatgtttatgatgtgtcattgggaaaaaattcaaaacataagcagtatgtatagcatgatcccatttctgaaaacagacaatatgattgaaaggaaatataccaaaatattagatagagttaaacctgggtggcagaagtttaatttaattaaaaaatgcaatacatgattgcatttttctctttctcctgtatcatatttattatagtgattatatgtcactttgatagaaaaaaattctatatttttaatgctgtaccttttagttttaggacacaaatagttaaaatagtcacagtttctatatattttgaaggatgtacatagatacatatatttatatttctttctcagtctacacataagtagactggccaccattaccaaaaattgttatatacattatttagaagtagttatatgtgctggtgcttgtatttctaattattctttcaatattttttcactatagtaatgtttttcatttttcagtagtgctttgagatgctttaacattgtttttctattagatgtggtgttgctacaggtatcaattcattctgagagagaaatactttctacccagcttgtcttctataacattataggcctccttggcacgactcatcaattccttactatgactcgaactcaaagatcattttaggagatttcatttaaaaaaagtctttaccctggatacaataattgtgttgactccaataaacagagctttctttttacaaggccatgtatcagtgctgcttgacagtggaattttcagtgaaggcttcctcttgtaaattgaaagcatatgcttgtacattaagagcacactattccagcgcactcacctgactccaccataagtagaccaggtgagatcatgaagaacattttagctgttctaaagagctataaaatagatttacttatgttccaaattgtctcaaagatattttagttgattcgtgccttccttccttcctccttgattagttcagttcaaagtcattaagaagggcagagtgaggtaggtcttgggcaggagtggcagcagcccagtctgagggattgcagccccagtggagtgaggagggcatctgtgtctgggtttgggtgtatcagtagcaacccagaattgggtttttaagccaaagaggggtgagaagagcacccatatgggggggggcagtgacagggagctcacacaggatgtcagagaccaagtggagtgaggaggtcacccatatgcatatgagattgagggattgtggtggcagcaccaatgggagatgagtagtttataggcaatggggaggggaaattagccagtaagtgaatatactgaggataaaggaagcctgatttctcactgtcagagaagaaaggtataaatatgaaaagggagtaaactagaatgaacctgtgttattggattcaaactagaggtatcagtgtaaactcatgattttcaaaatatatttggatatatagatatagaaataaagatgtcaatatgtattcaggtatacagtccagccctctacactcatgggttctgcatctgtggattaaagatatttttaaaaaatggatggctgcctctgtactgaatacatacagactcttttctttgtcattattcccaaaacagtacagtttaactaacaactatttacaaagcatttacactgtttactagtttgttctcacactgctatgaggaaatacctgagactgggtaatttataaagaaaagaggctaactggctcacggttccataggcccatgattccgtacaggtatggtgacatcagcttttggggaggcctcaggaaacttatgatcatggtggagggcaaagggagagcaaatacttcacctggccagagtaggaggaagagacagtggggaggtgcagtctatacactttaaacaaacagatctcatagtaactcacttagtacctatcatgagaacagcactgaggggattgtgctaagccattcacgaaggaccacccctatgatcacgttcacctctcacgaggccccacctccaacgctggggattacaattcgacattaaatttgatggggacacagaaccaaatcatatcacaccatattaggtattataagtaatctagggtatacaggaggatgtgtgtaggttatatgcagacactatgccattttatataagaatcttgagcatccatggattttggtatctggggaggggtcctggaaccaaggccccacagatactgagggatgaatctatatgtagatacatacatatattcctcagctctgtccactgagagggcctaggagtatctgcaacactccaatagccgtgagcacaccaggtacccagatataggtatttaaatatcacactccattaaaaggaaccagggctttctagagaaatggctgatctcaagacagtcacagggaaagtgatcctggaacatcttgtgccagaaagtgagaaagtgagcaaagaatgatgggatcaagtcaaaaggacatgggagtgagttaggtttaatgaggttttcattggtgaaatctgggacaatttagcttcaaaataaataatgacagtaacagattatatcccattgcataaactagtaacctacaagtccatactaatataaataaatacatggggagaagaaaaggtttctttcccttgcagtaggattccaactaataaatagaaggaatgtaggaattaggaaatcaccatttggcaaccaccaaagtaataattgagctaagaaatatcaatggatgataaaactggtaggtaaaattttgatatcaacatagtctcagcacacgtattccaccattgagaatgaactcctgttgggggggcccactgtggctaacagtaaaagcatatttatgtgtgcctgcagcgttactggttggtcatatgaaatttcctagtagccaaaaaaagcaaaagaaatagttaaatttaatagtatatttcatttaatccagttgtatctaaagtatcatcattcccacacataatcaatgtgaaaattgttagtgaaatatttatattcctttgttatacaacgtattcaaaatctggtgatattttatatttagagcgcatctcacttccaactagtcacattttaagtgctggggagccatgtgtggctagtggctaccttattgaactgtatagctctaaggtcttcagagtctgttcacaggagcaaaggggatcttggcaactcttttctgggtagtgtcagcattttctgtgcatcttgatgtcactgagggttaagagaagacttccctcatggtctttcttaagctctttaaagcagggattctttccctagggccttaggtacacattcactggcagctcccggagcttaaaggaacacatcagaaacattgtctaggattgggaggaagtagttatagtccatcctcgtgggttagacagagcattgtgaattggatttcggcaaagccgtgagattatctaaaggaattttggtaaaaaagcagtagcaaaatacaaaatttcatgatagaaaaacaagaaacagatgaatgtggcatggaagagagagtctggtagttttgggaacacagttggatcaggttccaagggatgaggtagacctagaaaattttgttgctcaggaacatttggaacagaaatgttgaatctggagttcacgttctcttagaagggccagaaatgggcttcaggggcctatagatctcctgaaactataagcaaaatgttgtgttacatgcatgttagggggtgatagattttcaaaggagagcattacccacaaatgactgagaatcctgccttatggattatatgacccttattaacttcaatagggatggcaccaggttcacaagactgaagaagagacatggagccagcaggtgaaacatagaatttatttgggaacttacagggcagtccagtggcagtgggctggtcagaagaacaaccatcactttaaaaaagcgtgctgtttatatagcatttttccttaacactccttcccccaaccccacctccttccacacaacctccacatggcaaccctcatatcataagtgaaattatgctgtcaggtgcatctgccatacagagtatgcttaagttaaattattgctgtcaggtgcatctgccatacatagggccaccaggtagaaagttaaaaatgagaattctcagccaggtgtggtagcttatgcttataatcccagcactttgggaggctgtaggtgggaggatcacttgagcctaggagttcaaggccagcctatacaacaaggtgaaacccctgtctctatttaaaaaaaaatttttttaaacagtgagaactgtcacttgttcaaagccaggagagacctcgggcctctgaatcaaatctcactcttcagtggaaaaaaatgaaatacagagatgtcgagttactgggccaagcaaggcttttcactgacaacgtagtgactgacatacagaaatacaatatttagggacactagaggacctctaagactcagaaaaattaggcattctggaccacagaaaaacccacttaaagaattcttgaaatctttgatcatcccgagtggatgtgatctttctttctttgctctgccagagcacctggtttgtatcacacagagagcaccacactaataacactcagagtttctcaccttggcgctgttgacatttcatgtaggataattcttcgttgtcggggggctgctctgtgcattgtgggatgtttagcagcatccgtggtctctacccactagatgccattagcaccatttccatcactgtacccacagttgtgacaatgataattgcatttagacactgccaaatgggggagaagggggaacaaaatcactcctgattaagttccactgccttataccaaagctattttaacatatctcagaattctaattgaatcttgcattggcacaggccacgcctcacacagcttgaagcaatcacagtatgtgtaatatgctggataaataaatgttcagtttttgtgttcatggattctgcatgccacataagctatttccaaataaacaatgggtkaatggtttcaaaagagaagaaaatcaaaaaggaaacatttcattccacttgctcttttaggagctcctgagttctgcatcagaaacaagttgagccttgtattttcttttttgagcagtaaaatacaggttgtcatcttctcctgcacgatacggaagaatacaattagaatattactcaaatgaagttttcctttagcttcacacaatgcactccatttagaattcgttcacaaagagaacatttccccctacttccttcatattcttttaacagggagtttttaaaaggtccaacactcaaaattaaaaaaaaaaatgtatccctcttaattgttacctctgaaaataagcacggtggaaaataatttttaaaaacctactttccaaaaaaaattaaactgtgctcttatgaagtatttcaactcaagtcgacgagcccaaagatctttctttaacacctcctccccacagtgctttatattgtgtggttcttatggtagacatatacgcaaagaatataaatagagaggaaatacatttcaagccaaatcttagatgtaggcaaatcaactccacatgatttcaatcttggagtcttaaccagatggaaatggtttcccaggagacagagctgcggggcaggggctagaagcagcagcctggacgtgcaccaatgattacgcacgggctgcgtataaaaagtccccgagggaaggaaagccgaaactccatcctgagggatgctgcggcgagagaatctccaactcatggaggctgagcttctgcgggagaggccacagcctgaagaagaggtgggatcggaaataaacccgcctgggagacctgcaggcaccagcaggtcattctcatttgtttattatatttaataagcgttttagtttggaatgatctgaaatgatttaaaattgcaaagcgagcgagttcagagagttcccttatacctctcacccagtttccctcattgttaatatcttacattatcatggaatatttgccaaagctaaaacattgacattggcattgtattaatttatgagacacggttttgctctgtcgcccaggctggagtgcagtggcacgatctcggctcactgcaacctctgcctcccgggttcaagcgattttcctgcctcagcctcctgaggcagctactcaggctaccactacagacgcataccaccatgcctggctaatttttgtattttcagtagagatgggatttccacatggtggccaggctgctcttgaactccagggctcaagcagtcctcccacctcagcctcccaaagtgctgggattacaggggtgagccaccgtgcctggccggcatattattatttatttttaaagagttaaacgatttcctttaatagaaaaacattcaacacgtttgttcgaagtttcatatgtttggggtgtaagctagtggttcttaagagcatagaaaaattcttcctgagggcagtttattagatgctcctgttgcttccatgctaaagaacaaaccccacaggaaggcctgtttcccaacatttggagtagttctttgtctcccaaaattccagttataacacctgtaagggtatgtggcatttcagagggagtttgctgcttgtaagatagcagggtgggaaggggaatttccctaggactttgcctgtggttttccttggggtgccaggttaaaatctgaagaatggagggtctcggggcctccatctggccatgccacaggggcttgtggcagcccactttcttccctcttcagaaaaatcctgggcttggctcaaggaggcagatgtcatctggtcctcaaagaccaattgtgcagctgatggagcccctggggtaggatccaggttggaggctaccccaccccttgtagaagggcaaaaatctcagatctcaatgacttattttagtgagaattccctcttttattagtatttgctataaaaaataagctccacccacacttgtgtgtctaagaatcacccagggaagttgctgacaggcagatgcctaaacccagatttggtgggtctgggttaggtcctggagatgtgtgtttctaacaagcatcccagatgattctgattcaaatagatggcacttaagtcagatacactgtttaattagtctgcttattctagattaactactagaatttggatttctgtcagctgggggtatctttttagcattctccagaggggctctttaattcagaatgttatgcatcttgttttgttgtcattcattgacagtaagtgaaaacatataatgtgagaactaagtaaaatttgctaaacacttaagcatgaatgtatatgtcacaacttatagacagtgtcattccagtgataaatctccatttttctctctcacgtgcagccaagttgtagtgtctgattctcatagtcggtacctatgcaaggaatataaatagagagggaaagcatttcacgccaaatcttaatgtaggcaaatcatctgctctgggtcttgttcccttcagggacctggctcctggctttttgctggttttccaggatctatgttgtctatttatcattttatatactgtaggtgagcctgtcctaaaataatcatccttttgagttttctaatatcaattgccacttttcactttagtattcagagactcaaatctgggaccccgttctgagtgacagcaagtgcgtggacacacacattcttgaagatactgcttttcacttcacattgttctactcagcgtctccactgctcccagcgtctctgctgtgcctcttctggacatatagaagtgatgtattcttcatagtctaagagccccagcaatatttatagcaatctttaatttccacttagtaagtattttgaacttatgaaattcctgtaagtgaattttaggtcatgccacgtgtactccaccttctgaagtctgcccgtgatgaccttctttcaggtacaataggtacaatttgtctagtgtagattgtctaatcttgattaatatagattttcttcagttcagaaatacaatttaaatgccattaaaaacttaatttttgactgacttttcttgtgtttcttatttaatagaaagcctcaatttctagtaaagccatccagtctttcagttactcagtgtgctggcctgtggaaactgaagaactataaatatgctccaattcacatcagtctggtgtttctgaagttgccctgtttctacgtttcaaatcccatgtggtttttttcatttagaatataattccagataccaattattttatctgatttcataaatcccagtaacttctttttctgtctatttggcctgtttcttccttcattccagacatagttatctaatgacttagttatctaatgaccacagggtgtggttttacaatcaagtccagttcttgcatctgtgcctgagtttgrgggcctgtaggacttgcaattttaattggtggcaaggaagtatgcagttcatgcatgtggcttgaataataagattttgctctcctttttctcatataatatctaagtaactgtctttcttgctattgtagctttctccaggccaatctgtcactctgtggtttctggttttgctcttcattctcccaagaatcactgtagcatttaagaaactttactgaagacttgaaaataaggtcaaagacctgcaatgcagaaaggaaagtctgtgcctgagttgtcctcagatcccattgctcctgaaacctttcagtcatggccttttcataggacgatccctggtcatccttctacccaccttctcccactcccaccagtgtctccaagttactggctgtcttagtttgtttcagctgctgtaccaaaaataccataagctaggtggcttgtaaacaacttttactcctcacagtgctggaggctgggaagtccaagatcagggcactgatgaattcagtgtctagtgagggcctgcttcctggtttgtagacagccatcatcttgctgtgttctccaatgggagaagggacaaggcaactctctgggatctcttgtaagaaggatactgattccactcatgakagttctgccctaatgacctaaccatctcccaaaagccccacctcctaatacatcaccctggtagttaggtttcaacgtaagaattttgaggggacattcagaccatagcactgggtcggcctcccacttgaacaaacagttcccttgactctctccatcataaagcccacaactccatcattatttcttagctatagccgtaggagaattggagttaagctcacgataatctctaggcacagggccagaatgagagtaaggcaatgatgcatgaggccacaagttttaacggaacaccaaaagagttaacaattaagagcaataatatgttaatgcaatattttaaaaattaaaattaatgctaaaatcgataataaaatagcaatagtttaaataaaaacaggctgtttgttttgcaactctgcatttttgtgcaataaagcatagttgttgattagctcaaggttcctgagcccacagagctaggcgggttgataaggggtgatgatggtgtgtgaacagattggacaatataatgctttatatttagtcatatttttgaatggcagaacttttactttttctatttggttcaaaatatgggggagggtactttgtgtgtatgtgtgtgtgtatatatatatacacacaagattttgctctcctttttctcatataatatctaagtaactgtctttcttgctattgtgtgtgtgtatatatatatatatagctactatatatatatacagctactatatatatgtgtatatatatatatagctactatatatatgtgtgtgtgtgtgtgtgtatatatatatatatatatatatatatatatatacaggggtacatatttatccttttgcctcaggctccaacatgacattgcacaccagtgttctatccacaatgagaggaggtttttatattatcatcagagcaggattctgggcctgttatgcacaattaaaatctattagtgtcccctccacctgcaaaagaagtcttcccccaaaatggagtctgccacctttatagtaatataaattatgcagcttttcaaaaattgtgaaaaacacatatttacaatcttaaccatttctaagtgtaatgtgtaatgttaagtacattcacattattgtgcaaccaatctccagaatacttttcatcttacaaaactgaaactgcccaccaaacaactccccattctctcatccccacaaccattctacttggcactggcaataccattctactttctatctctatgaatttgactactttaggatgctcacataagtggagtcatacagtgtttgccctttgactggcttatttaacttagcataatggcttcaaggttcatccatgttgcagcaagtatcagaatttctttccttttcaaggttgaataatccattgtatataccatattttgttcattcctccatcaatggacatttgggtggtttacaccttttggcaatcgtgaatagtgctactaggaacacaggtgtacaaatatctcttcactggcagcttttgaagatcacagaatcatatctcacaaaatccattccaccaatgattacttgtgaattggatttctgctctgcactctttgtggtaagaggaattttctgcaagcttctggctctttggtggcaaaagccattcctagattgaagtgcagaagtcattagaatctttaacactccacctgatttgcaactgtggttactctttaatcatttcttgcccacttccatgaaggctacactttcctatacaacatcatatttaatctttctttataacaaatctgtgacattgatgttataattcccattttatagtcaaagaaactgagtctcagggaagataagtgacttacctagttaataacccattgggacctaacatataaggatctagtaagtacaaataagctagcactgtccacatagactgtgagttttgctaaatctataaatctttctatttgagcaaaataaatgtaagaagttttcagaattcataactctacttaccaatttccaaaaggggcagtttccaaattattttatatagaaggagatgctacagccttccttaggcactcaatctagtgacctatgactaacatacctctgggaggaaaaaatcatcttaatacagattagtttaataagacaataagacagcctgatacagaaattaaaactagggtatggaggttaaagtttggcatattggcttctgcactgacagacattttactttcatgctattctgatggtccttgcctaatgaccacagagcgtgtgtgtgtgtgtgtgtgtgtgtgtgtgtgtgtatgtatgtatgtgtctgtctgtctatcagtgctatctaacagttttctgcaatgatggaaatactttttgattgtccaatgaagtagccactagtcacatgtggcaactgagcacttgagtggtgactagtataaaagggaaaatcaaatttttaattttatttaattaatttatatttaaacaaccacatgtagttataacaacagaatattggacaacgtgggggctatagaatgggtgtaacaatgttgtatttcagttcttctaccagttcttcggattygttttcttgaacagagtccaagatggaatattttaccatgaattctgggttggaataggtaggattacagtgaaactctagcatttagtcacatgaataaaagctgaatgaggacaaagcatttcaaagaaggatcatatgtctacaaagaaagataatctggcccaataaaccaggtaaattgtgtgttttggaacgctctagtgtattttattgctaacgcccatttagtgaatggattgattttcctgttagaatgtagtgggaacataatctgaatgcctttgactctgaagcctactgcagctaacaagaacatcatttgtatttcattggcccagacagattatgattaatggttggatgaacacattttcagttgaatttatgtagcacagtgcttcccataatttttttcctgtcaaggaactattttatgttaaattacacaaatatagttttatttttataacattacttccttctatctctgaacacctgcaccttctctcacaatgtcaacctctctctttgtattgcaatttggcttctgtatctactctgttcttttttcccaccttcccccgccccctgagacaaagtctcactctgtggcccaggctggagtgcagtggtgcaatcttggctcactgcagccccgacctcccaagctcaagtgatcctcccacctcagcctttgggttgctgggaccacagatgcacaccaccatgcctagctaatttcttgtatttttagtggagacaagatttcgctattttgcccaggctggtcttgaactcctgggctcaagcaattcttctgcctcagctccctaaagtgctyggattgctggtgtgagccaccatacccagcttgtttcttttattctcagaatattcttaatattctcaagaacattcttggcctcccttccctgccatttataatgtttcctcccttggtttctttattttccttcattcacactctgattgcaccattcagtttgactcaattgtagtcaaattcaactcacaggcttgttaaccctagtttggtgaacatcataagtctttcagatgctggttggaaatgcacctcctcaatccctaacactgacatttaagcagcagaaagaagaggagcagcccatggtgaaggcaactggaaaggtcagagacccaaggygagataagatgaaagttatcagtggtgcctaatgaagaagaactgttctgtgagacaaggactgagaatgttcctcatgaggacatcatngatgaccttggtgagaacagtcagcagaagtttgagaaattattgggaggtgctgaagctgccacaagtacagaccaagcttctgagagagttggatgatgacagaaggagaaagtgaaaaagggctcagggtagagaggcttttgtttaggatgggagaagctagagcaagccaatgtcagctggggcctccctggctctgtgagatgttggtccatctttgtaaacctggtccaaagccacagtccaagattccttttatgatttccctaaatttctgaggcttgctccctcatgcttctctttgtgtcccctgccacatctgtacctgtggtttcagatccatcttgtggcaccacagtgcgaatctcagccttctcnccagtttctacacaaacactcatgttaatggtaatctattgagttaacaatttaacaaggaactttaaggtagtttggaggtgctcctggagaggggttatacgcccaaccacactgccctctgccatcctgctggctcctcctccgtttttcccaacttcctcctcctttagagcaaggaattacttttcttgtctagaactgagtgatcaacccagagtcaaggtctcgccttcaacctcaatgggcttatccatgaatttttctaagaaatctccaaaaggaattttcatgccatttgctaagagaattcgattctcctctaatatgtcctcttgtcatattagcattcgggggtgggggcggggcaaacagtttatgtagacacagaaattgatgcatgtggtgaaatgctgggagacacctggaggggagaggagggcagctgttctatttcttgtgattggtgggacaggaagcaagaatgagtgaaaatgaagataaacctgtatgggggcaggatgtgtatgggggtgggatggaagagtgaagatttgagggtttgtgggctcagtagtctctgtgggggcaagatcacttgctgacaggggatggacagaactgaaggtatgagattctcgctatagagaggagtgagggaaggagaagggatgaggggagagatgctgtttttagataaggagaagtattgacaagatgaatggagtattcttctgaaatcggaaagtatacctttgtgaagataccagttcccacggttgtacttctctctagaagccccaaatcactaagatatagaagcagagaagggggatttcaggattaatctggggttggagcttgcagagcaggacagtgtgagttctagtgctttattctgaagtcctggtgaaaaagggaaaattgagtaggaagaagcctgcccattagcactgggttgacattcagctccactctggaccatgttaccttggtgataatgaaagtggaaggagggatgcttttctgccaattttatctaagcgtcttgggcagttttaatttaaacgtatgatactacctccattttttcctggtatgattcctttcatttaattaggctctattggtggaaagtagttgatctttgatgacgttgttatctcctgaacattattatatctcccgctctggtttacaggtttttcctgactcttctcttctgcattacagctcaggactgccacccagtggcctgttagcatagagctctggaaatgctgatttttttctttaatacagccrcagaataagacaataagaaaatatttgcttccttgttggggaaagtaaaatgcagaacttcctatttaccagccaaacaaaagaagaatgcattctctcaggacctcagggactgtcagaaaataagaaaagcttttttgaccttagtaacctttgacatggttctctgagaccaagtgtgtttagccaggaatttatactaaacagggaatggaatgaaagcaggatcaggattttgaagaaaaatacctctcaaattggggagagttaggcaaagagattctgaatgtaaagtcatttggggaagacataggcccttggataaagcatactttttttgttttcctattttactttcttcctcaccctttaacacatggaagatgggtccctgtgtcctccaggtctgataggagttgtcagactgccgttgtttgagttactttatttatttggaatttctggatgtgagaagctatggaagccaagttcagattcagccattctaattctcttataagatatcctctgtgaaacagtggtgtacatttcagttttgtttttgtaaaaattgagtatcaaaattttaaaatcctacatgttttattatcaaaagatcacttacaggcataaactctagtataatttttaattttttgaattgtagattgtctttttcttttttatcatagacactctgaaagctaattgggatgacagagaagaaaaagrgaaaagaaagaatctcgaataagaggcccagtggcctcactagaaggatgagaagataagacttgctctagaggaggaaaaatggcagcttccttgcccactaaggggagacacagagacccttgaatgcaatgtagagtgtccttccttagcccttatagcggttcttcaaagttgcaactgttcctacaaatgttatttacagcctgggacttcattaagccagaatatttccctgaacactactagagatgtgctctgtaatattagcaaggtcttgctgataccaagggagggaaagtaggtgaatatctgtgcatggctctggaggcatacctagggcagtgtgggtggagtgccaggctctgttaaggattcccagtgggtcagccacaagcatatggagtgatggctcctgaacaaagactgggcagaaaagtgggcagaagggaatgccagaaattggagacagagataagatactaaacacaaacttttccacttcctaattttgtctaagataagaagattctaaaaacaaacttttccactttctcattttgtctaagtccagccctgcttgcatccantggaagataaaagattaaaactagagattattttcaacaagcatgaattgaggacctactataattggtttattgagcaatcttgcttcactggacaatgaaagtaggaagacattattttttcctgtcattgcttttacctgggctctgcaaaatatccttttcctgacacttaatgaaatcttggggagatttaataatgtcaggatcagtttggttattaaacatcattttgtttaaaactccaatcatatcctattcaagtttcaaatattaccttacctcactcctgctccaggtactaggtcacaaagaaagtctttaaagtcaaaatgtttaagaatctaagttatatgaaccatattatctggctatattgtaataatcatataagaaataagagacttaacttacctatactgttataggttaaaaaaaattgtgagncatttacattaacagtgaagaagggaaacattgatattttcttttcataaaaacaccacactacttcttttagcatctgagatagaaacagaagctaataaatagggaaagagtttttgatttttaactttgtatttgatatactaaaatagcagcccataagttcaaaccccatgtgtttcatttttattctgatataataatttgaatagagaaaattcttaaagtatcttaaatgctcatttttccctcaaatatctcatataacatggtgctcagaataaggtgaaatgcaatatgttgctgtttgtagcagcacggtttctattttaatggctgatgatttaaaattttattttaaaatttatatatgcatatatctatattaaaatataagattattttatattttattttaaaatcatcttctaagatcaaaaacaatttggtttgaaatgacagtacaaggaatgtgcatcagtgcctccatgtcaacctgctgacactgaacgttcagttttattctgcaaccttctgcaagctaatttatacagcatccaaagctaaggcgaaaatcaggcctggagttagaactcactggatgtcaatctggtttctgatggataacagaggctgaggacataaaatagtccgagtgttatttatgctattcagctagatatgtttcattgaaagcaacttgttttaaaatgtctatgagcttggagttgtatttatattgcatcagatccacaaaggtgtgcagtttctggctggcactgatctgttgacatgtccttggcataacacacttgaaaagttacaacagactgcttttttctccatgttgttggttttcagaaacttataaataactgaccaaatcttctaaattagaagtagttggatactagcaatggttcaaaacttcctacagggaagtccaactgagtatacttggaatgttgttgtgacacagcctgaatacaggcactaagtttctgtatatgaggcctagcattaaactcagatttgtagggaaagtctgattcatggcatggaaattggaaaasaccttatactgttgtaggtcttgntgggaatatctgcaaggcatggcctgattagaactccaatctgtaagctgccatttacttgctatgcctcattttatgacccagttgntgctacttcatctcatgaatttgttggtgctaaagctattggggtggttataactaccctgtagcttgagttgagaaccaaggaatgttactgcttatgacctgaatacacgakggtagacttgtaaaataatcttggatataagttaggattttatctgttatgcctagtagataaaatccttaccagaaagtcagatctgaagttcctcattctgctgattgtatttgatatcttcaaaatcaatgtttaagtttttcctagtcttgtattaggtcattattattattatytggaaggaaacttgcaggatctccacaaagtgtcaggttcwtttgctgagatggatcaatagattcatgtttkaagacattgcctttttgcatttggcacaatattatcttgctgattactggcttcactcatagatgcatttaaaaagctctttcaaagggtgcagtatttgaaacaggataaaacgcccagactcattttgttgcatcatagccctcagaagggaagtaggattaatggaatccttattttgagctaatttggtagcagagtattttccagtagtgctactattagtcctcattagtaagagttccatcatgacagggaaagggctgattatctcatccatcacggcttctccagcagtaaacataataaaagataatttctattttatttttataaatgctctgttccttcttcatttcagagatgtcttgagttgcactgatacaatctagcctgccattttaaaaacaaaggttgtgtttaactgaacccaggtccattgctttttttttttttttggtagaaagcctgtatatgttcaggcctgtttcttcaggcttactcatctgaacacagtttttgactcaacaaagtgtattagcagccagatcccccatgcacacaattttgcttcagcatatcccagaacaacttttctttttggcatcccaaactgtaggtgtaaaatctagtttgtgtttagttttagagttgttttttgtttgtttgttttttgtttgtttgttttttgtttgttttttgtttgttttttgtttgtttgtttttggtgtaggtttcaatatgaatggaggtttaggtatggctggatcaactactgtacaaaagccaagggaagtggaagattcatctttgcctttcttgtctgtccattaggatactttaaccactcttgggaatttatggccaggaagtctattcagcagacttcctaattggcagaggaagcacatttccataaaagaagagtttctggaggaagctagcagctccattagttctgttggaagacagtgcacttgaaaggtgttttttgttttcttgtttgtttgagacggagttttgctcttgttgcccaggctacagtgcaatggcacaatctctgctcactgcaacctccacctcccgggttcaagcgattctcctgccttagcctcctgagtagctgggattacctgggccatgcctagtgtggccgaagccgagttctgactttggcgcggttcagttcatacatctctgatgttgacatcagaagcagaaacgccggagaatattgtatagtagaaacacaaaagatttatagggataactaanaccaagccattcggagcctgatatntgaagtttccttccgtgttcaggctttctgagttttgctctatggtattctggcctctatttctgttagctgggaaggattttaatgtaacgttaagaaaactcttttctcaggtgtgtgatactgagcctataaactgtttgtgcagcttattaataaaatcttgtggaaaaggtgtcatgctatccaaacaggcaaattctgtaataggagagtctctgacgcctgaaatattatagtttgctttgactccctcagactggtttggtgtgatattttctgcaactggcatgtacacgcctgcacctggggcggtggggtccctgcgggctgcaggctccgggttgccgcggagacgcgtctgctttccctcggtcttcgcggggcgggtggggggaggccagggtgcctggaggcctgaacacatccaacagctccagcaggctgagggcgagcccaagctggggctgaggacagtagagctgaacgaagacgcacctgagacggtctacaccagcggtgtcgctgcccgaaagtgagagaaggctgataytgctagctggaatccaggcctgggtgctgcatggtggcgcccctccccgtgaccaccgctgcgttttctcggggtgagaaaggcgcccccaccatgcccctgcccctggacttctggcctaagaagctccagcgtccgctacctccctgggagggagtggggtgggggtggtggggagcaggacatgttctggattctcaggccgccccctgcatgttccattgacttttagtatgggacatggagatattaagcggcatctcagagaatctcctgggtttagacacagacttccctagccctgttgtttagtagcaatctaatttcccttttgtaatcaggatctatggctgcagcaattgagtactgttctttgtttcagtggcaggagaagccccaaaaggccaggtgcttgtttcagctgccaattcaagggctccattgttgttggcactaagacacacagccagcagggctcagagttgggacgggaagcaaaagtcctgcaattgagttgttagctatggaataataaggggaatcacctcacaaccattccttgatcctgggctggtggaagaaacagtacccatgtatcaatccctctctccctgtctccctctctccctctggcattctgtaagatagaatctatccttttagggtgttgtcccctaattggtaccatctgtagctgagtttttggtaagcctcttaccagcttgttaccatgacccacatgtttcgtggtcatgggttacctggtaaggccagtgaatttctagggaatcagtccatcagttttgtgagtgcagatggtgctggctagtacatattctggcagggagagctaatccatattcagaatagtgtctattccaaggaggacaaatcagttctccttctatgatgtaaggggcctgatgtaatcaatctgtcaccaggtggttggctgatgttcccgggggaatggtgctatattggagactcagctttggtctctgctgttggaagatcccacatctggtaatgttggtagcaggcctcagagaggggaactcacattattgatccctgccagtatggccactttgcatttgggaaagaggctgactgaaggaatgtgatttttgttttttctttgagacagagtttcactcttgctgcccaggctggagtgcaatggkatgatctcggctcactgcaacctctgcctactgggttcaagcaattctcctgcctcagcctcccgagtagctgggattacagacgtgtgccaccatacccgactaatttttgtattttgagtagagacagggtttcaccatgttggccaggctggtcttgagctcctgacctcaggtgatccgcccacctcagcctcccaaagtgctgggattataggcgtaagccaccatgcccagccaggaatgtgatttttatctacctgtaggggttgccctttagtgagcacgcacatgaggacgcagatatccacatcatccatatacctctttggaggcattcctattaaagccaaaaataagacaaacacacctgctatccccatgtcagtcaacattgtagagagaatttggttaatgtagtgagacctgaaaaagaaatagacctgaaaaaccagtgtctactatagacactggttgcttgagctcataggacttgctcagaagccttatgaaatgtatctcagaactgtctgcataggggaataaaggggaaagcacttttccacttgctcctattccccatctgtcaaggatttcctcatcaagcattaactctccctcccctaccccacttctgggttgtctctgagtgctgctgagcaaatttccaggacaggaacaatttccaggacacagtgaggttaccatcaggttgcacctgggtggcaaagaggtcagaagtggtgagcaagacatatccaatatcaagtgtataataataaggaagagaataaactaatttacataaacatgattattagaaaatccaaagaatattataaacagaattaataagaggcctcaacagcatttctagattgaccaatgtacaaaaatccatagtggttttgtatattgattagaaaaggcaatcaaagtctaggtgcggtcactcacgcctgtaatcccagcactttgggagactgaggtgggcgatcacttgaggccaggagttcaagaccatcctggtcaacatgatgaaaccccgtctctactaaaaaagcaaaaaattacccgggcagggtgcaggccttgcaggcctgtaatcccagctactcgggaggctgaggcacaagaatgagcctgaggggaaggctgcagtgagctgtgattgcgccactacactccagtctgggcaacagagggagactctgtctccaaaacaaagcaagaaaaaacaaacaagacacaaaccttaaaactccccaaactcctattcctgaggcaaataggcaagatactaaagtatgataaaacacaatggaggttcagggatgttcgttgcattatattcttttttcttttttctttttgagacggagtctcactctgtcgcccaggctggagggcagtggtgtggtctcggctggctgcaagttccgcctcccaggttccggccagtctcctgcctcagcctccctagtagctggcgcccgccaccacgcttggctaattttttgtatttttttagtagagacagggtttcaccatgttagccaggatggtctcgatctcctgacgtcgtgatccgcccatctcggactcccaaagtgctgggattacaggcgtaagccacgcgcctggcctcgttgcattattttctacattcatctttatgtacaaaaaaacttaagtccggttaaggctgattggtttaatctgaattctgactttatttctctgtgagaatttgagctttgttctcccttgtgtgcgatctttattctctagtctgtttctgtggtcacaagatggctgccagtaacatatggggcttcatgcatccttgttcacatccagagacagacctctcagagctattgtgaaaattttttgagcttctcagagtatcttgggtcaggtgcgcacttctacattaatcctgggggctgggggaattccatgccctgactagcttgggcaggactgttaaattaatcaatatggcaagggggatgggactaccctgattggctgaggaggttgtcagtcccattaaaaccacatagctactacacaatggtgacagacggaaagagtattgggagggtcgggtgcggtggctcaggcctgaaatcccaactctttgggaggccaagagggtggacagtttgagcccaggagctcaagaccagcttgggcaacatggtgaaaccccaactccattaaaaaatacaaaagttagccgggtgtggtggtacacaccagtagtcccagctactcgggaggctgaggtgggaggatcgcttgagcctgcgagggggaggttgcagtgagctgagatcgcaccagtgcactccaacctgggtgacagagcgagactcagagggtctcaaaaaaaaaaaaaaaggtattaggagacaatgactatgtatgtaggtatagtttttcttgtttacatatgaatttgagaccatgttatatgtatggctaaaatatatttagaattttttgtttagagcaggattatttgtatcaataatggtttctaaaaacctggattcaaccgaaatagttaactaaaagggaacaaaaatgtgggctattacgcaggtattaataatgacaaattgtagacttagctttttcaaagcttgccaatgacttggcagtgaagtaaataataaaaagtcatgttgatgtgatttttctgtccagtaacctcagataataatttaaagccacctttaatatggcttcctgatgaaaaagtgaatgctttgggcaaggaaaacagtattcagtgattcagtgggtgctttattagatgtagtcacaactccattattccctttcatggttctcatgttttcaacatcatgaatgtttcagaactttttttgtattctgattatgtcatttttttatttgtcctcttggtcctataattcccccctgcatcagaacattagaatctacctactctactaggaagtagtctcaacaagttgaaaacatgagtggaaaaaagtcatgtgccaatgaaagtggggaaggagttagtttgttaatttccaaggtactaatttaaaaaaaagttgtaaaatacttataaatgttattttaaccctttttgagtgtgaaatttggtagaattaactatatttacattgttgtgcaaccatcactacacgccatctccaaaacatttttattatcccaaactgaaactccctgttctcccaccctggtaaccactattatattttctttctctaccaatttgattcttctagatacctcatttaagtgggaccatataatatttactcttttgtctagcttatttcatttagtataaagttttcaagatttaaccatgttgtagctcataattattgataggtaagaacttacttttaccttttttaaatttattttctgtacatcatagctttgtttcccattccttctgttactacctttctttgtctttattttttctgagctgactcattttgattaccttttcatttcatttgtgtgttttctatagataatttctttgtgatcactatggggattacatgtaatatcctaaagttataatgatctactttgaattgataatttaacttcagtcatatacaaaaactatattcctatacaatttcatcccacctttatgttactgatatcacaaattacatctttatacattgtatacccattaatatagatttataattaatttttatgcatttggcttttaaatcctgtagagaataaaaagtggtgttacaaaccaaaattacaataagactgatttttttcaaacccttggtcagtttgaaaaattttaaattttattttattttactttaagttctgggatacatgtgcagaacatgcaggttggctacataggtatgcatgtgccatggtggtttgctgcatctatcaacccatcatctaggttttaagtcccacatgcattaggtatttgtcctaatactttcactccccttgcaccccaccccccaacaggccttggtgtgtgatgttcccctcccttcctccatgtgttctcacttttcaactcccacttatgagtgagaacatgctgtgtttagttttctgttcctgtgttactttgccgagaatgatggtttccagcttcatccatgtccctgcaaaggacatgaattcattcttttttatggctgtgtagtattccacggtgtatatgtgccacattttcttaatccagtctatcactgatgggcatttgggttggttctaagtctttgctattgtaaatagtgctgcaataaacatacatgtacatgtgtctttatagtagaatgatttgtaaacctttgtgtatatacctggtaacaggattgctgggtcaaatggtatttctgattctagatccttgaggaatcaccacactgtcttccacaatggttgaactaatttatactcccaccaacagtgtaaaaacattcctatttctccacagcctcgccagcatctgttgtttcctgaattttaaatgatcatcattctaactggtgtgagatggtatctcattgtggttttgatttgcatttctctaatgaccagtgatgatgagctttttaaaaatatgtttgttggctgcataaatgtcttcttttgaaaagcgtctgttcacatcctccatccactttttgatgggattgtttgtttttttcttgttaagttccttgtttagacatttgtcaaatgggtagattgcaaatttctctcctattctgtaggttgcctgttcactctgatgatagtttcttttgctgagaagaagctccttagtttaattagatcncatttgtcaattttggcttttgtcacagttgcctttngcatttgagtcaggaagtctttgcccatgcctatgtcctgaagggtattgcctaggttttcttctattgtttttatggttttgggttttacatgtaaatctttaatccatcttgagttagttttcatataaggtgtaaggaaggggtccagtttgtgttttctgcatatggctagccagttttcccagcactgtttattaaatagggactcctttccccactgcttgtttttgtcaggtttgtcaaagatcagatggttgtagttgtgtggtgttatttctgaggtctctgttmtgttccattggtctatatatatgttttgataccagtaccatgctgttttggttactgtagtcttgtagtatagtttgaagtcaggtagtgtgatgcctccagctttgttcttttttgcttaggattgtcttggctatatgggctcttttggttccatatgaaattgaatgtagttttttctaattctgcaaaggaagtcaatggtagcttgatgcgaatagcattgaatctataaattactttgggctgtatggccattgtcacaatattgattcttcttatccatgagcatggaatgtttttccatttgtttgtttactctcttatttccttgagcagtggtttgtggttctccttgaagaggtccttcatgtcccttgtaagttatattcttaggtactttattctctttgtagcaattgtgaatgggagttcactcatgatttggctctctgctggtctgttmttggtgtatgcttgtgatttctgcacattaactttgtatcctgagactttgttgaagttgcttatcagcttaaggagattttgggctgagacgatggagttttctaaatacacaatcatgtcatctgcaaacagagacaattttacttcctctcttcctatttgaatacactttatttctctctcttgcctgattgccctggccagaacttccaatactatgttgaataggagtggtgagagagggcgtccttgtcttgtaccagttttcaaagggaatgcttcagcttttgcccattcagtatgatattggctacagacttatcataaatagctcttattattttgagatgttccatcaatacccagtttattgagagtttttagcatgaagggatgttgaattttatcaaagccatttgctgtatctattgagataatcatgtggttttgtcattggttgtgtttatgcaatggattatgtttattgatttgtgcatgttgaaccagccttgtgtcccagggatgaagccgacttgatcatggtggataagctttttgatggctgctggattaggtttgccagtattttattgaggatattcacatcaatgttcatcagggatattggcctataattttctttttttgttgtatgtcttccaggtgatggtatcaggatgatgctggccttataaaatgagtaagggaggagtccttctttttctattgtttgggatagtttcagaaggaattgtaccagctcctctttgtacctctggtagaattcggctgtgaatccgtctggtcctgggctttgtttgggagggtattcattactgcctcaatttcagaacttgttattgatctattcagggattcaacttcttccttgtttagtcttgggagggtgtgtgtgtccaggaatttatctatttcttctagattttctggtttatttgtgtagaggtgtttatagttaatagtattctctgatagtagtttgtatttctgtgggatcagtggtgatatcccctttatcattttttattgtgtctatttgattctttcttttctcctttattagtctagctagcagtccatctattttgttaatcttctcaaaaaaaaaaaaaaacagctcttggattcaatgatttttttaagggttttttatgtctctmtctctctcagttctgttctgatcttagttatttcttgtctcctgctagcttttgaatttgtttgctcttgcttctctagttcttttaattatgatgttaggtgtcaattttagatctttcctgctttctgatgtgggcatttagtactataaatttccctcttaacactgctttagctgtgtcccagtgattctggtacgttgtctctttgttctcattggttttaaagaactttgttatttctgccttcatttcgttatttacccagtagtcattcaacagcaagttgttcagtttccatgtggttgtgtggttttgagtgagttttttaatcctaagttctaatttgacggcactgtggtctgagagactgttatgatttccattcttttgcatttgctgaggagtgttttacttccaattatgtcatcaattttagaataagtgccatttggtactgagaagaatatatattttgttggggtggagagttctgtagatgtctattaggtccacttggtccagagctgagttcaagtcctgaatatccttgttaattttctgtcttgttgagccatctaatattgacagtggagtgttaaagtttcccaccattattgtgtgggagtctaagtctctttacaggtctctaagaacttggtttatgaatctgggtgctcctgtattgggtgcatatatatttaggacagttagctcttcttgttgcattgatccctttaccattgtgtaatgcccttcattgtcctttttgatctttgttggtttaaagtctgttttatcagagactaggattgcaacccctgtcatttatttgccttccatttgcttggtaaatattcctctatccctttattttgaacctatacgtgtctttgcacgtgagatgggtctcctgaatgcagcacaccaataggtcttaactccttatccaattgccagtctgtgtcttttaattagggcatttagcccatttacatttaaggttaatattgttatgggtaaatctgatcctgtcatcatgatgctagctggttattttgcacattagttgatgcaatttcttcatagtgtcattggtctttacattttggtgtgtttttgcagtggctggtactggtttttcctttccatatttagtgcttccttcaggagctcttctggtggtgacaaaatacctcagcatttgcttgtctggaaaggattttatttctccttcacttatgaagcttaatttgactggatatgaaattctggattgaaaattctttcagaatgttgaatattggcctctaccctcttctggtttgtagggtttctacagagagatcaactgttagtctaatgagcttccctttgtaggtaacttgacctttctctctggctgcccttaacattttttcttttgtttcaaccttggagtatctgcaattatgtgtcttggggttgctcttcttgaggagtatcttagtggtgttctctgtatttcctgaatttgaatgttggcctgtcttgctaggttggggaagttctcctggataatatcctgaagtgtgttttccaacttggttccattctccccgtcactttcaggtacaccagtcaatcataggtttggtcttttccacatagtaccatatttcttggaggctttgtttgttccttttcattccttatttttttttctaatcttgtctttacgccttattttagtaaggagatcttcagtctctgataccctttcttccgcttgatggatttggctattgatacttgtgaatgcttcacacagttctcatgctgtgtttttcagctccatcaggtcaatttatgttcttctttagactggttattctagttagcagttcctgtratcttttatcaaggttcttagcttccttgcattgggttagaacatactcctttagctcagaggagtttattacccaccttctgaagcctacttctgtcaattcatcaatctcattctctatccagttttgtgtccttgctggaaaggagttgtgatcatttggagaagaggcattctggtttttagaattttcagcatttttgtgctggtttttcctcatctttgtggatttatttaccttcgatctttggggatgatgacctttggattgggtttctgtgtggggttcttttttgttgatgttgatgttgatgttgttgctttctgtgcattagtttttcttctaacaggcccctcctctgtaagtctgctgccgtttgctggaggtccactccagaccctgttttcctgggtatcaccagtggaggctgcagaacagcaaagattgctgcctgctccttcctctggaagctttgtcccagaggggcactggcctgatgccagccagagctctcctgcatgaggtgtctgtcgacccctgctgggaggtctctctcagtcaggaggcacgggggtcagggacccacctgaggaggcaggctgtccctttgcagagctggtgcactgtgctgggagaatcccccttgtcaggatcagctgctctcttcagagtcagcaggcaggaaaaattaaattcgttgaagctgccccacagctgcccctcccacaggtgctctgtcccagggagataagagttttatctgtaatcccctgactggggctgctgcttttccttcagagatgccctgcccagtgaggaggaatctagggaagcagtctggccacatccactgtgctgtgctgtggtgaattctgcccagtccatacctcccagcctccttagcagtgtcaggggaaaactaaagcctcataatagcagatgcccctccccctaccaagcttgattgtcgcaggtcaacttcagactgctgtgctggctgtaagaatttcaagccagtggttcttagcttgctgggctcctttagagtgggacctgctgagccagaccacttggctccctggcttcagctgcctttccaggggagtgaatgattctatcttgcttgggttcctggcaccactggggtatgaaaaaaactcctgcagttagcatggtgtctgcccaaacagccacccaattttgggcttgaaacccagtgccctggtggtgtaggcacacgagggagcctcctgatctgtgggttgcaaaaaccatgggaaaagtgcactacccagtcttggtagcacggtccctcacggcttcccttggcttcgggagggaggtcccctggcttctggcactttccgggtgaagtgacacttcagcttgcttctgcttgctgtctgtgggttgcacccaatacctaaccagtcccagtgaaatgaactgggtacctcagttggaaatgcacctaccttctgcattggtctcactgggagctgcagactggagttatttctatttggctatcttggcccctccctaaacacatctttttaaatatgccatccaatgtgttgtcaaaaaatgattaattaaaacatggaatcaaaaatgtacacatttctaggctttcaggggggtcctgacatcttagctgtggatctcccaatacctgcaggtcacagggccacagaagctgcacctctaggagcagaggacacagagcagtgaagaggagacctggagctctggctgcagtgagagacccagtttgcaaaatttttattgctgcttttgtaattttgttgcttttcttttattacctttcatatattatatatatatataaaatatattatatatatataatataaaaaatatatattatatataatataaaatatatatattatatatatataaaatatatattatatatattatatatataaaatatatattatatatattatatataaaatatatatattatatatatatataaaatatatatattttatatatatataaaatatatatatattatattatatatataaacctctctcatgtatatgtgtgtgtgtgtgtgtgtgtgtgtgcacgtgtgcatgagtctttttttatgctggtaccacactgtcttgctatgttgcccagctgatctcaagctgatcttcttgtctcagtgccctgagtagctgggattacaagtggctgtaatcacccggctgatctttcttttatattagtccatgtatttatttttgctgaagatcttcatatcttcctatgggtatgagttactgtaagtgtccttgcatttctacctgaaggactaccattaacattttttataaggcaggtctagtggtaatgaatttcctgggtttctggttatctgtgaatgtcttaacttttccatcattttgaaagactgttttgccagatgcagaattctcagctgacattttctttcagcactttatcccactgcattttgtcctccaaagtatatgctgaagaattgattgatagtatttttgaagattgcttgtatgtgatgagttgcttctctcttctctcaattctgtctttaacagtttgattataatatgttttggagtggaccactttggaagctgagtttcttggatttgtatattaatgtctttcattgtatttgggattttttttagtcattatttctgcatataatctcactatctctttcttctccttggattctcataatgcatatattaatctgcttcataagtcccttcatctctgttcacttttattttagatttgaaaattttgaatgtactatcttccactgatttttttttccttctgcctgttcacatctgctttgatttctcttgaataaatgcctaggagtgaaattgccgggttatggtttcagtatatgtttaattttataagaaactgccagacatttttggaaagtggctatgtattttacacttttatccataatgcatcagagttgctattgatctatatttttgccagcatttggtgttaaagtcttcaattttaaccattctgatgggtgtgtaatagtaccttattgtagtttaaatttgtgggttttttgggctctgatcattaatctctgacggctaatgatattgaatactttttcatgtgtttatttgccattagtagattttcatttgtaaaatatctgttcaaatatattgccccttatttaattgagtggtttgaaccttttaaagaaacggagttgtgggagttccttatctattccaattattagtcctatgtcacactttagttttgagaatattttctcttggtctggagtttatctatttttttttagtggtgtattttgattaggagcagcttttaatttggataaagtctaatttatcaattttttgatggttatggccttctttgtcctttccaagaaacttttgcctactcccaagccataaatacattcttccagaagtttcatagttttattctttgtttagacctgtgatccattttgagttgacttttgtgcaggtgtggggtaaaggtcaaggttcatttgttttcccatttggattttcagttgtttcagtaccatttgatgaaaagacttctttttgcataagattgctttgatacttttgttgttgaaaattagtggaccatataaatatgaatctacttctaagctctgttctatttatctacttgtctgttttttatgctggtaccacactgtcttgattaccatactttatagtaaatcatagagatagatagtaccagcccttcaagtttgttcttcttttacaagatgtatttggctattttgggtccttttcatttatgtgtaaattttagaatcagcttgtcaatttctttgaaagcgcctttcaggattatgatttgggttgccattgaatctacaggtaaatttgaggagaattgacatcttaacaacattaagccttccatctatgaacagatgcatttctccatttacttcagttttcttcattgtccttcagcgatgtttacagttttcaatgtagaggtcttgcacatcctttgttaaatttatttttaaacatctaattgtttgatattgaaaataaaatttatttcaaatcatttgcttctagtatataaaaacataattgctttttatactaaccttgcatcttgcagctttgcgaaactcatttattctaatagttgttttgctgattacttggaattttctacaatgttgattagaagtgttgagaatagacatctttgctttttctttttatcttaggggaaaacatttattccaccacttcatatgatgttaaatataagtattttgtaaatgttctttatcagattgagaaagttccttccaattctaaacttactgagacttttataaaaattcacgataaaataataatgaattttgccaaacggccttttctgtacctactaaaatgatttttattatctcctttattctgttaatatagtgaatttcatttttttcaaacaataaactaaacttgcttctctaggaaaatctgcaactgctctcaatgtattctttttaacatattgctaggcttgacttgttaatatattaagacttttttcacctatttttctagcagttttgttttagaatccaaaagcaatatatacttacagcaggggggaccttcaaccaatttaaaagtgaatcaattaaatataaaagttanttctttctatcccatccatcctcttaaagaaataatcacaatgaacaatttgatgtgtattcctctcactttttaaatacatgcacaaatatatacagtttaaattctgctttttcacataacacttcctcataacattaaatattctccaaaatatgtatttttaatgtatttaactattttcctattgttggacatataggtcgcatatatttattcattgagacagggtctcactgtgtcactcaggctggagtgcaatggtgcgattatggttcactgcagccttgaactcctgggctcaagtaatcctcccaccttaggctccccagcagctgggaccacaggcacatgccaccacatctagctaattttttgacttttttgtagagatgggggtctcactttgttgcccaggttgctttcaaactcctgggctcaagagatcctcccgccttggcctcccaaagtgttgggattacaggtgtgagccatggtgcctggccatattactttattatggaatgaaacaaaatgttaaagatgatgtatgctgagagtacaatggagttacataccaggtgctgaaaagacttctcaaagtagatggctgtgcttgagctgatttctgatagttgacagagtgctgagttgtttcattaagaatggaagacagggagggaaggaagacaaagtaggaaaagcagaaggaagacagaaataaagaagggggaaaaggacawgagaaaaaagatgaagaaaaaaaatcattagtatcatgcttagtagctgctcgacatatacagtgttctgaaccaccagcccatttctccatcccatctttaaaagaaagatccttccaatgtagttcaccctttccttgcaaaatgttttttgttatttgaattttactatttttagctggtgaaaagccaaacaactcatggaaaactttcccatgaggtaataggaaccactgagcaacattccaaatgtcttatttcaagtgattacacataagatttgtttttcttctatgcttttctgttggataatgaggaatatatacagatgtttattttgtaatgtctccaactcctcttgtagatcctatcatagtgtatcctctaaaatctaaacatacttggcaggtgatttttcctcttttcacctccctcctttgaatggccaacaacagaatatttccacttcctaagtttggctcttttacttttttctttctttctttctttytttttttttttattttttttttgagactgggtgtcactctgttgcccagactggagtgcagtggcgcaatctcggctcactgcaacctctgcctccggggttcaagtgattctcctgcctcagcctcctgagtagctgggattacaggcgcacgccaccatgcctggctaatatatatatatctatttttttttaagtagagacggggtttcaccttgttggccaggctgctctcgaactcctgacctcaagtgatccacccacctcggcctcccaaactgctgggattacaggtgtgaaccaccatgcctggccctttatttatttatttatttttttaatgagacagggtcacactccatcacccaggctggagtgccgtggtgtgctcatggctcatttcagccttgacctcctgggctcaagtgatcctcccacctcagcctcctgagtagctgggaatgcaggtgcacaccaccattcccagctaatttttgtattttttgtagagacagccatttgccatgttgcccaggctagtctcaaactcctggattcaagagattcacccacttcagcctcccaaagtgctgggattacaggcatgaagtttggctcttttaaatctacctgaattctgcttctctagtatcccactgtcttcctactgaatactatttaagagtaaaatatattggagattctcatgatttcctgctagtcttctagcatcattgatttgtgcaaaaggaaattgcttcctagactgttctagctattgtagttccacatagtcttttcaggtggaactagttcttgctctactttacttaaggtatattttctttctgtgcaccatttttcttttcttttttttttttttgacagagtcttgccatctcaaaagtgagatggagtgcagtggtgccatctcagctcacagcagcctctgcctcctaggctcaagctatcctcccacctcagcctcccaagtagctgggattactagtagcataggccaccatgcccagcttattttcatattgttagtagagagggggttttgccatgttggctggcctggtcccaaactcctggcttcaagtgatccacctgcctcagcctcccaaagtgctgggattacagcatgagcaactgcacccagctctgtgcataatttttcttatctgaaacatgggtgtaaatttaccatgctgctttctgaagggaggctgtgataatcaaatggaatgtgtgtacaacttgcttaaatggtcaaaagtggttgatgtcatattcattattaatatatattaataatgatagctgccatttagtttagtctttgatatgtactaggccctgaggtaggtcctttattgacattatctcactttaattctcaaaacaattctattattcacattttagagatgaggaattaaagcaatttacctaacagcattcagagacagaattcaggtctttctgaatccatagcctaagcttttaaacattatattgaatgcctgtcaagaatatttattgaatgtacggtatgaaatgtaataatgaggttacctgaatagtcactaaataacagcaatctatgattgcttaggtggtttccccactattggtttagccataagctaaaaataataataattttaaaataccttatttttgtgtagcacttactgtatagacatttaattcaatcaacactgcattaaccagggcagatattaacctcactttgcacgtggtaaaacaatgcttcagaaaggttgatagtcttagatctcacaactagctgagtgccaacgccagatctttccttttttatgttcattactataactttattgacctgcagtagctttttttttttttttaggaaatagaaacaacagtcaattgtaatacttaaatataattatctcacagatcagaagtctcatttcagtcattctccaagatttaatgtatgtatcatgttaattctctcatgctaatggtttttgtccttggggctgtattagttttctgtggttgctgtgacaaattaccacaaacttggcgatttaaaacaatgtacatttactggcccacaattttttaggtaagaaatccaacatgtctctcactggactaaaatcaaggtgttggcaaggctgtattactttctagagatcctaagggaataattcatttccttgccwttctagcgtctagagactgcccatactccttggatcacggcccttcctctattatcatagccagcaatgaagggtcaaatccatctcacatggcatcattccaatctcctgtttttcttcctcttccactttcatggacccttgtgattccattgggcccatccagacaatccagaataatttccctatcttaagggaaattacagctgattaacaactgtaattccctgttgctatgtaacataatatattcacaggtttcagggattagaattaggacatggacatctttgtgggaccattattctgcctgccacaggggctcatttatgtttaaaatgaaggacaaaagtgattggcgtaggtagttgcagtgactttcctcagtggtctgtagatctgtttccataacagcaagaagagagctgttmcawtgtgggttggtgagcrggtgggttgggcatgctcatacacaaactgctcggtagggaaaggagaaggcacatgagcaagggatggccctggtggccagggtaaggattttactttgtgtgctgaggcattctagactatttgggtttggaaaataagtttcaaaccactgagcttggccaataaggtttttcataatatagcccttgctttcttttcaagtctcaatgagttattttttctagcttaaatgagatactaaatatcaaatacttggtataaggtagatatattagtcaaggtacttagttataaaagcaaaaaacaaacctacttcagttagtgtaagcgctaagaaatttgttaaagaatagtagaatcttgagggcaggacaaccatgccaggtggaggagcaggaacaatgtcccaatttatattaaggaaggcttcagagcctggacacaggcctgaacatgggatgcaactgctgggctctcagcaagtgctgcctctgaaggctgaatgcttcctttccatccggcgagaaataattcttaccagcacctccttattcatgtcactcttttaatttgatgacttagctagatagttctgatcaacagagtccaggtcccatacctatatgccactcacaaacaaggttaaataggtgagtttctgacttctgtactggagaggcagggactccaatagtagggaattcccaaaatatatgaaagttgttaaaaagctgcgagaaaacatgacaaatattccaatagtaggtagtcagtaaatagtacctctcttctccagggagaagaacatactagaataggtacataaacatccattaacaggttagatgagtgaagttcactatgaaattttattatgaaaactttcaaatacataccaagcttcaacttttgtcaactgatggtctaccttgttttagctctacctgtactcgttccttcattttccctaccyccactgttttgaggaaaatctcaaacattaaatatttttgttcataaatgttaacatgcatctctaaaacgtgaagattgcttatgaatttttgattgtggagaagtaacatggcataaccacatttctgaatttagataaggattcatattttccttcagggcagaagtgttgatccagtccccactgtgtggaagatatagttagttcacattcttcaggagctcacaacccatttattcattcatccatgcattcctccatgaagcaggaaaacaggtaagtaagtaccggctaccttttctacgctgggctcaacatagatgaatcaaaatataatcactgttcttaggaaattttgatgaaaagcagataaaggcctaaagcattaaacaacaaagctgaatataaaccattagtcagtaagcaatagacagatatggtaaggcagcaggtgagtgatcacaaaatgaattaagaaatagtagacaaaattctctacatatttatagaaggtttttgatatgctcattcatagttagtgttcattttgcattgctataaaggagtacccgaggctggctaatttatgaagaaaaaaggtttaattagctcacagctctgcacactgttcaagcatggcacctgcatctatctgctcagcttctggtgaggcttcaggaagcttttactcatggcagaagatgatggtggagcaggcaggtcctatggtgagaaagagagcaagagagggagggaggaatgccatgctattttaaacaaccagctcttatgtgaaccaacagaatgagaactcattcattactgcagtcagggcaccacaccattcatgagggatctgtccccatgacccaaacaccttccactgggccccacctccagcactggggatcacatttcaacatgagatttggaaggaacaaatatccaaaccatatcagttactcacaggtagaaattacatgggtacttaagataattgagtatctttgtggattattcaatcacagaaatttaaaacaaattttagaacagagaaaaatttgcccaacatatttgttaaactttcctgtcaggggattacatcaaagcacgttcatctcctcaaacatattgctaatttttactcaaatatgaagtggtatctgaaattatgtcagtctctgaggttgtaattgtaggtgtgcaacttcagtaatttccaaacccaaagaggcacacatctaactcataatggctataacaaatgtgtacataaggaagaaatacagccctttatgtttataagtaaaacatggataaatattaccagaacttaactgagtttttaaatttttttaatttcataagtgtagtcagtcttcgactcctctgtttttatcattttcagtagagatagaattgcaaacaaggaaagaattctatggactatacaagttggtctagtgctttgggcaataagctaatcctcaaattgcttaactctgagcatactatgacattcatcagatagcatatcttaaattgacgctgtgaaacacaccttgggtgtgggtgcttggttgtataaagttctgtatttcatgtaaaaagcatggggtaaaaagttatcaccctaatagtgaggctagaatttctcaagtatggcaaattaacatgcgaggaacagtattttctgagtgatcaggcacatggctcgtttcttttgaaacctgccattctaagtacaagtcattgacttggaaatggatatcaaagagaaggtcataatagtgatgaagaagtttacactcaaatctttttaaaaaaccttcaaccagttactgaaaatgaaacaaaatatcaaaggtcttcctctgcatgggcaatcaaataggcactgctatcatcatggggaaactgtttctttgtgatattttgtgtctaaacttttttgtaagatgctctgaaaagtgaagaaagggataagaactacaatgtctttggccaagaaaagtagatttgaaagggctgtctggcctataagtggacgacactagggctctggaggaaaattgttatttactgaaaagaaataacattgagtggcttcaccatgtttactatgaaaacagactggaggctgctgatgtaattatattttcattgtgcacttgactccttataattgtttggaggctgtacagaaaagagttggcataacaggcccaagtgctattctttgacaggcttgattataaggctggcatctgcgaacttaggttgtgggagggttcctgtgattaactggtagagtgtaccagttagaggtacaatagcttagtacctaagctatttgaacaaacaatgtggttatactgaacacgtgattttcttctggaaatttaaagtttgggtatgtgccaatcagaggatgcctacataactagcccccaataaaatccctgagtgctgagtctctcctggttggtaatatttcacatgtgtgctttcaacttgttgtcaggggaattacgcacatcccacgtaactctgttgggagaggactctggaaactcatgcctagtttcccccttgctttgccccatgtggcttttttcctttgctgattctgccttatatcatttcactgcaataagtcatggatgtgagtatgactatgggccgaatccctcaaacaaatcatgggaccctgcatggtcttgggaactccttacacagtggctctaaagagaaatatgagaggattatggccttggattttggaatattgctttttttgtacatttgttatatttagtagggtagagtcagtatgctatagagcaaacttgtctaatctgtggcccacaggccgcaggcggcccaggacagctttgaatatggctcaagacaaattcataaactttcttaaaacattatgacattatgagcttttcttgcaattttttttttgttttagctcatcagctactattagtatttgtgtattttatgtgtggcccaaggcaattcttatgttatggcccaggaaagccaagaaattggacacctgtgcataaagggtgaagttgtgggccatggcatgaaagagaccaaggtttgaatcctagctgtgacttaagcaagtgactttgacactctaagcttcagtttccttacatgtaaaatgtagacagtggtatttattctggagattaaatgggataaagcttacgtctgtgtctgtcatatagtcatagttcaatattgtgaattgaggaagactattgaggtgtatcttcaaatattctgccaattgataacattgtatctgtggtagagtcaattccaaattatttttgatattggagaaagattgaagaaagaaggaaaatcatttatataatactttaaatttacataatatttcatcatagaagtatctttttcacattataaagctaatatacacttataataaaagcatttaaatgatacaaaaatgtaaaaagtagaaagtgtaattcctccagaattttacatcctccctccaagatttggtggttattctttgagatttctttctgtgtatctagaaacattgtttttaggcaaaaatagatcacattattcatactatttaattttttattcaccaatatatcgaggcatttggcattttcacgttgttacggatagagtgacctcattatttttaaatgtggcatagtttcgtatagtttgggcatagggtagtctgtttagccaagctccttggtggacctttgagttagttccaatctgaagtcaccataaacaatattacagtaaataaactctacattttagaaaacagttgctactttctctattctttgagaagaaataataatagcatttttaaaaaggcctggatagttgttcttaatgaagttgcaagatatgcttatttaacctgaagacatgggctgagggatgctgaatcacttcaatacttgcaactatggcagcttcaggacagagatgagcttagactaccaaccaaagaaaactaaaatgaaaaaactgtgttcagtgtacactgctcaggtgatgggtgtgccaaaatctcagaaatcaccactaaagaacatattcacgtcaccaaacaccacctgttccccaaagagctattgaaataaatagggtgggcgtaggtggctcaagcctgtaatcttagcactttgggaagccgacgtggttggatcacttgaggtcaggagtttaagaccagcctgaccaacatgttgaaaccctctctctactaaaaatacaaatattagctgggcgtggtggtgtacgcctgtaatcccagctactcaggtcgttgggacatgagaatcacttgaactcagaggctgtgcactccagcgcaactgcactccagcctgggtgatagaggaagatgctatctcaaaaaaaaaaaaatggaaagaaaaagctgtgttcaaacttcaaactgagactataaaagtttgggcagttactgtaatctccttaaaaatttggccagaatgtacagaccacatttggatcctgatttgatccagaaatagatgagacaattgggaaaacttgaccatagacttgatatttgaggataggaaataatttttaataaatgtattaggtttggtagtgatattatggttatcgttcttcagagtctttgtattttagagaaacataataaaatattgcaggataaaatcatatgtctggggttggctttagaatcatccaactaaggagaacaaaattgtgtgaggttgcatgcatggatgtaagggtgtgtgggcagagatgaattgttgaagctggctcaaggagtttcattatataatactctcaacatttgtatattgtgaaaattttcataataagttgaaaagsaaggaaaaaaacaacttagtttcaacggctaattgtttctactggggcggagagaagtaatgaaaatgccagagggaaaagggtgtttttttttcagggctgactaatcttagtaatggattttcactcctggccttagtccaggggtgcagagctttggattcttaaggtcgctgactcatcagaagaaaataaaacgaggacataagtttttaattttaaaaatttwaaaaaaattgtttttaagacaccgagagcactaactttgaaaatttaagaaattaagagagaaatcacaggatttgaatcactaagtaattgtgataataagttgatgtctttgagtaaaaaaacgtttttttttctttctttttttttttttttttggctgcttggcattcactatctctttctaatagcactgccagtttccaaacacatccgctctatcatgtacagccttcatgggagaggaaatccagtggtctgcctcttacttcataagctccttcttctcatgacctggccaagggaggtcactgagattttcacaaaaggtttaccctagcagtgacctccttgaccagactgttcctgctgggaaaccaatcctttggctcccactttctagtccttagagctaccctggatcctgccaatctccaaggcccgttctcttagcttgcctacatgattctcattgataccaagtttcttacgctaacctgtcttttgctggaagtagccagagttggatttttgccattagtgagcaaaaagtttattcctctgttgtgagttaaggtcaattaaacgctactagagaaagaggctgtcagccagaaagaggaatagaatgattaagggagcagctggagaaagagcaaagaaggggtttgtgggagcaaaattcagcagaaagctataatagatgaggcactggagaaagacagtaagaccatttgtttttgcctatcctttctctgcttcttaacaagaaccagattcccctccaccaccttaccccaattcctgccaaaganctctgttgctcttcttcagatcctacccctcccactcaaagctgcaaactgtccagggccaatcagtagcttcacaggcgcattctatccctgtacttccccacccagccaaccaggagcctcatctcggctaacttgccatgtaccccaaccctgccaactccctgcccaacagggaggggctgaatttccatcactcttggcacatttatccacactatctgctgttatcttagacctgctttgcccctttttgtctctgataatcatcataggttgaaattctctgaggatgacctgaatagaaaattaaaacttgtatcttttcacagaaactcttttgttttagaactagtcaagggtggtttttggaggagacaatgtcagtcaacttaacaataacccacaacctttgaaccaactcagaaatgccctttcaaaaatatagcataggtctttaatgtaatttctttttaagtaaacatgaatttaaacagccaagcaaatgtagaccctattaaaataatgtcctcagaggctaccaggttattctaactatgctgccgtttcttctcatatttttgaaactcatttctggtcatttcttttagcatctaaagcctgatttttctcattcaatgaatatgttctgagtgtctagcatgttacraactttgggccagggactggtgaagaagaggttatggtttttaaactccgagtctcagaaagggcacagatacaaaagcacttataaaaagcaagagatccagataatgaatttctaaataatcaagtgctgttaggactgtctacagtttgaaggaaattctttacagcatccaaaagtaagcaaattgacttttttttttttttttttttttggagacagagtcttactctgttgcccaggctggagtgcagtggcatgatctcagctcactgggactacaggtgtgtgccaccacatctggctaatttttttgtgtgtttttagtagaaacagggcttcaccatgttggccaggctgctcctgaactcctgacatcaagtgatccacttgcctggcctcccaaagtgccaggattacagatatgagccgccgcacccggcctcaaattgacatctatcctctagcacctagattgtggtttccagacacattttccagcaagaagaaccaaaacttttaggagaaatagctgattcaaggtgttggacacaaaatatacacgaagaacatggaatatcttgttatatgagaggcaaggaaatatcaaatactattggggtcatctcaaaatgactcacaagggccagcttgaaaascttcctacttaccacttcgcacctgttagagcagctattatcaacaagatgaaagataayaatgttggtgaggatatagaagaaagggaacccttaaattgctggtgaaagtataaaatagcactgctgctatggaaaacactatgaagtttccccccaaaatttaaaatagaactatcatatgacccagtaatcccattaatgggtatatatccaaaggaattgaagtgagtgtgtcagagatatttgaaaagagaatatctgcactcccatgtttattgcagcattaatcacaatagccaagatacggaatcaacctcaatctatcgtgaataaaaggataaggaaaatgtgtatatacacacaatggaatactattcagccttaaaaaaagaaggaaatgctgtcatttgtgacaacatagatgaaactagagcacattatattaaatgaaataagccagcacaaaaagacaaatactgcatgatcgcatttatatgtatgtcttagtctgtttgatattggtataataaaatatcacagactggtaatttttcaacaggaatgtatttctcatagttctggaggctgggaagttcaagaaaaagacactggcaggtttgatacatggtgaggacccaatctctgcttccaaattggcaactagttgctgcatcctttggaggggaagaacactgtcctcacatggcagaagagcataggagcaagaggactctcccttcaaccttgagcccttttaagtgtgcgaattccattcatgagggtagagccctcatgactgaatcaccttccaaaggccacagctcttaatacttttgcatggggattaagtttcaacatgagttttggagggaataccatctttcaacatagcaattgtaagatttaaaaaagtcaaattcatcaaggcagaaagtagagtgatggttaccaaaggctgggagatgggcgaattgggaagatgttagtcaaaggatacaaaatttcagttggacaggaggaataaattcaagaaatctattgtccattgtgttcactatagttaacatattgtatacttgaaaattgctgagatcaaattttaagtgttctcaccacaaaaaaagtatgtgaggtaacatatatgttaattagctctattcagccattccacaatgtatgcatatatcrtaacatcatgtatactctaaatatacacactttatttgccagttaaaaaataggcttctcactgaccaaaatgggatgatatgagcactaatacaagtaatgagtggattcaaactcatcaaatatgtttaacgcaatgtgttcataatgtaactaaaattagagggtcctaggaaaccaactccttattttgaaaaataattaaagaaaaatattatgtattcttttctttgcaaactgtacaactgggtaagcaagttgyaggtaaagggaaatttatcttaccaaaggattatagttaatgtatgaaaaagaagtgatggagttttgcccttttgcaagcccctgatgaaatgataaatcatagaattgaacattaatggttggtaacatcaaacacaaaaagacagaatctgacatcctggtcatcctgataaatgccaaactaccatttggctgcctctagggacagatgttagagatggagcaagaaagatttgactttaccttaaataccctctcttttttttttttgagacagggtcttgagctatcgcccaggttagagtgcagtgcttttttccatgctaagttattgtattattttttctcaattaaaattttgtttccatttgtaaaaataatacaatattttaggaaatttataaaaatacgggagatcttaaaggtttaaatatacatcttagaaggaatgacattcactgaactttttttttcctagaggccagggtagaaagcaggcaatgtaatgaataatcaatatttattaaatgccctctttgtttttgtgacctctatcttcaaataggttaccccagccagaaggttatttattcattcagtttagctgagatgggtggcaatatagtatgataataagggttttgcattctatttactgcaaaccacatagaaagcattcgtagggcaactactatgtttgtagtaaggtgctgtagggaagattatggtcataacaaccattccttcaacaaatacttaaagtgtgcctactagaagccagccatcattgtaagcactgtggatacagaggtaaatgtggcaaaattccttctcatgtggagcttatgatatacaatgggacagcacggtgcagtggctcatgcctgtaatcccagtactttgggaggctgaggcgggtggatcacctgaggttgggagttcaagatcagcctgggccaacatagtgaaaccccgtctctattaaaaatgcaaaaattagctgggtgtgttggcgtacgtctgtaatcctggttacttgggagactgaggcaagagaatcacttgaacctgggaggcagaggctgcgttgagtcgaagtcatgccattgcactccagcctgggcaacaagagtgagactttgtctcaaaaaaaaaaaaaatacagtgggacagagagataatacacccacctaccacgcacacaatataatgtcagatactggtttaaaaaaaaaaaactgaagaaaaaacagagtatatggatatagggctgttattatcacatacttaagcttatcatgtagcaagtgcagtacttagaagctttatatccataacctcatttaaaccccacaacctacatagagtaggagtcattatttctctgttgcagatgtggaaaagaggctttaagaggtgaagttcatatatcaagtaaatggaagaggtgttgtatttaagagcctctccccctctcttcccccaattccctctaggtctctctccttttctctctctctccctcttctccctctcaatttcaaaacttaaggtattattcagtatgatggaggcacagtagaaagatggaaggtcatgttaatacataaagaatgacctcattctcagtaacaatggtcttgttatataatctgtctgtctcactttcctcttctgcaggataatacccactacataaagttttaggatgacatgagaaaatatgtataaatcagaaggaacatacctcttatcaaaagtcctcagtacgtattatattgctaaatataattgatgggcatgtggtgaagagactgataaataattgggagttggggtactttctaagaggtgcaggtgggacctgatacacaaagcataagtatatggagtagattgggaggggcctcagtgtttggagaaggattaggaggacatcaaagcaaacctttggtagactgtgtgaagaaagatagcaccttgatattcaataaaactgttttccaaagtcaacagccatgagtattgtaggttgctttttggatcaatgagaagaatctcaactgttgcttcaatagtggttcctcaaattgcctgacaatcaaacttatctgggaaacttcttacaaagacacattcaaagttctgtgtcctccaaggtggaaatttccatggtagtataaaaggaacaaaaccatttgttcactgctataaccccaaaacctagagcagtacctggcatgtgtaggatattcaactagtgcttgttgactgaatctcctttattttttcctccttcctatcttccttttgttttccccaaacacataggacattcccctaacacatgtgaaatgctctgtgactctgtcctgcatcttcccaggggtggattatgtgtggagaaaaatgtcactttgtctttgatgggatttaagggggcatggtcatgcctgcttgctccaaactcttcctcactctgtttgctagcataccagcaatgtccacacggcagctattccgtgttgagatcatgcatttcctgaaaacccctactgctactacataacgcattgcactgagaaggagagtgactgggtgaaatcactttaactctcagcttctcactcatttgcgctggttaggctatgagaaggcttgctgccactttgagtagcagaggggccaggtcctgaaggaatgagacagggcagtattgatgggaaagagcaggaaggaaaagtcccagggcttaggggtggcaagctaggaggagtacccagaaagatggctggtgtggaggaagcttttgggggatggtggcatttgatgagcatgggaggtgttcccacttaagagagacttttcctgagcaacactttgagtcaggttggtagggtgttattaatggctccaagtgcttggtacatagttgactcacctgctgaaacacttgctgagttagcggttcaatttcacagatgtttttaagtcttgggtatgcagagactgacctctgtgtgactgtcacagagcctgacattcccagaagacagattcacaagttttcaccctttctagcactatgtgagctctgatgattgtttcctcacgttaatttagtggttcttcccctgaccttgggcattctcccacacacatgcactgatcagcacttagctgaatgtttgagggggaccttctgtaggtcttcaagttttcccagggcarctctcatgtctttggtgctctgccctaggcactctagccaccttactctccagactctcagctgtctcctcagttccaggatacctccacaaaggtgcctcttccctgccctgtgacctgaaaaaacttcctccaaatagtatactggggcaatcattggctcacatcatttatttcctgtttcttggagatcaccattcttcattgtctaatttgttctaagactcgctgtttcacgtatttgtctttttgttgttgtttcagagaggaggataaatctggtctttcttactgcattttggccagaaatggaaatacatgagttattcttaatgcttttgtttcctactcacttttggttttaatttacatttctccaatgactaatgatgttggatacttttttatatgtgcccactggccatatgtatatcttttatgatgaaatgtctattcaaatctttggcctgttttttaaaamcttgtgttgcttatatttttattcttgagttgtargaattctttgtatatctcccgccttttaaaatatgtaatcagtttagtaatcaatttattatacagattagctccagggagcaattagatttttaaatctatacaagtatttctttaaatggattttcacccttatgtacacttagacctaagcgattaagagcataagaaaaataagagctagtttgggcagacacggagctagctgcaagaatgtttttttcataccccagtggcactggaaccacagcaagacagaactgtttactcccctggaaagggggctgaagccagggagccaagtggtctcactcagtgggtcccattcccatggagcccagcaagctaagaaccattggcttgaaattctcactgccagcacagcagtctgaagttgacctgggaagatcgagcttgttgggaggaggggcatcagccattactgaggcttaagtaggcagttttcccctgacagtgctaaggagacctggaagttcggactgcacagaaatcaacacagcacagcaaagcggctgtggccacactgcttctctagattcctcttcactgggcagggcatctctaaaaggcagaagccccagtcagggacttatagataaagctcccatctyccctgcgacagagcacctgggagaaggggtggctgtgggcacagcttcagcagacttaattcctacctgccggctctgaacagagcagcgaatctcccagcacagctcttgagctctgctaagagacagactgcctcctcaagtgggtcctgacccccatgcctcctgactgggagagacctcccaacaggggtcaacaggcatctctgcctattgcaggagagctctggctggcatcaggatggggcacctctgggacgaagcttccagaggaaggagcaggcagcaacctttgctgttctgcggcctccactagtgatacccaggcaaatatagggtctggagtggacctccagcaaatggcagcagatctgcagcagaggggactgactgttagaaggaaaactaacaaacagaaagcaacaacatcaagatcaacaaaaaggacccccacacagaaacccaatccaaaggtcatcagcctcaaagatcaaaggtagataaatccacgaagatgaggaaaaaccagcacaaaaacamtgaaaattcccaaaaccagaatgcctcgtctcctccaaatgatcgcaactcctccagaaagggcacaaagctggatagagaatgagtttgatgaactgacagaagtaggcttcagaaggtgggtaataacaaatgcctctgagctaaagaagcgtgttctaatccaatgcaaggaagctaagaaccttgacaaaaggttacaggaactgctaactagaataatcagtttagagaggaacataaatgacctgatggagctgaaaagcacagcatgagaacttcatgaaccatacacaagtatcaatagctgaattcatcaagggggagaaaggatatcagagattgaagatcaagttagtgaaataaggcatgaagacaagattagagaaaaaacaaaaaggaacaaacaaagcctccaaaaaataagggactatgtgaaaagaccaaacctatgattatttggagtccctgaaagtgatggggagaatggaaccaagttggaaaacactcttcagtatattatccaggagaacttccccaacctagcaagacaggccaacaatcaaattcaggaaatacggagaacaccactaagatactacttgagaaaagcaacctcaagacacacaattgcagattctccaaggttgaaacgaaggaaaaaatgttaagggtagccagagagaaaggtcaagtaacctacaaagggaagcccatcagactaacagcaaatctctctgcagaaaccctacaaaccagaagagggtaggggccaatattcaacattctgaaagaattttcaatccagaatttcatatccagtcaaattaagcttcataagtgaaggagaaataaaatcctttccagacaagcaaatgctgaggtattttgtcaccaccagaagagctcctgaaggaagcactaaatatggaaaggaaaaaccagtaccagccactgcaaaaacacaccaaaatgtaaagaccaatgacactatgaagaaattgcatcaactaatgtgcaaaataaccagctagcatcatgatgacaggatcagatttacccataacaatattaaccttaaatgtaaatgggctaaatgccctaattaaaagacacagactggcaattggataagcagttaagacctattggtgtgctgtattcaggagacccatctcacatgcaaagacacacataggctcaaaataaagggatggaggaatatttactaagcaaatggaaagcaaaaaaaagcaggggttgcaattctagtctctgataaaacagactttaaaccaacaaagatcaaaaaggacaacaaagggcattacataatggtaaagggatcaatgcaacaagaagagctaactatcctaaatatatatgcactcaatacaggagcacctagatttataaaacaagttcttagagacctacaaagagatgtagactcccacacaataagagtaggagactttaacaccccactgtcaacattacatcaacgagacagaaaattaacaaggatattcaggacttgaactcagttctggaccaagtggacctaatagacatctacagaactctgtaccccaaatcaacagaatattcattcttctcagcaccacattgcactgattctaaaatcaaccacataattggaagtaaaacactcctcagcaaatgcaaaagaatggaaatcgtaagtctctcagactcaaattagaacataagattgagaaactcactgaaaaccgcacaactacatggaaactgaacaacttgctgttgaatgactactgggtacataacgaaatgtaggcagaaataaatgaaaccaatgagaacaaagacacaacataccagaatctctgggacatagctaaagcagtgttaaggaaatttatagcactaaatgcccaaaagagaaaggaggaaagatctaaaatcaacaccctaacatcacaaaagaactagagaagcaagagcaaacaaattcaaaagctagcaggagacaagaaataactaagatcagaacagaactgagggagatagagacacaaaaaacccttgaaaaaaatcaatgaatccaggagctggttttttgaaaagattaacaaaatagttagaccaatagctagattaataaaggagaaaagagagaagagtcaaatagacacaataagaaatgataaagaggatatcaccagtgatcccacagaaatacaaactactgtcagagtactataaacacctctacgcaaataaactagacatctagaagaaatggataaattcctctacacatacaccctcccaagactaaaccaggaagaagccaaatccctgaatagaccagtaacaagttctgaaattgaggcagtaattaatagcctatcaaccataaaagctcatgaccagatggattcacagccgaattctaccagaggtacaaagaggagcaggtaccattccttctgaaactattccaaacaacagaaaaacccatcacatttgatgtactaatagctccaatccatataaatgttgtccagttaaacttagaccttaaaatacaggatgtgggtagagtttaatctggttggtcataatttttacctaagatgtagctcctttgcaataaaatgaatacagaaacaacttcagttcactttgcttttcataactgtcttgattagagatggagtctactgaaaaacaatctcctacaggtgagtagagcttttctctcacatctaagcacacatcatacccaccacacctcactgttatccaaatttaagtcaatgaggaaagcttttagtctcacacctaggctatgcgtgtagaactggcttgtcacacacacacttctctgctaggaggcaatgttggtacagaagtacagtatttctagtctgttgttccaagtatgtacaacatgcagcattgctgtatcaggttgtatgtacagggcagggtgaggtgtatactcatagaaggcactaaaatggaaatcaaaagaacttgctcctttttttttttttgagactgggccttgctctgtcacccaggccagagtgcagtggtactatcatgactcactgcagccttgaattcctgggctcaaggtacctcccacttcagcatcctgagtagctgagaccaaaggcacatgccattatgcctggctaatttgttaatttttttgtagagacagcgtctcactatgttgtccaggccagttttgaactcctgggctcaagcaatcctcctgcttcagcctcccaaagtgttaggattacaggtgtcagccattatgcccagcctaaaaggactttctctttcagagtgcccctgtctttatttgtagaggttattcartttctttaattacctggcatactttgagtccatccctgagctattctgctatacttttctctatcctttctgtagatctcagcaacctcattcactagaagatcatgtggattggaatcatacaatggggaacaaatggaaaagagtacttttgaaatagtgctggagaccactgtgaccacagaatgtcaagacacgtgctgccattactgttactatttggaaaatacattcttgtaaatgcaaccttagggggtttgagggggaagtctgttgggaaatgaattgcaagaaaaatattacaccctgattgggactgtcattttgcctcttattgcagcttgccagtcgacatgccatctccaacaggaccggctgtacactgtgctgggcgggggtgggtcccgtgccaggtcattcaattccttgtgagttctctttggagctttggtgggaggcaagtggtgctccctccaacccctggggccaggacgaggacagggaaggggtgggcgagggagcctgaggccrcctcatgatcacccaccagcgggagaaaatgcggcgttggggtgagcgggtctggggagacaggatgagcgctggggctgcctgctgagtggccgccgtgtcactctggatggtccctttatgcactgcagcagcttaactaactcccttttctctggtaatatttgttgcttaaaagaggatggctttatcatctttctcttaattaatatgttaatagttaatatggctatatcagctttctcttggttagaatctttctatatctttctcatattgtagatataagtatgtaaacaggcatatttcaggctcaggcatatagaattgatcataatattaaccatactattgtgggtctgttttatgtgtatgtaatctgttgtttttgctagctcttactcattgtgccttggctgtttagtaattttgtaccatgagctgcttcatggtttgtaattctacttgcagaaattctctttagctagcttaaagatggggtccttcaaagagaattttccccttcttctaggtttatgagaactgttagtccaggggcactctaaattaaatgttcagcaagacttttctccaattctctcaggtagtgtaaattcaagctacaaacatgcataaaggctagatttctctggtttttagtatttagaaggctgttttaatctcccttctgcttagcactaaaatttgagctcgtagattttctttcctctagagctggaggtgagaagggagaggtgaggggttggagactaatatgggtttatttctagttctttctaaaatagatggtttaactcattatgatcccaaccttttttgtggcagatctcctgttagacacagtttaattttgctgaccagtaatgattcagtgatgggaatctcgctctcttttaacatactccacaacgtgggcagaccccgggctgtgtctctggtgcctttgaggtcataaaatacaaagctcaatctcctcttcctcgcttctttcatttgacaaatggccggctccaggcctctcacaacttctctacagtggctcgtcttcacttagcccgatttgagaattccttactttcttactttcatgggctcttttcagttttgtttttttttgttttttttttttttttttttttttgagacggagtctcgctctgtcgcccaggctggagtgcggtggcgcaatctcggctcactgcaggctctgcctcccgggttcacgccattctcccgcctcagcctcccaagtggctgggattacaggtgcccgccaccacgcccggctaatttttttgtatttttagtagagacggagtttcactgtgttagccaggatggtctctatctcctgaccttgtgatctgcccacctcggcctcccaaagtgctgggattacaggcgtgagccaccacgcctggccccttttttagttgttttaaacaagagaatctgttgacgtatttagcttaccaccttactggaaacaatctaaatttagtagatgacacttcaaactctgtttaattgcttctgtgtgctttttcctctcaagtaattatatcttagtatattacagtcatgaatatttgttttttagaaattccaggatatgaatttgttttttataaattcctgaattccaggaaaggacactgggagggtggtgtgctctggttggtaagtggtaaacattttagttccaagcttgagtcagcctctttaaaaggatattgcagaattttggaacagataccacaaactccttaaatctgtcagcttgaaactgcccatgaaactgccggttttctatttttagcttttatttccattcagtttatcttttgcatttacttctgttgtttatatttctgctttagtagctttcttccaaaatcaaaatcatacaaacaagctgtagggggttgagtgcccctgcccccaaagatatgttcacccggaacctctgaatgtgaccttatttgggaaaagggactttgcagatataattaggctaggaatctcagratgaaatcaccctggagtatctgggtgggccctaaatccaatgacaagtgtgcatccttatataagaggagaagagacagacaggaaagaaaaaaaaacaaaaacagaaaagatgatgtgaagttggaggtgaatgaagcaatgaatctataagcaaaagaatgccgagagtttccagcacccaccagaagccaggagaaaagccaaaccaggttctctcccagagcctctggaaggagccaaccctactgccaccttgatttcatattcaggcctcttgaactgtgagaraataaatttctgttgttttctaaaggcactccatttgcggtcatctgctatggcagcttcaggaaatgaatctacaaatttataaattttctttgccccaggaatttttaaaagttkgcaatctagttttccatcaagcatgaccaaagaatgacaggtagatgagagaactggattagaacgtctctggaggttggatttcaagagtttcctggttgtgagaatcaaatacactgtgtgcttaaagcatttaacaaatgtgagactttccgtaacatgaccattgcttttttaagaagtctagcactcatgatcagtgctgaccgtcagctcccgctttgttctcaactacagcagtggttttagtgtttgacatttccacctgtctttccttcactccctgcccctcctccttcatacacactgaaattagctctctgaaacttctcagagcgagtctgaattttgtagagaagtagttttgtccaatgaagagtaacaacaaatagcccctggaatttgtctaccaaattataacacccctcacctcagcaattttggatactttatcattatagcagctgtctgagataggtattgtcatgaacattttatatgtaagggcagtttttctccagttagaatcaaagaactggagctggaaggaagtttggaattgctggcctttttcatcaattggttaattaaacaatttttaagtaaatataatgtgctagactctaagatgctctggggattcaaatataaccactctattccaggcttcatgtgctgatgagcaaaataatatatcactactagcaatagtgtagcaatttcatagcactaataaatttgaaattttaaaccattattataagtaggaattttttatacaccccaagtgaaacagtatacatcaataaaaatgtgttctaaagccctatttatgtttgttataaagtaaactaaggcacaacaaaatttcagagtctctttgaggaaacaatgattcatgaatgggacagctccaaaccagaagtggcttaggagctccatggagggaacacaagagggcagcttttataggatgaacatagaagtaaagcaaagaaaatatttgatgggttanaattatacagttgccttgtttggtctatccctttggaaagtccctagttacataagtttattggctacttctgattggttgagcttaagttctgtttttaatataggcatttataaaatatagctcaagtttcacttacgcttgtaaatcaagcaaggttatgatgaggcataaccaattttgtctgctcaagaattcttcaggcctggttttcattttgttttctttaacattttagtacctataaatttanttctttaactgctgcatagtattccacagaagaatgtaccataatgtatttgctcattcctctgttgatgttaccaatattttgttgcaatggacaactttttgtataaatgccaaagtacttcattagaaaaattatactagaatagaagtagaattggtgaatcaaaggatattcacatttaaaagttattatatagattacagatggtcctgacttacartggttcaacttatggtttttcaactttatacaatgatgtgaaagtgatgcacatttaatagaaactgctttgaatttgaattttggtctttttccagagctagtgataagtagtatgatactcttacctcacacattcaacatttattataaaatagattttaaattagataattttgcccaactgtaggctagtgtaattgttctgagcaagtttaagctaggttaagctatgatgttcagcaggttaggtgtattaaatgcatttttgacttaagattattttcaacttataatagttttatcagaacacaacctattgtaagtcaaggagcatctgtatatagatactgtcaaattgctaaaaacactctatcaatttatgttcctgtcagtattatcagcatacacttttttcaaaattctcacacaatattattcatctttaaaattctgtcaatacaaagctagaaaaatgactcaagttattttaattggtttgtgaggagggcagaagagcaggttaagagagactttcactttgtttcttcacatctaatgggagacaaatctgcatgacctgggctaaagtggactgagccagtctgagacagggctgcaaagcctttggcagatgtcagcattcttgaaacacagaggctcttcaaggctgttcctagtgaaattttaaaattgtggtttaaaaacaaggattactaattgcattgatattaatatagccaagacttgctcttttttgattaatgaattcagggtatatcttttcccctttcttttactttcaatccacctgtgtaattgaagttgaagtgaatttcttatagatagcctattgttggaacatgtttttatttttatcccctctgcaaatttctgtcttttaattcgtgtatttagaccacttacatttaagggaattgttgatatgttagggcttatatctgccccactactttgttttctttttgtttcctctatttcctgtccctctgtctctcttttttgtaccttcctatgggttgattgaacatgtttcaggattcaatcttaatttatttattttatgtttttaagttgtaagagggaggatctaggaggagtggggcttaccatcatggctggagctggaagttgttgagtaattattttttattgtcataaaatgtacataacacaaactttatcaccttagccattctaaagtgtgcaatcagtggctgtgtagggagaaactctctcaaactgtgtctttactctcacactacaacaatcaacacagaaggcttctatgaccaaatatgttgggggttagggggttggttgccacacttcaagcagtggacaccagccaaatgtcctccaattcgattcttacactatctacctagagatggcgtcagatcccatgggttgggtctcagtccccaagactgtctcctctacaccagttgcaagtctgggcctctgaaacttctgaccaactagcttgaagttgagattcccaggaatcccctctttgggtttgattaattttctggagcagctcacagaattcagggaaacacttaaatttacttgtttattataaggaatattactaagaatacagatgaagaaacacatagggagagacataggggaagggatgcagagttccatgccctccctgggctccaccctccaggagcctccangtgttcagctatctagaagctccctgaacccagtcctcttggatttttatggaaacttcgtgacatcagcattccttcccccagggtatgaggcgaggccctcatcggggagactcttaagacccacaatcagaaagacagggaacattagaatcctgccttgggtcaggtaaaaggaatgcaggaaagagattatttcctgaggcctgcccctgagacctaacacacccagcattataacgaaagactgtaacaagggatgtgggagttatgaaccaggaactaactgtgaaggagaacatcatcgactgtgccaaacgagctcagatgtccaggaaggggctgactaaaatgcattatttgaatatcatgatgcagaagatatatatatctatatatctatatagatagatgaaaacaaatatgtatattttctataatgttctataacacaagaagtttcccaaayatttatttacattgtttgtttattcccaaatatttatatttcccaaatacgacagcagggagactgagaaatcacaaaggacagatgagagcgatgttacttaatgccacagaacaggacatcatttaaaggagttactcaaagtgtttcagttactgccattakgaactcctaagcccctcggcagtgtgggtggtacggggtaggtgttgaggttagcagcacccacaggcttctcttcacgcaggatatgctatatagtgaatcggtatcaagactggaggaaggtaagggtttccagaaaaccaccttcaggccatggtttggagtagtcttattgaagtttacagaatcaaaagttacagataattaggaggcattgaaatacagacctgttttcttttttctttctttcttttttttttttttttttgakacggagtctcactctgttacccaagctggagtgcagtggtgagatctcggctcactgcaacctctgcctcctgggttcaagtgattcttctgcctcagcctcccaagtagctgggactacaggcgcaccccaccacacctgcctaatttttgtattttcagtagagatgsgtttccacacattggccaggctggtctcaaactcctgacctcgtgatctgcccgccttggactcmcaagtactaggattacaggcatgagccactgtgcccagctgacccagtttctacgaccagtttagccacaaagtagacatgtaaccagaggaaagtgacttaacctcctagggcctcagcttcccatattacacacccctgggatgagaatgataggaggtgtagcggggttgagctggataatataaggttccttacagctctagacatttatgatttaacattttttatggattgctaatgctgctttttttttgttttaaatgtcaaattcttgcatgtataaggccttgattctttcaggcctgggttgtgttgatttatgggcatgagctaattccagatgactcattctagaagtgattgtgtaagtatcctttacttagctaaacatatgcaacataaattcatctactataacatatgttctctcagaacatgctactggccagagttattagattttgttcacaccatagatcctgctgtattttanagcacttcagaataacaatcattcttttaaaacccttctacacacctttgctgtttctgtaaatacacctgtcctttncaagcatctggctctttctatgcattcttcctccagaaatcatagtattatagatttggaaaatgcttggccttcattttcctgttacagactggtttaggtgtccctcttaattgttcttaatgcattcagtatattcattcatttcttaattcattaaaaatatgcaccatgccaggtgttggggacattgcaatgaacaagacaggcatggcccctgctctcattcagtcatgtctaggggtaaaggtaaaccttggataagtaataattggtgtgctgactgttaagaagaactacagtgctatacaagctgtatgatcatattgggctttaaccaattccttgggaatcagatttctagatgaagtggcatttaagttgaaatctgagtagtgagtaggagttagccaggcaaagatgaggagggggaccactccaagctgagagaacagctgaaatgagaaagtccatgcaatattttttttttttttttttttttttaccataagaagatcacaccggccagaatggagagagggctggggagggtgatttgacctgagtctagagaggcaggcacagatcagaccaggatgcttatggcaggccacgctaaggattttggactttatccttatggaagttggaaatcattaagagtttaaagagagatatgatcaaatctgatattttaaataaagctcatttggctgtgatgtggcaagtgggctggagggcagggtggtgagaggagacacaggaagctcagttgggacattcctgctgtggttcagacgagagctatgtgggcttggactagggcagtgtgtctgcttcaaggggaaagggtttggtgttttgtggaatttggggaatgagggaatgtttcatgaagccgaaggggagagtgtttttaaaaggaggacatcatcgactgtgccagatggagctgagatgtccaggaaggggctgactacactagaatgcattatttgaatatcatgatgtggaagattttttgggggggkgggcagactcttgctctgtcacccacactggagtgcagtggtgtgatctcagctcactgcaacctctacctcccgggttcaagtgattctcctgcctcagcctcccgagtagctgggactacaggygtgcaccaccacgcctggctaatttcttgtatttttagtagagatggggttttgtcatgttggccagcctggtctcgaactcctggactcaagtgatccgcccactttggcctcccaaagtgctgggattagatgtgagccaccgcacccacccagaaagatatttttgacctcaggaagaatgcttttggtggaatgacgagggtgaaatccatagtgtgtggcttaaggagtgaatggaaagaagaggaggagagagaggtggagagamtacacctctttccagaagtttggctctgaaagtaaagagaaagggttaatactagatggtaacagtaagtaaagaaagaattgtagttttacagtttttttgtttatttgtttgtttgttttttgaggcagagtctcactctgtcrccaggctagagtgcagtggcatgatcttggctcactgcagcctctacctcccgggttcaagcaattcttctgcctcagcctccctagtagctgggactatgggcacgtgctgccacgcctgtctaatttttttgtatttttagtagagacagggtttcaccatgttggccaagatggtcttgatcttctgaccttgtgatctgcccaccttggcctcccaaagtgctgggattacaggagtgagccactgcacccggccagttttacagtttttaaaatgggagaagcttccacacatttagatgctaaaggaaggaacagataggaaagatttaagaatcaggagagaaaagagacaatagcttaagattcccgactatggggtagaggagaatgcttagaaccaaggtggaggaattggtcatttgtcacatttgctgacattttactgacattttctggctggatgtctgtctccttcactgggctgtaacctcctgaaggtgaaggctgaaattctatttgattttatatccctagcacttagtgtaggacttagcacgataatgtgccctctgagtgtttggctgggctgacgtgtcacttgtggtaggaaggtctctacagatgtgttcccttaaggatatagactgaaggccttgaatgcttaggaagctggggattgacttgaggtaggtagggcttcttggatagattttttaaatgagaactatgaaatggcaaagctgtctggcctgttaggttagtaactttggctgtttatgcctgatccaaagccctaggctaaaatcagtcatggtggagataaagagcaacctacaacatgcaagtcaagaactaccacagtgaattctctccttcttagctatctccttggtctagaaagaaagatgaaccccacagcagcaccccacaagaagagaaacagtgctcactcatttgagtctacttctcatcagatctgatgcaacttatctgcacaggccatgaatggaacaatgaaaagatgacctgaaatctttccccactcagttgctgttaaatttaacacagacataaaaattaagaaattcagtgaaacaattatattgcatttgtatttttcttctgcactgccattaatattggctggtaaaaattattccatacttatttccatgaattttgaaaagacttaaaactgcctgatatacttgggtgatattcttccaggaatgataaaatgagacagaaatggcctttgagtgttttcaggaagggaaaatggaaaatgaaagctggactaaaaggtgttacaaaagcaaactagttaatacttccaagaaatgaatatgctaagatattgtttgctgatcaacatttattaaacatttactgtgtaccactgatntaggctcttggccagatatgagcaacaaaaagaagatagtgtagtgcttgccttccaaaatctagcacagtcctagaaagaattcaggtttcactaaggctacttagggagagagttctctaggttctagaaattaaggcaggcacccacacaaagactcagttgcaaatgggtggaaagaatgatttttattaatcagcacaatatcttaaaaatcccagtgtagccttctttgataaaagacagagtacatgacttagaggcttaagaggggtcttctactacccattctggatttctgttttgagacttggaagttctaaagtccttgcagaggagattctgaggcccaccagtagcctaaaatctccaggcctgctcccctcactgcccccactcctgggtggaacacagacgtagaagatgctactcagctcagtggccctgcccaccatgcacctgaccctgtgaatgcctgtggctggccgttcaggttagttcttcttccctcctctcccacaccatggagacacaggaagagaaggaagatacgtgtttttctctagtgctgacattagagccygagactccggccttgcatgaggccagatgggctaaggtttctatgctgggtttttcgagatctccccagacccttccagcaaattcctctttttactcgaggaggttttggaaacaaatgagtaagacagacgtagtctctgtaataagagaatggtgagtcaaggacacctgaaaaacagtaatagctaaggtcggacagaatagaagggaaaaaaaaaaaagcaaaaagagctctggagacacaggagaaaatgaagctcagatgtctgggaaggcgagagtatctaaaacctttaccagagaagactggagggcctctttgggagatgaaactctctgtcacctggagattcaccaaagactctgaggctgaggggaacagtatactgtggaactgatttctgagaccacagttggaaattgtgtgttcagagtccttacaagtctgaaaaggcctttatttttacagccacacttgagtcaccatttggctgtagaattctccctcagaattctgtaaacatcactccattgggtctcctggcattttatttccaaataagagagcaatgwccactggtttctttgcacttggcagacacctgattttggtgaaggtgttggagtgtcttttgttgggagaagtgagtgtgaggagggtgggggagtgttctggaagtttgtaggatttcttgtaggattcttttctgtcatttacaaatttcaacagattatctgtaatatggcttttttcagtattcctgcccaacaatccttagattctttaaatatgaaatctagattttcttctattgagaaaaatgttaacttattcttgatcattccttcatttgttttctggaatttctgttatgtagaagttatcatatattattcttcctgtttcttaattttctttcataacttctctgttttttaggagattccttaaattggttatctgtttcacagttgccaggtttggtttttggcatattattctgctacttaagatctccactatttttttgttttgttttggcgcccatgattttactggaaaaatccttttgttctctccttttttgttaccccttttcatttatgtgacaccttcctgaaaattacccctccctttgagatttaaataaaatgtctggctcttcatcccattcttgatgggaagtttaatgcctcccctaactcctgttttttttttttcttttcaattccaagaggttttgtacttggtccccacctaggtccaattttctttgtcctagatttcctaattgtacctcttcttagagtctgttcttacagcctgtcctggtgcagacatggaacacatcgttttcctttgtgttccccaaatggcattctttcattccattcaccttgtgtggacacactttgctgaaggtctgaggtggcgaaaagggtggcgtcacagctctccagagagtattcatgtgttttaaaaagtcctccatctgccccattaccagggatttgtcacctaccaccttactaacaaggctcctcttctgtcctgttgaaaggaagaatcactaatggatgctagcagggcttagtacctaggtgatgggatggtctgtgcagtacctgccatggcacgtgtttacctgtgtaacaaacctgcacatcctgaacatgtacccctgaacttaaaagttggaaatcaaaaaagagaaagggcctctgttctctgcctttcttatcttccagacagaactccctttacctgaattctaaagtcctctttgtttctatctgatatttaagtcaaaaagatgttgccacacctgttctctccttcagagaattcaggttcctgctattataatccctttttattccttgatgcactaaatttctttttctgaaaattcttccttgttttctttactaaatctatcttgcagaaagatatctttgccctgattgttcagcttatttctggcagctaatttttcccatatgtctaatgtttcttgtataagagaaaatagatggcttttatttctaatcagaggtctatttttctcaatgttggcaaatcctgtgggttccctaagcaattgtgcatctcagggttcagttccttctggtggtttcctgctttcttttcctatgtgaggcttacgtagaatttatttaacatgcaataaaatatgcacataacatgaaatatgtttacaatatggataaatcccacaatcataatggtaggagaaagaggccagatacaaaacagcatatgattccatttatacaaaatttaagagtaggcataaccagtctgtggtgatacagattagaggagtggctatcatttgagtggatgttgactgggaaggagttagctggagtcctagaaattttctatatcttgatgtgggaggtagttacatgaatgtatacctgcgtaaaaaagtcatagagctatacattcaagattagtgcacattactatatgtaagtcatacctcactttaaaaaatgtcatgtgatgtcatctagaactagggaaggaataatttgagagaccttcttgatttggagaggaaaagaatattttgagggcaggtgttacttagaagaattgctctacatagcagtcttttcttcctttatcctactatcagacatttctccaactagaataagatgtggttacaactgtcctcttgctgtttcgtgagaattgcttagttgtttcctacacagaattttaaacgttgtggtaaatacaagttcaaagtcacattgccagtgcttcggaaacttataatctagttggagagacaagactaacataaaagagaatttagtgttgcttttttttttttttaagtgcaaattttgaggcacagaattctccagggattcaggagaaagagcactcagtgggaaaaggaggaattgattttaatgaagcggggaggacttaaggtgagtttttgaaaatacctgggcaggcacaatgccagctagttcttcactgtattgtgtttgtttaaagaaacatagaacacctgcttgctagagctgaaacagtgactgggcaagacaggatatttatcaaactggggaaaataaaccaagtggcatacagatgtctgaagagatttagacttggattctgaattcccactagtctgagccctcagggttgagaggacagtacagtcaggggagggtagggatcgggaaggaacagaggccaggcctaaactgtatgccccggtgggaaatactatacagaggtcttttcttttacaacaaagcaattcttattatattacaaagaaaaccaaaatctgtgtttatgacaggatgacttacagaaggatacaaaaaattagggagtgatatattaagttctccttaatattttctcctctgacactacattcatgtatctgcaaaaacatacatgtgctttcagacacacatagtatgaacacacacacacacacacacacacacacacacacacacacacacacacccttcatactcctgtgctggtggggaattcggagtttatctaaagtacacacttcatactcctgtgctggtggggaattcagagtttatctgaagtgctctttgctaggctctgtgggtggagctgggagggtaatggtaaggttggcagatatatgaagacaactgaaattcatatcagcaggctgagtgttcatgtcaccagaagtctgactcgcctgctgtgctcttgcctgctgtgctctcgtaattactttcggaaaggttttctggctacaataaaatctgattaaatttgttaccaagcaaattgaattgttcaggctgcaacctttctagaagttttaaacgttatttaaaagaagatttcaacctcactccatttcagctttctctggggagctgctcttgtgctgtttggcccctgcctactcggaatggaacaaaggtatggtgtgtattgtttttctactgaatttaggatatttatttttgatggtttgtcttcacgtcttctgtaactagatataagaattgagagttcttgctgggggatggggagggatttaggatgttaaaacagttttcaaatatatagtgtttgccatcttcagaacacctgatttacaattcactcagttacttgggtatagaacttgcttgtatcgcaccctgcttacccttgatattctatctgcttgagccctctctgcaaccctgtccactttacccaacccccttatcagcaacactgccttttctgtatacttcccttcttttttctgtggctgctagcagatcttgtttttggagctttccttctgtcaagacattacttactgctttgctcaggtctcagaaagctttaggatccagagagatactaaaggctgaatgggcatggaagacccagggtttggacttgaggggtgctctggactaaatggtacactgaattcatggatcaaaagtgcagttagtcttaaagctccaatcaatacaatgttgactacttcatggggtaagtaagatttttgtgggctggttagaacttacttgccattcgcaacttgtttttatgggaaaatatcaagtgcagtataaaataaacatttagaccactacctagtcataaaggggggggtgctttctgtagtatatttaattaaacacatattattataacattttgctaagttctagttctcaagtaaatataaagctgttctaaagatattttaggagtggtgacatgtttaaatctcaggtttataaaaagggttgtaagaatgactgttgtgagccattagtttcaatgttgatttattctctcaacaaatatttgttgaaatcctcatgtgcgctaggctgtgggggtgcaacggaaacctaaaacaaacttggttccttcccttgcatagcttacagttttctaggggacacagatattaatcaaccaacctcataattaaaaatgaaattattggctgagcgcggtggctcacgcctgtaatcccagcactttgggaggccgaggcgggtggatcatgaggtcaggagatcgagagcatcctggctaacacggtgaaaccccgtctctactaaaaataccaaaaaaaaaaaccaaaaaattagccaggcgtggtggcgggcgcctgtagtcccagctactcaggaggctgaggcaggagaacggtgtgaacccgggaagcggaggttgcagtgagctgagaccacgccactgccctccagcctgggtgacagagcaagattccatctcaaaaaaaaaaaaaatcagtttgaaagtgatgagagagaaagtgatgtgaggctgtgtcacggtgggatttgaccttatatggggagtcagggaattcccagtggggctactgattgaactgagacctaaagtataaggcattgggggaacctgctcccagtatttcaacatagtttctttctattttccataagtgtcggctggctgagaaataaagggagacagtacaaagagaagaattttacagctgggccgccaggggtgacatcaygtatcagtaggaccatgatgcccgcctgagtctcagaccagcaagtttttattaagggtttcaaaaggggagggggtgtaagaacagagagtaggtacacagatcacatgcttcaaagagcaaaaagcagaaccactgataagggtccaacaaagatcacatgcttctgaggggacagggcaaagggtaaaagcagaaccactgataagggtccaataaagatcacagggcaaaggacaaaagcagaaccactgataagcatctatgttcagcagtgcgctgcatgtattgtctttttttattattattaaattttttattttattttattattattaaaattttattattattattattattaccctagaactttaagttctagggtacatgtgcacaacatgcagatatgctacacatgtatacatgtgccatgttgatgtgctgcacccattaactcgtcatttacattaggtatatctcctaatgctttccctccccccttcccccaccccacaacaggccccggtgtgtgatgttccccttcctgtgtccaagtgttctcattgttcaattcccacctatgagtgagaacatgcggtgtttggtttttttgtccttgcaatagtttgctgagaatgatggtttccagcttcatccatgtccctacacaggacatgaactcatcacttttatggctgcatagtattccatggtgtatatgtgccacattttcttaatccagtctatcattgatggacatttgtgttggttccatgtctttgctattgtgaatagtgccgctataaacatacttgtgcatgtgtctttatagaagcatgatttataatcctttgggtatatacccagtaatgggatggctgggtcaaatggtatttctagttctagatccttgaggaatcgccacactgtcttccacaatggttgagctagtttacrgtcccaccaacgtgtaaaagtgttcctatttctccacatcctctccagcacctgttgtttcctgacattttaatgatcaccattctaacaggtgtgagatggtatctcattgtggttttgatttgcatttctctgatggccagtgatgatgagcattttttcatatgtctgttggctgcataaatgtcttcttttgagaagtgtctgttcatatcctttgcccactttttgatggggttgtttgtttttttcttgtaaatttgagttctttgtagattctggatattagcccttggtcagatgagtagattgcaaaagttttctcccattctgtaggttgcctgttcgctctgatggtagtttcttttgctgtgcagaagctctttagtttaattagatmccatttgtcaattttgacttttgttgccattgcttttggtgttttagacatgaagtccttgcccatgcctatgtcctgaatggtattgcctargttttcttctagggyttttatggttttaggtctaacattgaagtctttaatccatcttgaattaatttttgtataaggtgtaaggaagggatccaatttcagctttcgacatatggctagccagttttcccagcaccatttactaaatagggaatcctttccccatttcttctttttgtcaggtttgtcaaagatcagatggttgtagatgtgtggtattatttctgagggctctgttctgttccattggtctatatctctgttttggtaccagtaccatgctgttttggttactgtagccttgtagtatagtttgaagtcaggtagcrtgatgcctctagctttgttcttttggtttaggattgtcttggcaatgcaggctcttttttggttccatatgaactttaaagtagttttttccaattctgtgaagaaagtcattggtagcttgatggggatggcattgaatctataaattaccttgrgcataatgcccattttcatgatattgatacttcctatccatgagcatggaatgttcttccatttgtttgtgtcctcttttatttccttgagcagtggtttgtagttctccttgaagaggtccttcacatcccttgtwagttggattcctaggtattttattctctttgaagcaattgtgaatgggagttcactcatgatttggctctttgtctgttattggtgtataagaatgcttgtgatttttgcacattgattttgtatcctgagactttgctgaagttgcttatcagcttaaggagattttggactgagatgatggggttttctaaatatacagtcatgtcacctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagagaatgcttccagtttttgcccattcagtgtgatattggccgtgggtttgtcataaatagctcttattattttgagatacgtcccatcaatacctaatttattgagtgtttttagcatgaagggatgttgaattttgtcaaaggccttttctgcatctattgagataatcaagtggtttttgtctttggttctgtttatatgctggattacgtttattgatttgcatatgttgaaccagccttgcatcccagggatgaagcccccttgatcatggtggataagctttttgatgtgctgctggatttggtttgccagtattttattgaggatttttgcattactgttcatcagggatattggtctaaaattctctttttttttttgttgtgtctctgcccagctttggtatcaggatgatgctggcctcataaaatgagttagggaggattccctctttttctattaattggaatagtttcagaaggaattgtaccagctcctctttgtacctctggtagaattcggctgtgaatccatctggtcctggactttttttggttggtaggctattaattattgcctcaatttcagagcctgttattggtctattcagagattcaacttcttcctggcttattcttgggagggtgtatatgcccaggaacttatccatttcttctagattttctagtttatttgtgtagaggtgtttrtagtattctctgatggtaatttgtgtttctgtgggattggtggtgatatcccctttatcattttttattgtgtctatttgactcttctgtcttttcttctttattagtcttgctagcggtctatacatttcattgatcttttcaaaaaatcagcttctggattcattgattttttgaagggttttttgtgactctatctccttcagttctgctctgattttagttatttcttgccttctgctagcttttgaatgtgtttgttcttgcttctctagttcttttaattgtgatgttagggtgtcaattttagatctttcctgctttctcttgtgggcattagtgctgtaaatatccctctacacactgctttaaatgtgtcccagagattctggtatgttgtgtctttgttttcattggtttcaaagaacatctttatttttgccttcattttgttatgtacccagtagtcaytcaggagcaggttgttcagtttccatgtagttgagtggttttgactgagtttcttaatcctgagttctagtttgattgcactgtggtctgagagacagtttgttataatttctgttcttttacatttgctgaggagtgctttacttccaactatgtggtcaattttggaataagtgtgatgtggtgctgagaagaatgtatattctgttgatttggggtggagagttctgtagatgtctattaggtccacttggtgcagagctgagttcaattcctggatatccttgttaactttctgtctcgttggtttgtctaatgttgacagtggggtgttaaattctcccattattattgtgtgggagtctaagtctctttgtagatctctaaggacttgctttatgaatctgggtgctcctgtattgggtgcatatatatttaggatagttagctcttcttgttgaattggtccctttaccattatgtaatggccttctttgtctcttttgatctttgttggtttaaagtctgttttattagagactaggattgcaacccctgcctttttatgttttccatttgcttggtagatcttcctccatctctttattttgagcctatgtgtgtctctgcatgtgagatgggtctcctgaacacagcacactgatgggtcttgactcttgatccaatttgccagtctgtgtcttttaattggaggatttagcccatttacatttaaggttaatattgttatgtgtgaatttgatcttgtcattatgatgttagctgcttattttgctcattagttgatgcagtttcttcctagcattgatggtctttaccatttggcatgtttttgcagtggctggtaccagttgttcctttccatgtttagtacttccttcaggagctcttgtagggcaggcctggcggtgacagaatctctcagcatttgcttgtctgtaaaggattttatttctccttcacttatgaagcttagtttggcaggatatgaaattctgggttgaaaattcttttctttaagaatgttgaatatgggcccccactctcttctggcttgtagagtttctgccaagagatccgctgttagtctgatgggcttccctttgtgggtaacccgacctttctctctggctgcccttaacattttttccttcatttcaactttggtaaatctgacaattatgtgtcttggagttgctcttctcgaggagttatctttgtggcattctctgtatttcctgaatctgaatgttggcctgccttgctagattggggaagttctcctggataatatcctgaagaatgttttccaacttggttccgttcttcctgtcactttcaggtacaccaatcagacgtagatttggtattttcacatagtcccatatttcttggaggctttcttcgtttcttttcattcttttttctctaaacttctcttctcgcttcatttcattcatttgatcttccatcactgataccctttcttccagttgatcgaatcagctaccgaagcttgtgcatttgtcacgtagttcttgtgcctggttttcagctccatcaggtcatttaaagacttctctacactggttattctagttagccattcatctaatcctttttcaaggtttttagcttctttgcgatgggttcgaacttcttcctttagctcggaaaagtttgatcgtctgaagacctcttctcgcaacttgtcaaagtcattctccgtccagctttgttccgttgctggtaaggagctgtgttcttttggagggggagaggtgctctgatttttagaattttcagcttttctgctctgttttttccccatctttgtggttttatctacctttggtctttgatggtgacgtacagatggggttttggtatggatgtccttcctgttgattagttttccttctaacagtcaggaccctcagctgcaggtctgttggagtttgctgtgggtccacaccagaccctgtttgcctgggtgtcagcagtggaggctgcagaatagtgactattgctgaacagcaaatgttgctgcctgattgttcctctggaagcttcgtctcagagaggtacccagcagtgtgaggtgtcagtctgcccctactagggggtgcctgccagttaggctactcgggggtcagggactcacttgaggaggcagtctgtctgttctcagatctcaaactccatgctgggagaaccactattctcttcaaagctgtcagacagggacattgaagtctgcagaggtttctgctgccttttgtttggctatgccctgcccccagaggtagagtctacagaggcaggcaggccttgagctgtggtgggctccacctagttcgagcttcctggccgctttgtttacctaatcaagcctcagctatggtgggtgcccctcccccagcctcgctgccaccttgcagttcgatctcagactgctgtgctggtaatgagcgaggctctgtgggcgtgggaccttctgagtcaggcatgggatataatctcctggtgtgccatttgctaataccattggaaaagtgcagtattagggtgggagtgacatgattttccaggtgccatctgtcaccccttcccttggctaggaaagggaattccctgaccccttgtgcttcccagktgaggcgatgcctcgccctgcttcagctcacacttggtgggctgcacccactgtcctgcccccactgtctgatgagccccagtgagatgaacccggtacctcagttggaaattcagaaatcacccgtcttctgtgttgcttacgctgggagctgtagactggagctgttcctattcagccatcttggaaccacctgacacgttttgtcttgataaacatcttaaacaacagaaaacagggttcaagagcaaagaaccggtctgaccaraaatttaccagggtggaattttcccaaccctagtaagcctaagggttctgcaggagaccagggcatatttcagtccttatctcaactgcacaagacagacagtcccagagcggccgtttatagacctcccccaaggaacgcaatattttcccagggtattaatattaatattccttgctaggaaaagaatttagcaatatctttcctagttgcatgtacatttataagctctctgcaagaagaaaaatatggctctttttgcctgaccctgcaggcagtcagatgttacggttgacttccctttttccataaaaatcggtattattctgttctttttcaaggtgcactgatttcacattgttcaaacacatgttttacaatcaatgtgtacagttaacacaatcatgacagtggtcctgaggtgacatacatcttcagcttacgaagataataggattaagagattaaagtaaagacaggcataaaaaattataaaagtattatttgggaactgataaatgtccatattaagatgaaatcttcacaatttatggtcctctgacacagttccggccggtccctccgtttggggtccctgacttcccataacaataaggagagttaaatctgtgaggaagggatcaaaaaagaatattctgggtatagggttgtacattgaggaaatgaaagaagaccagctatcattaggaggaagaacatagtacaanataagctggaggaagtgcgtaggggtcattacatatgcttcacctnctaggctatgttaggaattttgctgtttctcctaggaacaatgacaggagactgacgtggaawaaaaggttgatagggtggaattattttaaatttccatttaatctatgttattctgcctcattcttcatgacattattatgcgttgcgtgcttgtgtcaaaacgtctcatataccccacaattatatacatctatatactcacaaaaatttaaaattaaataactatgttattctggtcattgtggaaagaacaaattagagaaagagtgaatgtagggtgaccagttaggggtctatggcggtggcccagagggccatggtgatggcttagattagggtgacagggaagatggttatgagagagaattaagaggtaagattaatggatttgacttagctatagggtagggagagaaagggagtcgttgaagataacaggttgtcatgaaggacatttgaaggatgagaatgagtgagatgcactgagctgaattttggatatgctaagtttcaggtgtctttaagacatccaaatagatatgtatgaaaggcagttagctatacagatacaactttgtggctcaaggtctgcccatatatgtgtttgaaagtcatttgtgttcaggagataattgaagccaagagtatggaggagactctgtagggaaaaagtgtcaaatgaacaggacacagaactgagccttgaggagctacaacattgaatgaccagatagaggaaggatccatctacaaagcaaacaaaaaaggactgaaaatgtaggaagaaaactagtaagctgttaggtgtgcagaaacaacaaccacaaaaagtatacctggctataaagaaaaggagaaagagaactagctggagggtctttggggctgaaatgctttaaaaaaaaaaaaaaggtttggaaggtttaaaaaagcaatgtaatgtagattccttctacataccattcttgaaatgacaacattgtaaggatagctgggcaatcagtggttgccagaggatatgaacagtggggatgtgactgtaaagggtagtccttgggagtttcactgaggaagttccttggtggtgatagaagagttatatgtcattttgtttgtttttttgagatgggggtctcgctttgtcagccaggctggagtgcagtggtgcaatcacagttcactgtaactttgaaacctggggcttaaatgagcctcctccctaagccacccaagctgtagctggtactacaggtgtgctccagcacgttccacaagaactatatatctttttgttcttcacattcctgtcagactttataaaacaaatggatccagtagggaacaaacacaatcattatgctgactgtcaggaatatagagggaaagaaaaaatgttagccttaaagtatttgaaaaccactgactgtatgaaaatgctacttccaggcacctgggctatggctcagatgctgatattaacacatcagaaaggtctcaatttagtgactgtcccacatgctccagccttcctgattttctctctctgtattttttaaatgacagagcctgaatatcgtggacaataattgaggaggatcagagagcccagccaggcaaaattagaacagacttgggtcttgcaggctatacttggtgagatctgagttcttgagaaatgtgtcacattcaggaacctgccttcactttttctgctacttattctgtaatggaagaaacagaccaccactgtgtgagaggggtccttcctggcttccctcctcacagctgtgtttcaaaggggaagagatctgtgaagggcaagcacaggcacagccagagcccacagagtccactgggaccagcatggggacaatcagagtctgtggtcctcctgcctactgcatgccctacactatcctgtgggggttggggtgagataactgctgtgggggaggagcactgtgactgaaggaaacatcttttctcagctgtgggcgtgcctaacctctgtctcaaacccaactctgcctttaccttggagtgtccagaaaagacagcaggggccaaatgacaagccaaagttagtgtgacatttccacggagtaggggttgcaaaattgccgttggaaagaggagaaataaaggccatggaaagaaactctagggaaatgacaggccttattcacagactatgtccagaataaaggagccccagggtcaagggtcaacagtaggcctcttggaaactagggtcccattggagtcaggaaataaaaaattcaagtcattcataaaagtcttgaaaggcatgacaatttctaacagttgctagaaatggtaccaactctgggttcttgggctgttaatgcacagaaattggcatgagactgaaaaagtttccccagacaaggcattattggagtttatacctggacataagagaggcagcacaagagagagagaattccctgactgaagccagtagggctttttttttttttttttttttttttaaattaggcaaagcatgggaattgacttcaggggtagggtatgcaggatgggctgggaaagtgtgaagggtagggtatgccagtcagcatatctggttacagtggttatcttcaataatgggcaacctggtgatctggctggctacagcaacagtgtaaatcaatggctcagcattccttacctatgtgggacactcaacaaccttggttatctcctaaggccagtttctggaattatttaagtaaaaggtatggttcaaacattgtggcctaagcaaggtagtagtgtgggtttgtggtgagtggggatgcacaaaagaatgctctagtcgatataggctgaagccaagctccgttcctacttggtctcagaaaaaggcaatgttttctttagtatacattggccaagaactcagacttttataaacttgcttgaccagttgtcactgcttcgttgtgatctcttctgccactgggaatggatttattaactacagggctttgtgttgtgggagaagatttagtgattccaagaaaggaattcacttttattaaaataggttaataattaaaacttcaaagtgctacccagccatagaagtttcctgaagaaagaaaacagagagtcattggccatatgaggtggagatggtttcatctgaagtgtggaaaaaacagataggcttgtgttctttcctgtggcaggtgtgggtaaatgtgtcccccccaggggcctgcccttgtccatagccctacagtgtcttgcaatgtaaacattttcttttccaaggatctggtagggtggacataaatccaaggctcataaagtaggaagaaaagggggtggcctgggagttcctagcaggcagatcctcctcatactcattgtatttccagggtggggcagtgcttcacacatagtaggagctccaggaatacttatcaaacaaaagaacaaaggtaaagagaagaaagggaggtcagatggaagaaagcgcatgaccaattcaaaaactagaccccctatgaagttgcctgcagtgatcaattttaccatgagctggcagcacagagaaaagttctggccagggcaacctcgaggttcctgaacctctgccccttttctcagcctgggactgaactccctgttttggagatctctaaaccaagtatacacctcattgttccaaaaacaaaataaaacaaaagtgcagtccttcggcatttataaaatgtgagttccaatgtagctgaaaactgcccacccctcagccttgcttaatgttttaatttttaaaatttaaataaattttgttccttcatactttacacttcgaattttggtgcctggcagaaggactagtccgtcgagagagaaagaccatgatacaggtggcgatttggccgctgtcctctttggacttgaggtccacaatgatgtggtcgttggtgttggggatgaacttgaagaatgaactttaacgtgcgcggggcccacctcccccatgtggctgacggaaatgtaaccgaagtcctgggtggtgctcaggagtcctcgctgcaccgctgggggcaggaccggcgctgcagcactttccagcaggcggactaggggtgtgaggcagcctggcggtcggatttccgtggcggccctgggagcattgcagctgcacacccagttcttgtggtccacgctgcccttgtggcctgccactctcacccattccacgttctcagtcactatgtcccctccttgcccaggctgcccccctacagacgctggccctccactgccatgaaccccttctccactgccccatcgccttcggagagaattacccgagacacggccttgctgccatctatctgataggtcacccctctcccatggtccatagagtagtttcccaccagagacgttcagatccgagagctccatgcccctctccactttccgccaggtgggactctagaatgcagtggtctttgtttcatttcaccaccaccctgtccctgctgtctgatagggttgggtatccccttttcaggtaactgaaccaggtgttttcttcttgggcccttgaccctgtgcccaggtcagcaatgactgcgactgggtattgaatcctacctggcgtcctctggaaggcaaccagggggtaagtgtcattgtccatggccttggtcatgggcgcaagcacaggaaggccccgcacacttatctggagagagcgcacagactcattccattccaggtggtcagagggctgggcaggcatgagactgaagggcaggcgggacccagtggagcagggagtccgacttccacccttagtaagctcgcctggcctgagttatgtgagagtagtgatggctacacaaattaaagcatagaataaaatttcatagaactgtatacacacacgcacacacacacacaaatagatgcctgtgaaaactggtgacatgagaataaagtctgtgctctagttaacagtattgtaccaatgtcaatttcccggttttgatattgtaatacagtaatacagttacataagagatcactattggggaagctaactgaagggtacaggggactctggactatttttgcaaatttctgtgagtctacgattatttccaaagaagatgttttaacaagtgaatgagaatgaaaaatatgaaatttgcaatgactttttctttagtattttgccctttaagtgtaatctaattattacaatcatcattattactcatgcatagtgtacaggaagcacttctcttattaaaatataactcaaaacttccagaacttgtcactggaagacactccatccaggcagtttggctgacttgaaagccaaacctgtttgcagtaggaccttccttaattatagcagattatagcttgattatacttggttatagcttgttgcaggagtgggctgctctctcttgagaggtcaaactttacttacaattgtacatcagaataagtgaggagtgagtatactttgaaaaggcatatttgaaacagcagtttcctcattgtttttattgtggaatataacatacagaacagctcaaaaaccataaatgaagaacacttagaaaatgaacaccagtttaacctaggttaaaaaaaaaaaaaaaagaaaatgtaatattacctgtgagcaccccagaaatctctcatatgctgctttctttctttctttttaaaatagctttatagataatatgatttaaataccataaaattcacctgatttaagtgtaccattcaatggtctttagtatacttaatggagttgtgcaaccatcttcacaatctaattttagaatttttccatcacctcatgaagaaaccatgtgcccttgatcagtcagtccccattttctgtctacacccccaccattgtctctgataaccactggtctactgtctctgtgaatttgcctattctggacatatcatacaaatggaattatatcatatgcggtctttgggtctgactgctttcatttagcagaattttttgagatgcatctatgttgtagcatgtattgtaatttattcctttttattgccaaatagtatttcattatatggatgtatacatttatccactaaytgatagacatttaggttgtttgtactttcgggctgctatgagtagtagcaaagtgaacatttatatacaggtttgtgtgtgtgtgtggacatatgctttcagttctttgggtggagaccgaggagtagaattgctggatcaacagaaactctaacatgttgagaatctgccaaacctttccaaagtttatcaacaacagtgtttgttggttcctgtttctctgcaacctcagcaacacttgatattaccttcattttttcttatacctatcctaatggatgtgaagtaccatctcactgtagtttggtttgagtttctatcatgactaaggatggttaacttctattcatgcgcattactgaccatttatatatcttctttggagaagtttctattcaaatcgtttgttttattttatttatttaaagatgggagtcttgctatgttgcccaggctgctctcaaactcctgggttcaagtgatcctcctccctcagcctcctgagtagctagggctacagatgtgcacaaccatgcctggctcccctttgattatttttagttgggttgttttcttattattgagttttaaagttttttgtatattcttgatacaaggttcttacagatatataatttgcaaatattttctcgcagcttttgggttattttcattttcttgatggtgtcatttgaaatgcaaatgtttttaattttgataaagtcaaatttctcatttcttttcttcttttgcctgtgcttttggtgttgtatctacaaaatcattgcctgacccaaagtcacatagatatattcctatatttctaaagtataggttggtgcaaaagtaatcatggtttttatcttgaaaagtaatggcaaaaactgcgattacttttgcaccaacctcacaaatgactcaaagatgttctctatgtgttggctcttaagttgtttatttcttcacagcagactgagatccattggctcaaaggctgccagcaccagacttaaaattgtacacacacaattgttttaaacatagcccaaataagcatatttttagccatttagggcctgatctgcatactccatgaaattggcaatatttattatccatagataagataagccccagtgttataaagttgccaggctgctgctgtcctttgagttcactaaccctgagactccctgctgtgcctctgacttatcccctttcctagaagtttccttgctctcctccccttctgaatggtggtccctccaagactccggatagtttcaagatgtgaaggactcattcctcctgcttacttgctaaagcagcaccctgctaaagcttgtgcatgttgctgccagctcatcatatctttttcttcgatcagtccagaaattctggaactcactccctacagttttcctctaaaagtgttatagttttagctattatatttaggtctatgattcattttgacttaatttttgtatgtggtgtggggtaggggtacaaattatgcttttgcatgtggctattcagttggcccagcaccatttgttgaatacaggattattcttcaccccattgaatggtcttgacactttcttgaaaatcaattgaccacacacacgagcttatttctggactctcaattctatgtttaccttcatgccagtactacactatcttgattagtgtaatattgttgtaagttttgaaatggagaagtatgagttctccaactttgttcaagattattttaatcagagtcctttgtgtgttcttacgaattttcggatcagcttgtgagtttctgggatttagaaaggaattgcattaactctgtagaaaaatttggggagtactgccatctaaccttctgatctatgaacatggagtatcttcctctttatttagatgtttaattttaaaaatattctgtagtttgcagtgtacaagttttgtacttcttttgttatacttattccaaagtgtttattgttcttaattacattctgaatgaatttttttcttaatctcttttttgagttgttcattgctaacatgtagaaatgcaattgatttttgtatattcatcttgtatctgacattttgcctaacttgtctattagctctggaaattttttagtaaatgttttaggattttatatatacaagatcatgttgtctgcaaatacctttactcttcctttccaacttgatggctttattttgcctaattttcctgtctagaaccttcagtaaaatgttgaatggaagtggtgagagcagatatccttatcttcttcttgattttagggaaaaagtatccagtcttttgctattgagtataatgttagttttgggtttttcatrggttcccttaattagattgagaaaattactttctactattagtttgtaaagtgtgtcgttgtgagggggtgggagttastcatgaaagggtattttttttcaaaatttttttctgcattataatttcttttgagactattatgtggtttttaccttttattctcttaatgtggtatattacataattgattttcatgtattaaatcaatcctgcattcctaggataaatcccaattgatctggacaagtttatggactatcagtactaatttttctctaaatgtttgatagaattcaccagtgaagcctctgggttctatgtttttctttgaaaatactttaaattactgattcgatctcttttcctgtcataggtttgttcatgttttctattcctttatgagtccattttggcaatttgtgttgctctaggaatttgcccacattacctaaattatctaatttgttggcatatatttattcatagtatttacttatagtccttttaatatttgtaggattaatggtaatatctcctctttcattccggatttttttgtaatctgtgctttatctctttatcttgttcaatctacctgaaggtttgccaattttgctgatcttttcaaagaaccattttttgattttactgattttctattttttttgttttttctacttcttttatttttaccctgttattattttcttattctacttgttttgggttttgtttgcttttccttttctagatctgaagttgaagtcttaagattattaagatcgttcttcttttctattatagccatttaaagctacaaatttgccccatgtcttgctttaattgcatcctacatatgtgctcctttctgattaaaactctctccttaaagatatatagtaccctgactcttgtaatatttttctcattttctgaaacaatacactttagttttcttgttagggaactttatttaaatggagtcacgttgcctctgtgtgtgtgtgttttgttctttttatccaatattatttctgggcattggtgcacgttgttacaagtagtcttaattggtttatttgtctttttgtgttccacagaatgctactttactgttatagcgtataatttacataacatataaatacataatttatcatttcattgttgatgaacatttgcattgtttccaatgtaatatactcaaatgtaatatgaataatgctgtgatgtacattcttgtacatgtatcttgaagaacatatgcacatatttctccagtgttgagacttagctaagagtaggattgttaggtgacagtatatgtgtattctctgttttagtgtagaatgccacactatttttcaatgagattgaacctcactacattgtcattagtaacatatgagagtttccatactcctattatcaacatttagtacttgcagttgttttaattttagttgttctggtaagtatagtggtacttcattgtggtttttattttcacttccccattgctagtaaggctgagctctgtttatacagttagtcacaatttggatattctattttatgaagtacctattcaaacctttttgcccatttttcttatagattgtctttttcttattgatttatagacattcttctatattctgcatagaaatcctttgtcatatttatgttgcaaattttcattatgtgtcttacctttttactcttttattgtgttttggggtgtatatgttcttttggtgtaatctaaaattgcaataattttccttttgggtagagctttttgtgttttgttgaaaaaaatccaccgtgtcccaagattataaaaaatttctcctaaataccttccaaaagcttgattgtttatcttttaaatgtaagtcttttaacttgtctgaaattgatttttatctatggaataaggaaggagtccaatctatttttccaatatgggatcccagttaccccagcaagtttagtggaaacatttatcctttccctagtgatctacagtgtcacttatcaagtgttggtgtatatgtggacttgtttccaggcctctatcctgttcccttgattattttatctaccactgagccaacactatatgatcttaattattatagcttacaataagtcttgatatttgctaggacaaatcctctctcatctcccaccttgttcttcttgaagaatgttttttctctttttggcccttggcatatcttaataaattttagagtaagtttttaagctgtaaaaaaaaaaaaaaaattctgggggttttattgagactatagtaaatctacagataaatttggagtaaattgattatcttcataatattgagcttcctatctatgaacataatataactcttcgtttatagatacacttaatatctctcaatagagttttataattttctccaaagagatcatcttttgttaaatgtatttcttgatatttcattttttatgctatcttttaatttttatttatttatttattttttgagatggagtttctctcttgttgcccaggctggagtgcaatggcacgatctcggctcactgcaatctctgcctcccgggttcaagcaattctcctgcctcagcctcctgagcagctgggattacaggcatgtgccactacacccggctaatcttgtattttttgtagagacggggtttcaccatgttggccaggctggtctcgaactcctgacctcaggtgatccacctcagccttttctgctatcttaaatgatatatttttaaattcaatttttgtattttttattgctgatgtgagaataaattgatttcttaaactattgattatatatctaacagctgtactaaactctcagagtcttataatttatatgtgggttcttctgaatgtttatgtatacagtcagttctaagtatcttcaaaaatgattttttttctttccactccttatgtgtttgacttttttttttcttgccttaatgtgctgagtagcttattcaggtctctttacttttacctaatgtctttttctgtttcagggttacatctaagataccacatcacattagctaaggagctatcatgtctccttaggcttctcttggctgtaatatttacttagatttttcttgttttggatgaccttgagtttcaaggagtacagaccatgtattttataggttacctctctactggaatttatctgattttttttctcatggttagactgggattatgggtttgcaggaggaagaccacatcatattaaagttacattctaacataatttatcaccgttgatattgacggattgtcacatttccttactgttaaagttactctttttttcatcatttccatactgtactctttgaaaggaagtctctatgaaaggaagtctctatgtgcagcccacatttaagaattgattatttcagattttctacataggcaatcatgttatctgtgaacaaaaacagttttacttctttcttcccaatttgtataccacttatttatttatttgccctattttattgtctagaactttcaatgcaatgtagaaaagcagtggtgagagacgacatccttgccttgtccttatcttagtaagaaagcttctactttctcattttttgtagatgttttaattaattaattawttaatttatttatttatttaagatacagggtcttgctctgtctcccaggctggagtccagtggtgtgatcataggtcaccccagctttgaactgggggctcaagtgatacttacatattggcctaccaagtagctagggctatagatgcatactgccatgcctggctaatttttttttttttttttttgagatggagtctcactctgtcacccaggctgaagtgcagtgccatgagctcagctcactgcaacctccgcctcctgggttcaagcagttctcctatttcagcctcccaagtagctgggattacaggcgtaggccaccatgcctggctaattgttgtattttagtagagacggggtttcaccatgttggccaggctggtcttgaactcctgacctcaggcgatccacctgcctcagcctcccaaagtgctgggattacaggcataagccaccgcacctggcgcttttttatttttattttttagcaatggggttttgctatgttgaccaggctggtcttaacctcctggcctcaagtaatccttctgtgttgacccccaaaaacacttagattaatgggtatgggctgctgtgcccagctgtaaatgttctctatcaagctgaagaagtttcactgtatttctagtgtgctgagagtttttatcatgaatgagtgttggattttatcaaatgcatgtgatcatgtgacttttcttctttagcctattgatttgatacattatattagtgacttttgaatgttgaaccagccttacatgcctggaataaatcccatttggtcatagcatataattctttttatccattgctatatctgataatattttgttgagtatttttgcatctatgttcatgaaagaaattagcctgtagtttttttttcttgttataactttgtctgattttggtattagggttatgggctcatagaatgagtcaggaaatattccctctgtttctgtcttctggaagagacttttgaaaattggtataaattcttctttaaaattatagtagaattcaccagtacacccttctgggcctgatgctttctgttttagaaggttcttagttaccrattcaatttatttaatatatatagtactactcagatagtctatttctttttgtacaagttttggcagattgtgtctttgaatggattggtctgtttcacctaggttatcaaatttgtgagcgtagagtttttcatagcattcctttattatctttttaatgtccataagttccatagtgttgtcccttctttcatttctgatattgtattttttgtttttgtagacacagggtctgttttttttttttcctttgagagagggactcgctctgtcacccaggctagagtgcagtggcacgatctcagctcactgcaacctctgctttctgggctcaagtgattctccagtctcagcctcccaagcagctgggactacaagtacaagccaccaatgcctggctaattgttttgcattttttgtagagatggggtttcattgtattgcccaggctggtcttgaactcctgagctcaaagcaatccgcccacctcagcctcccaaagtgctggcattacagatgtgagccaccacacctgccttagacacagggtctcactttgttgcccagactggtcttgaactcctgggctcaagtgatgcttctgccttggcctcccaaagtgctgggattacaggcataagccactgtgcccagcctgatattaatatttttgcatcctccctctctctctcttttaaaatattagttagcctagctgtgggcttatcacttttttgatcttttcgaagaaccagcatttggttttgttgcatttctctattagttttctgttttcaattccattgatttctgctctaattttcatttctttttttctgcttcctttgaatttaatttactttcctttttctagtttcctaaagtggaagcttatgtgattgattttagatattgagtatcacagggtacagtaggtgaatttttcttcttttaaccatggagtacacattttgttcgtgtgaggatattctttaattcactagatatttactgagcacctaccacgggacaggcactgtagtcttggccttcatagagtttaccttttcttgaacagaatactgaacatcttcccattgaaaacaaaatacctaagacggggagcaaaatgtacatacagactgaaaattctgaatgagttgccttttcttcctccaccctttttctcagattatgaccctctggaggatttctagcttcataagtagtctttatttgggctccttgccctgcttggactgcaagtatagttgacatttatatcattcctatccttgcctctccctcagctctgagcttagaagccccagccactggtctttgaagagatcttcagggtgtgaggtgccatcagagcatgaatgaatgacatttttacctcataaaactctactcctctctgtatttttttgaggtctagattttgaattttcaaaataagtttcaagagcatcactgtttattccataggccctcgacatagtaaaccaatgacatttttattaatataggtattttctgtgatctctagtgaggtaaattttaaaaattcgtttgttacacacttatatctggttcctactaatcttcagaaaaagaacaggatggagataagtcaggtgagatacatacattgactatgaagctgacttctaactagttcctagtttagatcataattaagcatcagaaaataacagagcccaggattagggtgagacaagtgagaccacttttaagttgtagaaaatttaaggaatgtaaaaaaaacttgattaaaacaaattattttaacacaatattttttcattttttttttcttttgagatggagtctcactctgtcacccaggctggagtgcagtggggcgatctcagctcactgcaacctccgcctcccaggttcaagcgactttcctgcttcagcctcccacgtagctgggactacaggtacctgccaccacacctggctaatttttgtatttctagtacagacagggtttcaccatgtaggccaggttggtctcgaactcctgaccttaggtgatccgcttgccttggcctcccaaagtgctgggattacaggtgtgagccaccacacctggccaacacaatattttttaaggccaaaatgaacgcacaaattccatgacaaacgaaatatccaaaacttaaagacaggatgttatactgccacactgccattacttctgaggcaaaaaggaaaaagcgtgcccctgtataaatgtattttaatggttattttcaagaatattaatgtatttgaaaaaatattgaaatgttaaaaagtaggtgtattaaaattcattttagttttttttttttttttttccaaaaattgcattcaaatgtattttacactttaggcagttcttaagaagggagagtgcggttttttgacacttaacatttaaaggttttattggccacattaatctttctcacaaaagttttaggttatctrtaagttcttagaatgtcaaagaagagaagaaaaactgactaactttaaggrgcggtggaagaagcagcaacttggcaataattccgcagccaacttcgcgtgttcaggcatcctttttctccagtaaaattttgtgcaactcrtctgcatcctcgctggtttttacccgaatcaacatggtgactggcatggtggcattcttctcgtcaattggtggatttggaacacagacgataagaacgttattcttccctgttcgcgtacatggcatattgggtggaatcagaacattcagcaatatgttgcctaaattggtgtctgcccgcaccaaaagctrtgtcttctgatttgctgtaggttttaaatgcagagtacctatgcctttctctttaaactcattgtctttcttgtaaaayagtttacactttttggagtaaaaagcatcttcttttacttcggtaactactactttgggcggctcatcattctcttcttcatctccacctttgcrttcaccactgtcaccttccgcttggccctccaatggtttagtgggaaatggtgaagagactggtttactctgggtagtatctttgccaaataaactggagtttccaggggagaaagaaaatccagtcagggggacagagcttaatgagcccaaaacagagctatcaactttcttgtcgaaattaaatgaggcacttgtcgctcctagtgatgatgggtccgttttcttttcagatgccacctccaccttcttgtcaggtgtatcttcagttttgttgccatgaaacaaaaacgttgactcttgctgtaattttgttgagccaaaaagggaaggagactgtgtttcagccgccactttgttagattcactttcagaattcctgccactgttcccgtgttgctgttcaatgtttgctaaatatttctcatagtccttaaagataggtgtcagatcacagagggggtttgtattcacgtgcttcactatccaatcccgcacggagcagttcaaggcggccaactgcttgtgataggcatttccgacacaagctttactggaagcaaggccagaggaggagggctgctgactgtccccattagttttgggatttgaaactttatcaaccaaggcggtagggccatttgcagcaagagaaccaaaggctaccttgggctctgccgctgcctttgcactggtgaagggaggggcactggttatgttgtttccattcgacagtccttccaaaggcttccctccagcgccactaccaaatccaggaaagcgtcctcctccagaaggtaccaccaaacctttaaaacctttaaaggctcctccastgtcagattcgaatccamcatttctgcgctttgctttctttatggctctattcttcaagacttcctcactggccayggagaatgttcccacctcttmagcttcatcttcttgatcccaattcctatctgtcagttccttctcggcatttcttttggccgtgttttcgaacctcctcggcggccgccgctgcactcgctgggtcttgggtgcggcgaaacccagggcgmagcggcgcaggggtctggagcccgcaggggtcgccgggctgagcgcgctcggccgcttccrgtgctgcsctgcggaactcagaggacttggtgttcggcaagcccagagactcaaacaccatgtccatggagggggggtcctcacgctgtgttcagcagggaggcgagagcgccggttcagccagagaccgctgggggaaccgcgccgaacacgctccgggcggccattttgtaactcgaatctacccccaaaaccaattcgaaaaaaggcaattcattttagttttaatgttttatagcaaaacaagaatttgctacagttttatttttctgattttgatagaagcaaattcattgatatctttaaaaatactttggggaaaanctaatcatttaaacaatacacagaaaagcatgtatataggtgcacatatttttttcttttgccttctgctccaatgtgactttcacgtggaactgaggacaaaagtgtggytgagtgaacctgttctacatggttgtgatataagttgaaatctaacagagaactttggctatatgaattcattcaatggaacaacaaaaatctagagaggtttgccttttaaactcttagactaattattccaggaattgcctcagtgcttatgttagcttggtgtcagatatctgtactcgtaagaacaaagtcaaaanagaagtcatgaaatttagaatggcttcttcctgtcaaatacatttagaacatatttttggaataatttcaagtccattgggaacacaattactaggaatttgggacagaggtgacaatgagaatctgctttgagaaagtagatcataatattacagagctatgccttcatcagtttaaaattggaagtggtttctctgttattttctaccctggagtgttcttaaaattatttttatctcctttaagaaatttgcagcgcttctaaaaatgaaactgaaagtgccacaaatatgcttgtgctccaaatcagttttaagttaacatgcaaagagaattttggctactttttgtttggagtcaaatataaaactaaacaacatgtgcccagatttcctaccatggatttgcaaaagntattttgaaacctttcttggcanaaatcatattctgttatgattcagtgttgcactgtaaacagagtgtttagaaattggggtttgagaagtgtaacggctagtttccttaaaagaaaaaaaagattcaaatgcttggtttgcggctggagctttttgtaaattaatcaaattgagtgcagtgggaggggtgattcattaagtagagagctagtgaagacatatcctgtgaaaggcagtgggctaagtggtagggggagaaggaagatacagagtgctttcaaaagtgcctaaatgtaagtcaacagggcagtgtgccaattacantgttataatgttctacagaagagggatgtacaccaagaatgccagcctggacctctggtgtgtcttggaagacttaaccaggaaggggacgattcrtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcaggcaagtaagagggctattagttccctagaaaagtggagaggcatatttaacaagtaagaagtatatttacattcatatcagggtggggagaaatgcatcctcaggtagccactaaacctgggtacttggaacgcaaggggcttacaaaatattttagggaaaaggggttttgagctgtcagtttgaaatgattgtctcttaaaacctaacattattaaccttccccctcaaaatgtttgccttttcatagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaaggtaccaagagtcctttgctttctctcactggtgacctttcttgcaattagatttggcaggaaatgtgttcatctagaaattttaaatgaaccaataagcaaattacttcccctagaaaattttactcttgcgtgtttaggccatttctctgatctaaaagttgtatgttctatttaattttcctctctcttataagaactctaatttaaaatttattcctgacttgataaatagtaaaacctctctggggtatgtgtgtgtgtgtgtgtgtgtgtgtgtgtgtgtgtgtgtgtgtgtttgggtgtgcataggtaaagcacacatttacctggtttggtattcaaagacccaagcctcctatgggtctccttcctctctctcccataagtgtgtgtgtgtgtgtgtgcgcatgctcctgtgtgtgtgcatgtgtgtataggggggctcttttccaaagcctgctggacagcagatagaattttcccgggaggctagttgtgattactaaacaaaaatagcagggccccgactgttcctgccctgaacagtgactcttctgaccatttcctagaactgatattgttgccaacttccctcccatcccctcccctcctctactgtcccttccccttctctcccttctgtatagatcacctctccccagtgcagcagcaataccaggacaggattgttttgttagtttttttctcaatgactgccaaagaaatagcaacatggcctggcagagtcagatagcgctcttgggcatgtgttttgtcagtctaattctcaacaccagtaactctgtgagtgtttaccccacctttcaagctttgctttagcctaatttgccctatgtggctttagtcacttggtattaggcttttttcttccactgtgttgtcaatcttatttctcaggtcatttaggggtagtttagtgctggtgcattcagaataagagctgagtagttgtccacgagttacctgttacccaaatctagaatgctgtctaacgttcacacagatttactttgctctgtacctagtatcaaggcccagcccctcatgttatttgatttttaaatgctaactaaccactatgaatcctgaagacctgacacaggtctcagttaatttagaaagtttattttgccaaggttgaagacgtgcacccaggacacagcctcaggaggtcctgacaacatgtgcccaaggtggtcagagcacagtttggttttatacattttagggagatataagacatcaatcaacacatgtaagatgaacattagttcggtctggaaaggtgcagggagggggcttccaggtcataggtagataagagacaaatggttgcattttttttgagtttctaattagcctctccacagaaggcaatgatatatgcatttatcttggtgagcagagggataactttgaacagaatgggaggcaggtttaccctaagcagttccccacttgaagttttcctttagtttagtgatttgaggggcccaaaatactttcacatttccccccttttctttttaaaaatctgttggagaacgcattttagaagaaaatgagtctctggcctcaggtttcgtctgatctctcatggctaggatggtttattcctagatagytaggtcctgagttattaggaaagctcctttttagaaggttgtgaagtctcatgtcctgtgaagagaaaatagggggaggacaacaacaaacaaaagaacaattctggaaaatagatatatgccacattactctgaagtccatacatcagtaggcaggtatgaaagtggcttatgtatgtaaataggtcgctgctattttcttctgaagctcaagttgtttagcttcatttcacagggctttatgaaagcacatcttagtttccagtgactccaaatttggaaaaatkgaggaaaaaaagaaggaaaaaaattgaaaacattattttgaagacatgtagctaagaaaaattagaattcagtccaaactgtagaaaataataaaaattgaaaaacattacacaagactagaatctaacaatagatgtactatagtttttgaaacataatttttctctctcccctttcccatttttatgaaagacaaatcatggcaggactggttttccttattatacttggcctaattctttgtatacagtgcagcaagaataattattttttatataagcttttaaattggctttgatggaactttttccacagaaggaatctcagagaagacttttttaaagcacagcccagccatggatttgtaccatgaaatacctatgagttgggtgaattcctctccttttgagctcctaacaaaaacctggggctcctgggcctgtcagtaagtgaccttttttacttaccacaggtcaggaaccctgtacagggactgtggagacaaaggtatgaggctagtttttccaagggactttttattggctccataagtcaagtttaattctttaaaggaaagcacactatttcagtcaaagccttggtaaaataaccagtttcttcaaatgtgtgctgttacaaatgaaaacagattcttattgcacttatgcaaataactgtattgtcataagtaaagaatactcacaaatagattccaaattctgtagaaatcaggtagttttaaaaacaaatatgctccaaattttgttcaaaggagtatactccattgttaaaagctgtaaatagcttaaaagtttcttgattttgaaaaacaaattatcagcaacattttaagcaaaaagttaaaaaagattacttcaaacttctattagtttagtccatgcagttaattcttgttctgcttgatattcatgaacatttcagctctccatgagtcctcgaagttttttctctattttgatgtcacagtctccagagctatcagaaacatgcattcaagaacacctgttaagagttttatagctgattataaaactacctctgaaaaggaccaaaaaaagatgacaattgtctgtgaataatgaaaagttttagggcagccatagtcagacattctgttacctctgtagcacacaataatttaacataaaaattataattattactgataacatacagtgtgtcatatcagaataataggagtttcccataattttggaatacatactaataacatatttatacaaatacagcccaaagaaaaccaaacaccatttcatattggacaatgcttcctgtataattttcataccaaaaaagccaaatatgtcacttttggactttagggaacccattaataccatcttaaaggactaattagttcagaaaaagacataatgtataatttgatttcagaaagtttgtcaaatatcaaaggttttaaacacttaatatcacaaaataggattacaggtcattgtaaaataagtcattcatttagccaaagtgataaggatttcaaaacaaaagggcaaaaaccttcattctttgagagagaagacttaattttctaaacattaagccctaataaaaaaacagcatgaagccaattagttttccaaaattttataaacaatccataaaggtttaatcttgatcataagatatatcttccatgagccttttatatctttgtaacctttattaaggagttggttaatgttttaagaaaaccttgttaatttgacatgggttgatatgctggtcttgcatcagtgtgcctttgacattaatggttaatttatagagaaactgaactcattttatctctaaaaattaactttgtgatctcacaagcccacctcttctgcaatagcccctgggccttgaggagttaaatgcctttaatttctggccctgcgtctcaggaatgcagtttattttgattggcatcttctagggggcctggagatgaggttttaattgctgtcagtgtttgagatttagcaggacttggtgttctttttagacccaagagtcaaagccctgtaactcaatgtcacaaggactttaaaagcacatacaggaagatacaagaatgtaataaccttaattaaaaaaacattttacatctcagtttttcctaaggaaaccaaacttaataataatggcatgggagttattttgataaatgtaaaatctgttaggccagttaccaaaaggcaaaagaaaataccttctgcagtgcacagaatattatgttggaagaaaacaattcctttagacctttaaagaaatgttgttagcatcaggccaccaaaaaaagaaactgagcagggaaaaaaacttatatgagctgaaaattagttgaaggggagtgttactatttcacactttttaaaagaggagagaaaaccaaaaccagcgagatgtaatataagtgtataagtggcattttttttaacatcaaacccaacctctagaaagaccattattatttccctttaatcataggcaacttgatcatataaaagtttttgttttgttttgttttttataaatcttcttcttgtgacttatacagattgttcatgacatgcttgggctttctggtttgtcttgaactaacttccttccttcctttctctctctctctttctttttctttctttcctttgttttttttgagatggagtctcactttgttgcccaggctggagtgcaatggcacgatctcagctcactgcaacctccgcctcccgggttcaagtgattctcctacctcagcctcctgagtagctgggattacagrtgcacaccaccatgcctggctaatttttgtacttttagtagaagcagggtttcgccatgttggccaaactagtcrcgaactcctgacctcaggggatccacccgccttggcctctcaaagtgctgggattacaggcttgagccactgcacctggctgaacatccttctttcttaaacagtcattttactctaggactaaatttaccatacaagattctttctcatatggaattatttctctttaagctttcttaccgaaaaaagctctttatttttataacttgctttacatgtcttttatttcttggttccttttaccttgttttgtacatgccctttaaataagctttgaattagacaaaaagtgttcaccttttttaaaaggacatactgctttttttttttagaaagaatgttttcctacaaatatatttttattggaaaatgcccaaataatgaaatatctattatttaatataactttagattctaaattataatgagtttgtctacaagtatttatcctattacatttacctaattattttaatcatttacctagatcacttgtaaaaactgcgattgtcattatttgaagttatggaattgccattgcaaaattataactgagacagtgaaaaagatttgacctaactgactccatcctgctcttgcttctaacctccaagctgttcttgttcatttctggttgtaggtaggccaaactaattttgggaggaacttagtttatagtttagctttgaaacaaagatagtaacagtcctttcccaaaacaaactttactgctcgtgaactagactgcctaaagccacaagattagaagttatggtaatcttactaaattcaagatgttgctattttaattaaactaatatcagtgtcttatttatgaaagattacacaagtaaagatcattctgtcttgggctgaatttatagttttrtaacccctgtgccaaagtttgacaccttatagtatttggcagggataataactatgaaactgcttgattaataaatgtaaacaaaaaatgtatgctggcaattcttaagacattcctaatattactttacgaataatttttaaagctagcttatttattaaaaattttacttaagttatgtaaagttgaaaaagcattttactagtcttttcttctctcctgataatgtatttatttatgtatttatttatttatttatttattttttagttagagtttcgctcttgttgcccaggctggagtgcaatggtgtgatctcagctcactgcaacttctgcctcctgggttcaagcaattgtcctgtctcagcctcccaagtagctgggattacaggtgcttgtcaccatgcctggctaatttttttgtatttttagtagagacggggtttcaccatgttggccaggcgggtctcaagctcctgacctcaggtgatctacccacctgggcttcccaaagtgctgggattacaggtgtgagmcactgcacccagccaacacttttagtttcttaagccaattaattagagctctttcatacattttcagtagtgaaacagtgtgtacacaacatgtaaatacatagatatattgggcatgctgatagaaaagtacatcttatagatttatagaaacctttttttccccttagactttcagattcctgataaactgtttcacaaccctaggcagttgtcagctaaatagccttaaatttgcatactaaaggaaacaactcgggtgaaaatgatatagcaaaagttacatcataaggtacagagaggaaaaagtctggtggtgttagagggagattaaaaatggatgccaaattaaacataaaattatagaagtctagcatagrattctataaggagactaattttatttaggtagggaatgactacctatcttttaactggatctctgagctctgggcagagcccatactgaatcctgggtctccaaaaagggagaattaatatgagattaggctacgtggtgcttttacagtgcactcagaaaaaaaaaaaaattaaagacatttctaagtgtytaagccacattcttccttaaaaacccaagagtaacctctgttgcaataactattttagtcaaaaaaaaaaaaagtaacacaatacaaaagtaagctgttcgagaactgagacaaacttgtctgtttacattcttgaaaaaatttgttttccctggaaagggagtctggtgccttctccattttctttaaggaaccccaggctattataaactattttaggtcctccatgcagcagagggtgcaagagaaaggagagatagtagaagtaaatgaagaaaacagaattctgtcaactgaaaagaaaaaaacttttgctcaaaaaaaaaaaaaaaaaaagacaaggtcccaggagaaaaacaaaaacatgaagtccttttaaatacaaacacacacatatgcgtgcgcgcrtgcgcacacacacacacgcacgcatcttggatgttaggttttaattaagctgacttttaaccattgagctccttaaaaaaaaacttttaaaatctcattaccatatttcagctaggacaaattgctgctatttcagaagtacagccattgctctttcagtttggcctggctaacaaaaaggtggccttgttatgtaaatgaagacccttagaataaaaaatttttctttttgttttttttttttttcctttttctggccattttttcccctccaccccataccacgtgtgtgcgtgagtgtgtgtgtgtgtgtgtgtgtgtgtgtgagagaatttagccacttcagaggccttgttccccataatttggaatttcctttggatttgatsaagttggatagagttgatcaaacccaatgggaaaaagtccaaaacaacagtgaaaacaggaatgaacaacaacaacaacaaaaacagttaagcaaaacaatcacacaacttatatcattactgagtactctaatagtaaggagaaattaagaccagctggttgttaatcttaactttagccaagacaaaccccaattcagttacttagctagggatgggtctcagggtgtagactgctctctaccatactagaagcagagagaaaaaaaactcatcttccctgttggaagtgagctcaaactccataaaagagttacctgtcttccatagccatggaaacaggaaatcttcccttcctttttggaagcaagtaaaagtttttttggaattttacttgctttttttttttttccagcaaaataaactttagatctctaccacatttggggacatcagggattctctggagggggtgctctcaggcctcagcaaattgtcctattggtttgagccataaagttagctcatgctggtaccaagcatagatttgtcaaaggtcaggggcatctccactcagaatcccttcatggttaccaaaatgtgaaccctgaaaatctgagacaggtctcagttaatttagaaagtttagtttgccaaggttgaggacatttggccatgacacaacctcaggaggccctgatgatatatgcccaaggtggtgagagcacagtttggttttatacattttagggagacaagagacatcaattaacatatgtaagatgaacattggttcggtttggaaaagcaggacaacttgaagcagggagggggcttccaggtcataggtagataagagataattggttgcattcttttgagtttctaattagcctttccaagggaggcaatcagatatgcatttatctcagtgtgagcagaggggtgactttgaatagaatgtgaggcaggtttaccctaagcagttcccagcttgactttcccttttagcttagcgatttggggggcccaagatattttcctttcacaccagtattgcacctgtagcttgcttggctcctcagatagggctgccagcttgaccaataaaaatacaggatgcccagttaaatgtgcatttcagatttaaaaaaactaatgtatttttagtataaatatgtccaaagtagttaatgggacacccttttagctggcaactctgctctaggagaacctctaagtaattccctgatggcccattttgatgttcttccatcttctgggtggattcaagtcagtgaagcctcagacatagttctgtcactggtaaacttccgccagcacttcaaggtgttggagttttctcttccaactattacagctttgggactctgtctctgggtttcctctcctagttttttaacttagcgggccatttcacagagtgccacttagccagccatttaaggaggccttaaagtttactgattaagagcatcatctctccttatagactacctggtttagaagcctgattccacgacttactagctaggtcataaccctcgacaggtttcttagcctttctggacctcggtcttctcatttctaaaatgaggatgaaaatattacctactttgtcaggttgctgagaggattaagtgatgccaaacacataaaacttaaaagaatgccatatggtggtatatggcaagcacctcaaaaaagtgaattatagttactatttctctgcaatgagcttcttgtgtagcttatayagagggacttttttacaggaactcagattgtttttgtatctaatatgctcatctaagtatagtgattgctttcccacagactagcctttctcttcttcattcaaagccttacaggtgattgacctgttctcttgacacattagtcctcccctcttagctctcctgcccatgaggaagcaggttctgccagctttattcccagatgcagctcaccaagcatttgcacgttganactgcatttctgtgttaacttatgctctgtattctcccatccacttctctgagttcagtaaattatagttggattctcttcgtagctatttatctgaagaaactgtcttttctagtttctaggttccagccaagaacagagacctacctgttctacccaccattattcagccatttttcttctcaacacaaccaagatcaacaaatcctataagccatgattctcatctttaaagcctatcaatttttcacaacctcctctaactggaaaactgttgtctccctgtcatctatgaccgcatggttctgccaattttccctttcatggcctggcatgccaaatagctgcagttggaatgttccatcagaattaattgaaaggttgttggctacttatcaatgagaaaggagtcataaaataatccttcataaattgaagcgtggaatatgctttttgcctcataacttggagaacatgaaataattctggatataatgaaattcagaaatatcagcatgattcacttatgttaaagtagatgtttttagttttaaaaaatttggtgtttctggtttgcgacagatttctttatttaaaaaaattctttaactcttaaaaccaacaaaaaatcaccagaaacaccaccaaaatagaaaaaacggaactatttatatcccacctctagccactccgtccccctcaaagttgtggtaagatggggaaaagatactgagcaacctgttttattacagtctggttctcatgctaaaacagggttgctagtgttaaataaaaatacaagacccttggttaaatttaaattacagatttatcaactaattttctgaataaatatgtcttaaatattatagaaatcatatttaaaaattcattatctgaaatccatatctaactgagcatcttgtattttatctcacatatatgctgtaaaatcttaaactataagatcttttctctttgaaatatgtaacctttggttgactattctaggggtcaaggatttyagagtgatgtaaattatagatatatatttactactacagtttttccttgtattggccccagttggatcttatccagcttggcttttataaaagaggtgtttctgaagacttctttattctgctgtctctgttctctaaaatgtgtcattttgtgacatggagtttatcttcaatttattaattttatttctaaaattacctattgatgattaggctttatcttcaatttattaattttatttctaaaattacctatttatgattaggcttttttttaatatttaagtattagctattgatagtttttgttttaactaattccattataatttaatatcattatgaaagaatacatttaagcctaataaagattaatttttatttttaccatttcttttttttttttttttttttttttgagacggagtcccgctgtttagcccaggccggattgcagtggcgcaatctcggctcactgcaagctccgcctcccaggttcacgccattctcctgcctcagcctcccgagtagctgggactacaggcgcccgccaccgcgcccggctaattttttgtatttttagtaaagacggggtttcaccgtgttagccaagatggtctcgatctcctgaccttgtgatccgcccgcctcggcctcccaaagtgctgggattatagacatgaaccaccgcacccagcctaaagattgctttttaagattaggaaagaaaaagaagtcagaagaagccaaattggtaccgtaaccaggtggatgcctaatgatttcccacagaaactctcacaaaattgcccttgtttgatgagagaaatgagcaagaggcatttttatggtgtgattctggtgaagctttcctgggcatttttctgctaaacctttggctaactttctcaaaacaatctcataataagtagatgttaccactctttgtccttgcaaaaattcagcaaacaaaatgccttaagcatctcgacaaactgttgccatgacctttgctcttgagcggtctggctttgctgtgactggaccacttccacctcttggtagccgttgctttaattgtgctttgtcttcaggatcatactggtaaggccatgtttaatcttctgttacartgcttcgaagaaatgcttcaagatcttgatcccactcgtttaaaatttccactgagagctctgctcttgtctgcagctgatctggatggttttggcagccatcaagtgcaaagtttgctcaactttaatttttcagtcagaattgtgtaaggtgaatcaattaagatgcctgtggtgtaggctattgttcgtgctgttagttgttagtcctcttcatttggggcataaacaagattaattttttctttgcaaatggatacggatggtctgccattgcaggcttcaacttgaacgttgtcttctctcttcttaaaatgagttatctatttgcaaactgctaatttctttggggtatacatgcacatgtaaaattttcaaaaagtacaaaattaaatagagtaaaaactgaattttctctccttctctgatccctagtcaccaagttcccactctagaagcaactaccattattatttagtttcttgtgggtccttctaggggtatcttttgcatttgtaaactagtacatatttataatattcccttccttagtagcagactgtatacattgtcctccactttgcttttttttctgaatggctcttgaacttagaaagcaaaagaaagataatattgaatatccctgacaagcaaagtgttgacccagaagctgctagtgagacttcaatttctctttccctcccatccattaataaacacagagatttctattttgtacctgggcatgagggagaaaaaggaagggaaattgggtggtggagtctgtggtttgtggggagctaaaaatgggaattgttctggcccgtagaccaggttggattgcccaagctcaggaaagtggcaatcagaaaaataatggcactatttttaggagagagttggaggattcgtgggaagtaggagatggccagaactcgttatctgacaaagaagagccatttcacgtcctggtgtccacatgtgacacacaattggagaggaggctatttcttctacctacccttggaacctagcaatgatgtgacattcctcaaactcctaggcagacaatgtgaaagattataagccagggtaggaaaagagggaaaagcagacaccaagcagttacagatcaggttgtgggcatgtgtgtagcatgcttctggggaagtccccaaaatacgttcgggacacttgaaaatgtgctaatttctagtcagcaaaacagttggggctcttgccatcatcatttgtgcataaagatagactgcaactttattttatattgtcaatctggtgaggcctgggaaaattgggttatatgtaaaaatggaaaatgctaaatatacaacatatgcaataccttgtaacaggatggtgaaatggaagttgaggttgcaaaacaacagatgcccattccaaattgaagttctgagaaaggatttacaaagaggctgagaaccagtagatcattcttaaatccctcacccttataaggaatactaaagcatagaaggggagtttgaaatataacttcttaggaagagttatttggaaagctgtactgagagtccatgccccttgcaggggcaacttctgagggatgccggcccctctccttaggccagaatttagctggaccacctctagagagtctgatatgtgttctccaaggttaagggacacagtgggctggtgtctgattctcccctgagaaatctcaaggatgaaagattggccatgtagctgtgacagacaagctgaaggagaagaggttgtgttaggcacactggcactcccagaattcagtggggctagaacagttgagtgtttcctatggatgtgatgtggaccatgaatgggaggcataaacgtagagtcattctaggtccaaaaggcctgcagagaaaagttggatgtattgctacgttgctaggggctaaggaaagcataagtaaccaggtagcatagagatacccaggtgcagagaacttcaggtgggtgtttccaagcaattggacggatcctcgcaataacccactgaggtatcccttagaatcagctttaagcaaaagccaagcccagatagtgctgctgctccgtgaccaaaggacctttgctctctttctttaactctcctttttcctccagctccatgtctggaagggtcaggaaccttggatgaaggcatgaggggagaggaggaatagaagcattgggtgaggccaggcatggtggctcacacctgtaatcccagcactttgggaggctgaggtgggtgggtcacctgaggtcaggagtttgagaccagcctggataacatggtgaaaccctgtctctactacaagtacaagaagtagctgagcatggtggtaggcacctgtaatcccagctacttgggaggctgagacaggagaatcgcttgaacccagtaggcacagaggttgcagtgagccaagatcacaccattgcactcaagcctatttctgatacacaaagcaaaaaaagcatgttataaacattataaatagaatgactcaattatttaaaaaatacatgcataagcacatgtgggtgatataagagcagtcttagattacctgttaagggagctgagctggaagcttcctgggctatgcctccaggctgtgggctttgaatataatacctttaaattttttttaggctcaaattattataggcatactatataggcgtgaccactgtcacccatgtgtctctgtgagaccaacaccaaatgcctttttagacaagagtgtgttgccagcattctcccagttctcctacaaacaaaggtgttacttattgaggtatgtgtcctttgccattcactacaaggaaatagaatgctattttgggaagagttgctaagtgttttgactacaaattcatcgtccctccacgtctcaaacaggacacctggaccactagctattttctccagtgaactccaccctgaatctgttgacttagcccagaaagcctgccagctgccttattactaggagctggttatgtgtgctgtacaaatactgttaaatttatttgacataaaactgataataaacataggtttgggtataaacantgttagtttgtgtaagtgaaaggacaagagactatsaactttatgaatatataaccaagtaatctacaactgcttaggggcttttatgaaaatctctaaatcttttgatcaagacctttacagagacactgtagcaaagtgttaagagcaaaggcaatggggccttctcacctgggtgcggatccaggctccaanagacagtctggggacactgggnaatttagtcaatccctttgtgctttaatttcttcaaatgtgaaatagaaataatatttttagtagccgtcttacaaaaaacaggttgttataaaaaaatgtttaatttaatgcctgttaaattcatggtagttagtacacagagcataatttatttgtatatatatgtctcaaataatctgcatatatccttgggactgggaccacaggagcagaaataagggatttccctcccagcaggaagttggatgcactggaaaattagattaaggctactgttaaccatcatgcaggcaaaaggcagggccagagctggcagcagggtcagtgggaggacaggaaataacaaattctgggaatttcagccttagctggagtgaagacactgccacgaagggaacatttgttaacagagctcactttttagtccagtgctaccaacgctgtagggatttcataccacattctgagaaagataagggcttgatccacctggggacatgttatcagtgatgagcatctgattttattattattataaaaaataatatatgttcacaattaaaacgttggaattcagaaaagtagaaggaagaatctcacctacacttgcatcacccaaaacattttagaatgttttgttctggtggttgctgtcctccctctccccatctccttcctccttccttttctctttctcctcttcctcctcttcttcctcttggtaagaaataatctgtgtaccacaaaatttacccttttaaactgcacacattaatcctttttaaaaaaatattcaaacgttgtgcaaccaccaccactatctcattccaaaacattttccgccactcccaaaaaaaccctgtaatgattgtcgtcctcattccccttttctccaagacactgtcaaccaccaatcttctttctgtctctatggattttcctattctgaacatttcatatattggaataatacaatatgtggccttttgtgtgtggcttctttcacttagcatcatgttttcaagattcatccatgtcatagcatatattagtacttcatttacttgacttttatggctgaataacattccttgtatggatataccacattttggctatgatgaatacttttcctatgaatatttatctaatttttatgtgggcatatgttttttgttctcttggttataaacctaggaatggaattgctgggctatatggtaactctatgtttaactttgaggaactgtaaaactgttttcaaaaggactgcatcattttacattctcattagcaatgtatgactctgtttctcctcatcctcaccaagacttgttattatctgtctttcttgttgacatcttttgaagcacaaaagttttaaattttgatgacatctaattttttttctttggaccttgtgcttctggtatctaaaaaagtatatggttagaataactaagtcttttattctaatatacttattagactaacatacacacacatagataatagtctaagagagagtctaagaaatatatctatttctctctctctgtcacccaggttggagtgcagtggcatgattacggctcactccagcctctgcctcccgggttcaagcaatcctcccagcttggcctcccaagtagctgggactacaggcacataccaccatgtctggctaatttttgtatctttttgtagagagaaggtcagactatgttgaccaggctggtctcaaactcctgggctcaagagatctccccacctcagcctcctaaaattctgggattatagatgtgagctaccacgtgtagccagtctaagaaatattttttaaattgcctaatccaaggtgatgaaaatttattcctattgttttaagagttttatagttccagctcttatatttaggtctttgrttcattttgcgttaatttttgtacattgtgtgatgtaggggcccaaattcattcttttgcatgtggatgaattgcagcaccattttctgacagactattctttcccctattgaattgttttggcatctttgttgaaaaatcaattgatcataaatataagggtttatttttggactctttattccattgatttatatgtctatccttctgccagttccacacattttgattactgtagctttgtagtaagtttttcaaattgggaattgtgaatccttcaattttattttctttttaaagatagtttagttactctaggccagcttgtcttgagtctttagggtcagcttgtcaattcccagggggtgaggtatggggggggaaagcagccagaattgtgattaaaattgtgttgactgtggattaatttagggagtattaccatcttatcaatactcagtcttgatccatgaacatggaatgtctattaatttattaagtcttctttaatttctttcaacaatattttgtagttctcagagtataagttttatactactttgattaaatttattcctaagtattttattctttttgatgctattgtaaatggaattgtttgtaaattttatttaaaaattaacggctagcgtatagaayattgctgattttcaaaataccttgtatcctttgaaggttttaatagtttcatttgtagatatcttagggtgtcctatatacaagattgtgtcatctgtgaatagagacagttatctttttcctttacaaactggataccttttatgtcattttcccgttcagttgcctccatgtagaaatggaggttttagccaaggaaactgcttgtctggttcctgcttttagggggaaaacagctgtcaggttttcttagatgcctttttttttttttttttgacggagtctggctctgttgcccaggcagaagtgcagtggcgcaatatctgctcactgcaacctccgcctcccaggttcaagagattctcctgcctcagcctcccaagtagctgggattacaggcacgtgccaccacacccagctgatttttgtatttttagtagagatggggtttcaccatattggccaggctggtttcaaactcctgacctcaagtgatctacccaccttggcctcccaaagtgctgggattacaggcatgagccactacgcctggcctattagttttctgagtgtgttttatgacaacaggatgttggatttttttcraatgccctttctgtgtcaattgagatgatgatgtggtttccttctttgttctgttaatgcagtgtgttacattgaatgattttcaaatgttgaatcagccttgcatctttcaaatattgaaccagtgtggcataaagtccacttgttttatggcccaaggtaaagtgttctctgtatgtctattaggtacagtcagtttatggtgttgttcaagtcttctattccctgttaatcttccatctaactgttcygttctctagttttcttgttagacttaatttttcaaacagttattttatgtaaaccatttttgcatcttgtgaatattatgatattagacataatgtcagattctatgcacatataattttatgttcacattaaatattaactaatatatttagccatttttctmttagaatttaagatcatcatagttttatttaaaattaaaactggtatttttgcgtttaagagcttctctgtatttggwgttgtttcataaggtagttgaattactggtaaaatagtatggcaattaaagcattcaccaccaaccttcatatacttcagcctgaaggtgggcttcacatggcccaatagcctcaatgtgaaagtaatggaagacatataggagtatatttctgcaatctagagatagggtggcacttcttcactctttggataacacttcaaaagtacagctcatagggcaacaaaaattttaaatatggacgaatatgattttattaacatgagatttctgcttaatgaaggagaccatggacaaaattgaaagacataatgacaatttgagagttttttgcaatgtttataatcaacaagggattaatatcaagcatagagtaggaagtaatgcaaattgacaagaaaaagacagaaaaataaaaagggaagaaagagtatgaactagcattttaccgaataaacccaaaggctattaaacatatgaagatacttactaagtagtaatcagaaaactgcaagtgaagcaagcaagtttcactttacatcatttagagtagtaaaaagctagaagctaagatgatgccaaacgtcagagacrtagaagtcctcatccatgtgatgggagtgtggctgttgcagccattctgaagagtaatctggcagtaactagccagatgagttttttgtttgttgttcttgtttctttttattttgttttgtttttagagccagggacttgctatgttgcccaggttggacttgaactcttgggctcaagtgatccttctatctcagcctctctagaagctgggagtacaggcatgtgccactgtacctggcttctgatgaggtttatgaacatactaggatccataaatcctgctcttgtttatacctcaaagaaattctgttgtgrcagaanctaggagtctacccctgggagagtgaatttgtaaaatgtggtagacatgaacygtggaatactcaactgcagttagatgtgggctagatgtacacatggcaacatcatgggtgtcaaaatcatagtgttgagtgaaaaacagtaagaaacagattggagacctaatgccatttatataaattaaaaatgcacacacacacaatataatacatattttgcacaaacatttagaatggcaccttggaggggaggaaaatgagaatgggaactagagataaagggaataaataaataagattaaaaagaaaagagctttgcatggatcagatacatgtcatgaactagaaagtatgactaacacaaccctttccacttgatgtcctaaacgaatgaatgaatgaatgaatgagttcatcatatgtgccttctttaatatgtatagcattaccatccattctttgrcactgacaaatttttgctcccactgactggtttatgagcgtgccttttctccccataccttaccagctcagaacattcttagtctttcagactgttctcatttgaggcaaaaattgcatctcattgtttttacttgcatttttctgtcaaatatgatgctaatatttcactaaatatagtttggcaaaatgtgtttgctaaattgttttggtgttagaagtttttcaytttacatttgtatctattcagattttccactgggattatttccattgctattaaatttaaaagtcctctcatatttgatattctattttatacattttcatggcttggtcgttttgtgtccttaatcaactagaatacttagagaactaattgccncagcaccatgttagatggtccacatatttatgataccttctttagaataaacagttaacataattaggatccactttttggctgacctaatgtcaataatcagtgatttgattattatagttttatggtatatttttgttccatttcgccttcattattcttccttaaaaaagattttagggactaccatttgtttgttttttctggataaaattataacccaaatgacctagattttatcagcttgtaaggtcaaattaataatactatattctcatgaatttatttataatagttggcagatgtcacattcttcgttgcatctatgcaatttatctttgtgcaaggagcatagcgatctttatggtaattgcttcagaacgatgattaagagttacaattgcttcttggccttttggctaagatcaagtgaagaattacagacttatttttttctgcatctcttgaaaaagaaaaattaagaaggggtagctatcagtgcaagagtttcctgagggtctcccataatacaattgtatttttctaacgagtttgctagtatataggtttgtttgtcctacaatgaacttttaaagttctatatattcctttaagtataaaataatgaccataataatactattatttattaaatgcctgctttgttccaagcatggtgctagacactttagtatctattatttcatctaacctccacgacaactctatgaagttatgtatcataattttatagatcagaaaactgaggctcaggatactgctaataagcagcagaaataggattcccacccacatgttcccaaagccagcattttttctagttcatgactctaattttcaacaatcatataaccttgaaataataatatgtaccttcattataccacttgcattttcaggaacatcgttcaataatgcattctttatgtattcctgattttattaagaaagccatttgtgtttcaccattaaataaggtgatagttatgactaagaaaaatatttttattacattttcttaagcaatgtttaaaaggtattaaaaattaagtgaacacccatgtacccagcacccagcttaagacataaaatattaacaacagaatatatatctttccttgattatatcacatatcctcccacccatgctctggaggtaatcacttttttgaatggggcttcaggatagctattctctattccctcagctttattgaggtataattaattagcagaattgtatacaaatgctcctcaacttacacatggtgtgaagtcctgataaactcatcataagttgaaagtactgtaagtcaaaatgtagttaatacacctagcctaccaagcatcgtagcttagcctaacatgctgtatgcatactcagaacatgtacattagcctgcagttgggcacaatcacctggcaacatggtccactgtagagtatctggtgtttacccttgtgattgcacatggctgactgngagctgcacccgctaccgctgcccagcatcttactgtgtatcactagcccagaaaagataaaaattcagagtatggtttctactgaatgtgtgtcatttttgcakatcagatgcccctccctgtgcattcccatagcgcctcgaagtcatctctatcaatcattcatttagtcktaaggaagtcttgtttgtatatgtgtatccctgacatgactgagacctcataagttctntaagtgccatatgaataaagaaatgaattggtgttcatcttaagtcatagnctctgcagatattgcttgatctaagggagtggcaccctttgttttgattttcctttgatctttggaagaccatgcattnctatttcagtgatgcttttaaaaagccatttttgtcattaatccagatttgttctcatttgattctarttgttgaaatggatgaaaacaacggacttttgmttttagaactgaatcctcctaacccttgggacttacagcccagatctcctgaagagttggcttttggagaagtacaggtaaggaaatattaaaaggataatattattaaaaacaaaaacgtgaccaagatgtccatttaacatctatatctgtaaacatcctatattaccttgaatactgtttgagatgggtatttaggacatatggtaaaaagtcatatgataaaacaaattctttaaggaacccccagaacttggcagggattacaaggaaaaaaacaatacaaaactttgggaaaaatccctaaggaaactcatgcaaaactatttgatgccagatcactactggatagaatggctggttgtattttctggctttagaagagaatttccttcagaggaaacactttaatagtttgggagaggtacacaatcaaaaatttatttttctgtgtatttaggaagtttatgtatatttgggcagctaattttaaggaaacaaatgagaacctgcccggaatagacataatnaaaactaatctatgccttgacctttcctcacccactttgttgccttttcacatgacgttcccgctatctcatctctgcttctcaatacattccttttccatggaggtgccaggctgtggcaagagaatgaggaattggatttggaatccccatggtgccagtctctaagtcactgtttgtgtccattcttagaggaccttggcatccagaaggagtaattatttaacaggtaatttagaagagaaagtcttgcaagcctgttcagccagttgtcagttgagtctgcgtggctatgccaacccaccaaactcacgagaatcatccattcatattgctcttcacagccactctggcatttaaatccccagatgtttgtgataacatctctaactgcctttccttgtaaagtatgctttaaaggactgatcacaaaatatattcttcagtgtggactgtaaataactgtttaggaactaatttaaataaactaaaactaggtaaacaaattgatttgtcatctaaaactaaccatgagaatttatatttgaataaagtcatgacctgtgctgggaaccgtgttctatgaaaggctctttttggaatgtatttgagtccaagattttgcctgatcatgcttagaagcaaagtactccagcctgtgtactatgtcagccacccaaaccaaacatttcagttcaytgttgctgaccagtaatgaacgattcagtaatagggatctcactctcttttaacagataacatatctcactcatgcctgcatggacctcaagttaggagacaagagaatggtgtttgacccttggttaatcggtcytgcttttgcccgtggatggtggttgctccatgagcctccatctgattggctggagaggctgtgccaggcagacctcrtttacatcagtcatctgmactcagaccacctgaggtaatgaagtcctgagcacacaactcctaagctcatgctgcaggaaaggcatcaaatgttctccgattcttttgcaatcactgctcactttgaagtaggttcagttgggatgatgaaaaaaggactaattaagataaatatttacatttgcatagaaagtttatacttttaaaactgtttctagaaagacaaatatggtatgttctaacttataagtgggagctaaataatgtgcacaaataggcgtagagagtagaatgacagacactggaggtttagaaaggtgagggggtagcaagtaggtgaatgatgataaattgtttaatggataaaaggtacatgattaggattaataatgctctgatttcaccactgtgcaatctttggttgtaacaaaattacacttgtaccccataaaattatacaaatagaaaagcatttctacactttacaccattgggagtgaggaaggagctattgtaaggaagataggggaggatgaataaccgtctcacttcccaccctaaggcagaacacattttctataaagggccagagtgtaaatattttaggctttgcaagccatacagtgagagttgcaaccactcaaccrtgctgttgtaacccaaaggcagccatagatggtcctgaataagactgactgtgttccaatcaaattttatttatggataatgacatgtgaatatcatataattttcatgtattacaaaatatcattgtccttttgattttctttacaaccatttaaaaaggtaaaaaccatctcctcagctgtgggcaagcttcaaaagaanaaagaagccactcttagcttgcaaggttgtacataaacaagtagcagcaggttggattcggcccacacatggtttgccaagccctgatttatagtatcctaacactaaacacccaacgtagtaatcctgactgaacctcacccaatgtttcattggaaccagagtaatatgatactaatgatagcaactgaaattttccctgacccagacaattaaaaaggagggagaaaggaggactttaagttaagaaaccacacgtatttgcaaaggtactgagctattagaagagggaagctcatattctcaattcctttgcttaactatagggtcatatttcttcatcattattttgaaatttgtatcacttctgctagattgccagtataaacacacagcaatgcccataatgtgctactcaagcaattcgactttgtttttctgtgaccctacatgacaaaatggttagggataacatgttggttgctggttgactggccccttgatattttattctaaagcatatgggaactctaaagtgtggatatgctctgatttatttttcagggaagtgtttgtttttgtttttgtttttgttttgtttttttgaattaactgatttagtaacaaattgcctgcaacatatttcttaactgatcacaaccccctaggatactgtggtactacaactaaaattctactttatatgatacctttgtcccacactacctcctggaactatacttgcataatttcaggattacaagagccctgagttcatttgttgtacaataacagtaaagtgtggtaataattttatatagcttgtgtagggacaacagcacataaatgatatgatcgctttatagtgtctaagatacaattacctaaagtcttaatgagagacattctatgggaacacactaaatttaagaagggtaagaactttcagggagggtaagaactcatttagttgagttattctgtaactactgtcctgaaaaccaatttagtttcatttcaggggcttgtgtggacagttgtcatgcattaaaacaacagttttcaactatagtatcacaacacattggttgtgcagtgtgttgcagatagtttattattgaaaaggggccaaagcctgtgatttttactccgttgggtctatttccttgatagacccttacttttcgactcttgcctaatcaactaataaacatcaagattgcttgtccccgacccttctgtctgacctttatttactgaataaagcctccctggtttacaaaaaacaagggaaaaggccagtgtactttggtggattgccagtaagaattattagcaattgaaaaatccaaagcaatgaacatccattttaaaataacttaccgtaactcccaaagtcctttaaaatgcaggatttcgttgctgaacccagagattgaaggtacattcaaagaatcattgattttttgaatcttttgttttttggggagaaaggttgttgctcccctcacttccttccagattctacttatttggatagcttttaacgcaatgctggaacttgaatattagtacagccaagtgttgatatgcagatttttaaaatacttttcctatgattatatatcttattttacctgatcttatactctgtgtacaagtctgattcttaaaccagataataygttcattaaagttagaaactttcttcttatagaagaagcactaggtttagaatcaaaaacccaaatttgaataccagttyactgtgtgttgtatatttctgaatgtttcctcatctacaaaaacaaaaaattcatagctttttgataagaattgactaacatagtatgtaaaactgccccagcaccaagtttgaaatataatagatgtgtaatcatttgtttgtttattnaactttctaccacaccctacagtggtataataactctgttatataatgaatgctcaataaataaaagccgacttaatatgtctagatagtcaaaaatacttggatgattgttgtgcactgagttgggattactacaaatgttggatgtagttcctcaacactaaattttactgtcttgcctagctggtaattctgtccctccttaaggatgaataatatagtctgttaaagtgtggctttaatatacaaaatatattatttatccttaaaaagggacagaatctttgaaggttgaaaaaccaacccccaaaatggtccgagacatgggcttttgtcctgtactatgtcccagtcctctctcttactgagagctactgcttgaagcatgcaaagaaatgaggatctccgtgatcttcatttctttcctctacagcatgactttttctcgtctgtgcctactgttagaactacccctccttcaagcagcatcactgtggaaaatggaacttycctacctggttgatgtccacaccatgagcatttgatatgttctaacaacaaagatgaatcccctcagaatctcccgtcactttcacagtcatccttgaacagaaacttttctctggactctggtgagagtccagtttttcaattcctcacttctctgtcaatatgttggtataaggaacaaactgtctgtcatactagatgacactatttttttctcttttcaacctttccatctgtcttatcctagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtcagaaatctgctttctttccatgctttccagttatgctttctgtgatgaatgttaggtgagatagtcaccgtaagattaaggaaraaatgggtcaatgtggtatgtccctgatactgcataawcacaacctctatttgtgattcaaatgttaggcagactgtcctgggcaaagatgattttctttctattaacccatactattatagtacaactctacagaacaggtaataaatctagttctgaataaggaaatttcttcaaatgtgaggttcaattgaccagtctttccagaacaggtgattaccttctcaaatactgaattaaaaaccaaactgaaattcacagttgttggttttgttgttaaattccaggtggacaaaaatcttcgattcatgatcttgatgganggtgttcatcctgagatggacacttgcattattgtggagtacaaaggtatgtttttatccccattgataangaaaaatggaaaacattcttaataggaaggatggtaatatctatatgaaatttcatcacatgttcatcttttagctccattttgaaagaatatagcgtgttatatccttgttctagaaatatggagctatctttcaaataatttttccagaaaacaaattagaaataatgtcatctagatagtgacaggagcaaagatttctttcataaggcaatagatattttacattccacctatagtgatttcttcaaaactacatttattaaataaatgtmttttattactttcacctagaaatatcatgtaatataatcatgcactgcttttcatatgaaaagatggccttactgccccaacaatcatttgaatatgagctttgcatgtaatttgcaaaaggtacagggaagtatgttaatccacttttttctgatcctttgggctcaacacctggaaaaagttgacagaagaaagcagtctatctatgagctagagtggaattaagataaaagtcttcatgagacacctagtatccaccaagtcaaatgggatgaatttagtcgcttgaaaattcagaaaatatactattgaaagctttaagttttaaaatcttactgtttgtttttcctttgatataatcaattcttctataatcaaataagttcaattatacagactgtatacagaagtccttgtcttggaattcaaacyatggrtgttcaagatttcaccttgaatatctatacctctttgtttctccacaggtcataaaatactcaatayagtagactgcaccagacccaatgggggaaggctgcctatgaaggttgctctaatgatgagtgattttgctggaggagcatcaggctttccaatgactttcagtggtggaaaatttacgggtaatattttgtatgaaagtgataccaagtatcacgcatggcacattgctraatgctgtaagagtaaatacaaatgtaattgagacatgatccctccccacaagaagcatgcaatcttattgggaaaccagatttgtaagttgcagattaccaactaaggtttctagctcaaaacatgatggagcatgaaggaaatgttgagatctgagagcacctcaggaggagccaagaaagagaatcatctggattcaccatgtagaccntagagcagaacaggaaaggcctgaagtgggtcatccaggcttaggtgctcttggaatatggttcctaatggggtgtgtgcagcctcaatgtagacacatccccttggcactgtggatgctcatatcagggagcagtgtgcccagaagagagtcctctagttggggacctctagtgcacccagaggagggtcctctggttgggggtcttaggcaggagcccttctgctctgggtccaagagtggggttggggttgacattggggaagtgtgtatcctcaacactagtattgtaagtgctcaatacatgtccacttaataaattaatgtatctgataagtgatccctgtctaacagtgtggcagaaaatgccctgctttgcaatatgaagataacctttgtcccgttctttgctttcttctctaagtctatattcattgcctcccngagtgtgtaaccacatgagaaatagagggaaggttctgtccttaagaagttaaaagtgtgactgggaaggtaaaacatacttattaagggttaactagcatcatgccattctgtgtgatggtgagtttgtgtgtgtgtgcacatgtgcgtgagtacacacatatacatttaaaaaggtcttgaatataccaaaatattatgtctaggtgatgggtagcttgtatattttttctgtatccttgtctgtgtttgtcaaattttatagaaacaataacagtaacagctctctgaccttctaccctgtatgttctgcgtcctgtctaattcctcaagttccttcactgcctgtcactctgatgcttgctatatatcagrccatcctgctttttgtttcttagacccaaagtgtcaagtgcacacctgccctgggtctttgtgtttgctgtttccatttcctggagtgcagctggccctgatttgcatgtgaccagcaacttttcatctatgtctcaactcaaatgtcacctcttcactgaccatcctgtctaatgattccctccayctcatcccactcaccccagccactctctgttccattgccctgttttattttcttcacggtgcatcattctttgcaatgactttatttacttgttcattatttgcttctctcactagaatgaacactccatgagagcagggacctgctttgccttgttcaccactttattcccagtggctagaaccacgtctgacacagagtaggtgcacaataaatattggttacgtgaatgaataagcaaatgaacagcactgtgagaagggcatcatgactccatttacagagaagatacagacatggagaagttaggtagtttgcccaaggctgcccaaccagtaagtggtgggtcaggattttcaacctaactgactccaacgtcatgctcttaatcactgtgtatttgtcagattatgttgaacacacctgttataatctacaaatataatgaagccattttcatgttagtaaagagttaatttcaagaattacaatgcccttaaaatgtgcatgcacaccaactacgattatgcatcctaccctgtgtattcagctagggtccgaatgaattgccatatacaaggagaaagctcagtgcctttggctggcttggtaacattttcctagtaaccaattgaaatttccaagataaaaactccrgggaaatcctccactaatgacatggagccttgttctatttctgccttagttacctatcaattttatctcctgaaagagttccaatctgcyagaayatgtgtttttctgtgatttttccagcagaggagactcyaatctaaatcctgtcatttcagaggaatggaaagcccaattcattaaaacagaaaggaagaagctcytgaactacaaggctnggctggtgaagaacctgcaaccccgaatttattgtccctttgctgggtattttgtggaatctcacccatcagacaagtatggctagacactttgtacatttttacatacaacttaacgtatggtggaatgagcgactttgctgtgaaagcagtgtgacatgagaaggaaagtgattagtaggtgtctggaactttttaacaagctgctggagaacccagagcatgaataaaagttacacttggcagccaggaactctttcagnagataaaataacagatagatattctccgaaaggatcccaggaaagaggatggcaactgccatttattatgtgaagtgaactggggacttttaactaagccatctaagttaatctcccaatagcactatgcgtaggaagggggtattgttccttttttgcagataaggaatctgaaactcagaaaggtcaagggacgtgcccaaagtcaccctgttggaaacatgagttgagaatggaaccctggtatgcttagttctaaagctcttttctctataccatactgcattccagaatagaattatgtctttcttctcatgttttaggtatctaatgtgatttttcttgcagcaatataacttctgcaaatactatgaatcatcaccaatgtatgaaattgttgaaagaaataaaagaccatgaatttgatcttgtcccctttgccaatgctcagttaagtcaagaaaacctacatgattaatttcaagattttcttgaaacaaaagaattgcttgccaaatatgcaggaatcgaagataaaatctggcagggtagtttgttttttaatctgatatcacagtgcctatggaaaaactcattttgaatctcatcctaagtctgactccagcgtcatgctcttaatcactgtgtattgtcagattatgttgaacacaccttgtatttgaacacaatgaaaggaaaagcttaattgtgacttagttacacgggaagaaatattttattaggttcctagagctgttgtaacaaaggaacataaactgggtcatgtaacaaaaatttgttacaacagccctagaaacctattacaatttttgttaacaaacgtttgttaagttctaggggtcagaagtttgaaataaggtgtgggctgagccatggtccgtttaaagccgctggggaaggattggttcccggccctctcccagcctctggttgcctcagacactccttggcttgtagatgaccatctttactctgtctcttcacatggcattttccctgtgtgcctatctgtgtccanattttcctttttttataaagacatcagtcagattgttttagagcccacctacatgacctcattttcacttgattacctccataaggaccctgtctccaaataaggtcacattctgaggtactaggacttaggactttaacatttcatttttgaggggaaaacaacccatcacacgtatttatattaaaatggaaacttttcatggcaccaattaataacagttttatacatttttaaaaaaccaatatgcagattttatttttaattgacagcattaaaattgactgcaaagttgagtaaaatttgaagaatgtttcattagtattgataatttatagttgagttttgatttatgtaatacccctttgaattcaatggtaatattaatgagttgacacaaaagttagtgaatttactaaacttggacaggcatagttttgaaactgttatgcttttgcttcaaagccaaatcagttcttctaaaaaaaaatatgaaccagttgtgtcaatgtggatttgagtgctacatgaaagtacatttttagtacttgcttctttttattgggaaactttttgggtatgtgtggaacaacttgagcatgagaagctactttttgaactattcattttataagatctatagatcaagtctttctgatgaaaatgtaggatctaaattgagatgtactctgtttaaaatatacattggattccaaagacttgataatgcagaaaagaatgcacaatatctcaataatttttaaaaattgatttcatattaacatatttggattgagttaagtaaaatctattaattttacctgttactgtgtacttttttaatgttgctactagaaaatttaaaattacacatgcttgaattgtatttctgttgaacagagtttaataatttttggcatcatagaccttttaatagagtaaaatcttagctgtatagaacttctgggaacttgggcattctaaatagtgaaatcatgctaggtagcaaaattttctggataggtatagtttatctctctagatgtgaaaattttatgatttaggtataattgtcttctcagaaagagtattagaacataattgatattttcttgatatcatggattcatcatttcaaagttttagaatgtaatgtaacagcttgatgttcctacagttcactggaggatgttataacaggatgtgttctagtccattgagctgtttgcccctgcactaaacggccccaggcagtaaagcattatatctgctcgttacagttttgctaagttagtgatcattcttcactgctgtaacaaatctttaccagcagtctcaatccttctctttgatttgctgcttctagccacctaagtaattaagtcaaaaattaacttactttcactttttgtacatatgcttatgagagaggccctgagcaactctcctggtgaaggactgctagaagcctcactcatagatgacactccaaggaaaaagaatcattttctcaaatcaaagcaatttcggttcgaataatacgaagagaatccttgttgcagtcttttctctcgctaacctctcaccactttgccccacaagcatatgcagtttccagaacatgcacagcagtacagggaaatcgaagccctggcttttcaaccagaagatgaaggggatacctgggaagcagaaaatcatggagagatttcagataggaggaggcttaggaaagtgagcccataaaattatggataaactcctgggttaactccaaagctgcactgtgtgtgtggacctgaccctaaaaaggatatcagagtacatatgctaaaaactacaaaacagatgaaagaaatcaaagactctaattagataaatggaacagcataccatattcatgaattggatgttcaatatagttcatattttaattatccccaaatttatagattcagtacaatgcccatcaaaatcccagcaggatattttgtagatctagataatgtctaaaatttataggaaaggcaaaggaattagactaatcaaaataattctgtaatagaagaataaaattagaggaacatattctctaattttaagattagctataaagctgcagtaatcaagatagtgtgatactggtgaaggaatagacacagacatcaatggaacagaatagagaatccagaaatagatccacacaaatatggccaattgatttttggcaaagatgcaatttgrggaaatgtgaatgaaaaaaaggcttttttttggggggtggggaaggattctcactgtgtcgcccagcctggagtgtggtggcgtgatctcggctcactgcagcctctgcctccacctcccgggttcaagtgattctcctgcctcagcctcctgagtagctgggactacaggcacacaccaccacgcccagctaattttttgcattttcagtagagatggggtttcaccatgctagtcaggatggtctcaatctcctgacctcacaatccacctrccttggcctcccaaagtgctgggattacaggcatgagctgcaagccactgtgcccggcccggaaaaaggcaatttaatggagaaagggtagtcttttcaacaaatgttactggagaaattgcacacccatacacacacacamaaaaaaacctacctcgatctgaaccaaaaaaaaaacctacctcgatctgaaccttatgtcacatgcaaaaagtaagtaaaaatggattatagatataaatgttaatataaaactataaaatttttaaaagaaaatataggggaaatattcctgaccatgggttagggaaagacttcttagatgttgcatcaaaagcatgatctattttaaaaattaatatattattctttatcaaaatttaaaatgattgctctataaataggaaactattaagaggatgaaaaggcaaactatagactctgagaacattttgcaaatagcatacctgacaaagaatttgtatccagaacatataatgaactctcaaaactcagcaataagactacgatttaaaaataattttaaaaatcaatagtaagaagatttaaaaattggcaaaatatttgaacagatacatcaccaaagaagatatatggatgtcaaataagcatatgcaaagatgctgaatagcattagccattaggaaaatgaaaattaacaccacaatggcataactattagaattaatggcactttggaaaattgacaataccaacttatgtcaaaaatacagaccaagaggagccctcacactttgctcttaaggatgccaaatggtgcagtccttctggaaaacgcttttgcagtgtctttgaagctaaccttactgtatgatccaacagttccactcctgagtatctgccctaattaaattaaaactttattcacacaaaaaatctatatgcaaatattaatagtagctctattcataatcaccaaatcaacccaaatagccttcaacaggtgaatggataaacaagctctggtatagtcatacaacagactactactcaagaataagaactgctgcatacaacagtgtggatgaatctcaaaggcactgtgttgagtgacagaagccagtctcaaaaggttacatactaaaagattctatgtatatgatattctggaaaaggcaaagttatagggatagagagtagatcagcgattgtgaggaggtaggggttaaagaaggattttactacaaaggtgcaatgcaaggaagttttgggggtgatgaactgtcctgtatcccgattgtggtggcagttacatgaatctatatttgtgttaagatctatagatctgtactccctcaaaaagtaaaaaaaaaaaaaaaaaaaaaaaaaaaggatctcagtaaatttgaaaaattaaagatcaaaaaaggcaaacatggtgattcttaaagagcaccttaagccttggtagttaaggcaagcatattgggttttttgtttgtttgtttgtggggtttttgtttttttgttttggttttggtagaaacagagtckagctctgtcaacccaggctggagcgcaatggctgaatctcagctcactgcatcctctgcctcccaggttcaagggattctcctgcctcagcctcctgaatatctgggactacaggcatgcaccaccatgcccagctaatttttttaaattttttgtatttttagtagagacagggtttcatcatgttggccagactggtctccaattcctgacctcaaatgatcctcccaccttgacctcccaaagtgttgggattacaggcgtgagccactgagcccagcaagcatatttgtttaaatcatatttgtgatacaatcaagttatattacatgcacattttatggacttcataatcccttgctaaagcaatacatataataaatctatccattttgtgttatatggagtacaattttattttaaatgctaaaggaaagtttatagatgtttaaactttgctaagatttccttgattgtatataaaatttatttgatcctgagcttatgcagtgactcatcccctagctataacgttttcatgagcaatcatctgcttcacaaaaacatttattttatcatacagttactgatattttgtgaacaaagggcagggactgtttatgtgcaggcaggaaatgcatgtgtcattttaccaagaaagtacacttacctgtatttgtctgaatttattggataataagtcggtcctcgaggcgagtttttgtgacagtaatcttgttaggactgcccatgacttctcatcaactggaagcagcagtacagtagaaggagcggtgtacatgggattgtggttttggttctaccaccatctatctgacttctctgcacttcatttgtctcattgttaaaaacctgtcatcattttgacatgctacgttctcttgcaacgtagctacatgtgtataattgcttaatgtggtctcttgctgatgtgtttctttttaaacttcttgttgacattatttagctctcttgtatcttccaaattttttcagaaaagattggtctaaggttaaaacataatttcttttgatcattgctctttgttacttgtaaattcatttgtcattcactgagcagcactgtgctaagtactggagaactagagataaaatgattgtctgttctcagagtgatggtctattagaagagaagaacaartggaatacagaatgatcaatgcaggcaaggggatacagacgcaggagaggagacgaacactggatgagtctatgaatgctgcattttaaagaaggagtaggaactgaccagcaaagataaaaagatgctgggatgagaaattgcagttcagaacaggagacaggggttgtatgagcactttaggacatgctacgtgatttggattttttcctggaaggatagggagcctgatagtcgggtgaggaacagggatgtaatcagatgtgaactggaggggttagtttgtatgcctgtgtgatggcaaagggaaaggaagaccagtttggaaactattgcaataacccaggaaggaataatgaatggcagtggggagtgagaatgcagattcaagaaatattaagtaggttgagttgcaaggatgtggagaagaattggaggtggtgggtacttgaccacttaatgtgatgctgtcatttaaagcaattaaaagctgtactgttgcatgtaagcagttggcaaatactttcacttcccacaataccccatctagatactgatcttatttttattttatagagagacaaagacacatcaagaagttacagaactttgtgaccaccacacattatgttttaggaagagtaatgaatagtaacatagttggaggcagggaaacctgttagtgaaccatgtagagactaaaggctggaagaagatgagacaaggtggtgactgtaacagtgggaggatattaatgtgtgtaaaaagagaaaagctactgacgrctttggtgcagtgacagcgttctcacctgtgtctacaaaattgattccaagatcataaatgtgtcaccttggtgctatagaaatacaaatgattatgtactttttacttatctcactaaaaatatctatcacgtctgtgtaaccaatttgtagctcaagaaagtaaaattccctttaacagaaatgtctgtctataaaacccatgttaggtgaatcacagtgacaaatctcgttctctggatctttctctttctgctccaacacaaccacaatcaccttcttgtatgacattgaaattgaagagttaaggcttttcaagaaagattgtggtatggaattagatttgggagacaccacgcttctatcaatgccacagttagaaattagatctcagccagacacagtggctcatgcctgtaatcccagcactttgggaggcagaggcgggcagatcacctgaggtcaggagttcaagaccagcctggccaacatggcgaaaccccatctctactaaaaatacaaaaattagctgggcatggtggtgggcacctgtaatcctgctacttgagaggctgaggcagggagaactgattgaacccgggaggtggaggttgcagtgagccaagttgtgccattgcactccagcctgggcaacagagcaagactctgtctcgaaagaaagaaattagatctcagagcccaggagtagtcaagaccagcctcagcaacaaagtgagaccccatctctacaaaatgtcaaaaaattagtctggcatagtggtgcatgcctgtagtcccaactacttgggaggctgaggcaggagaattgcttgagcccaggaggttgaaccttcagtgagccatgttcatgccactgtactctacctggatgaaagagtgagaccccgtttcaaaaagaaagaaagaaaaaaagaaattggatctcaagatgggttgcaactgaggatatgtgtgtgtaacaagtagattttttttttttttttttgagacacagttttgctcttgttgcccaggctggagtgcaatggcatgatctcggctcactgcaacctccgcctgctgagttcaagcgattctcctgcctcagccccccgagtagctgggattacaggcacccgccaccatgaccggctaatttttgtatttttagtagagacaggagaggggatttcaccacattggccaagctggtctcaaactcctgatctcaggtgatccgcccgcctcggcctcccaaagtgctgggattacaggcatgagccaccacacccagccaacaagtagatttttaatggttttgaatgtaaaagcttttcagattttactcccaaagttttgtggcaactgtgagggctgaggcttcactggctgcacagcctgtgtcagacagctgggtggagagctggggctgggctgactgctaatggtatggcctcaagcaagtcatgtgtcttctctaaggcttagtttctctctctctaaaatgagcatcataatagtgcctcatggggcattgtgaaggtaatcaattagttcatattaaacacttagtataatgcctgccaaataatagttaatccatatattaacattaaacacaggagtgtgcaattcccacctattttcagtagtcagtcttgctacatctaacttcaattccaatcaccatgcaattatrcttaaaaacaaagtataagtacaaccttctttgactgacacttcttctctaattagggacattagcccaaatatagtctttatttttccatggaataagtggaggaagattggaaagtgaaaatgtggagaaaataaaacaaaaatctgtactcatcagaccatgcacctgagaataaactttcttacatrggaatgcttttatttctcaggtacatcaaggaaacaaacaccaaaaatgacccaaatgaactcaacaatcttatcaagaaaaactctgatgtgataacatggacccctcgaccgggagccacccttgatctgggaagaatgctgaaggatcsaacagacaggtttggcttaaatatttttagaggataaaaatgttttataattttttttcaatactattagaaaataaatggctcacctctggcctcttgacaggttcctattttgtttgttatacagtaaaatccacacatcactttttattttatttttttgagatggagtctcactctgttgcctaggctggagtgcagtggagcgatcttggctcactgcaacctccacctcccaggttcaagcgattctcctgcctcagcctcctgacgaactgggattacaggcacatgccaccatgcccggctaatttttgtatttttagtagagacggggtttcaccatgttggttaggctggtcttgaactcctgacctcatgatctgcccacctccacctcccaaaggactgagattacaggcntgagccactgcgcctggcctacctcactttttaaaaatggaagtcttcccatttaaataaaatgaactatccaataagtatgtcacaaatctaggggaaaaaaagactgaattttttcctaatcttttcatcctatataacagtgactcaaatgttttcatcatctcagaaccttactagcgagtaaacagtgaagaatcttttattaaggtccattgatacagctcaaaaataaattattttatgaaagtaaaaagcaataagaaaattagttttcatatcagtgcaaatattacccaatttcccattccacagatagtacatttgaacaagtaacaataacacactggaaatgcaatccaagaaaagttaacatgatgccacaaagctatatttttgaatactactctaagccaaatgaaaccatcatgggctatttggaaatggactaacattttggagagtggtacatgcaattaccaaaagctcaccctctcccagccttacctctgcaaagtcagtatgaatgataaatcagctcattctgtcttttgctaacttcccatattaaacgagttatcaaatctggtcaattctccttcataaagcactcacaaatccatcactcytctccagcctcttctgccctggccttaattctgcctctcaaaatttctcacttagactcctgcagtgccccccaacttgtatctgtgcctcccccacaacttcccttgatccatctttcatgccagtgtcttcaatctgctggtcacaatccattggcaagtcacaaaattaatgccattgctcacagccaatgttttaaacatgaaatagaatagaataaaatggaataggatagaaaatacctgagtacattgcatgtaacaagggtattatttcatgaaacttrcgtttcataggtacccttggtagggggactccagggtcctaatgtaaaatgtagtctttactgggatgataggcaaaatgtttgaaagcccctgctcttcattgctgacaaagtaacctttctaaaatgcaaacattcttgtttaaaattctgtaggatatccttagtgcctccaggataaaagtgtttttaattttattttccaggtctaaaggtttttaattattccagttcttagcaaggtattcaagagccttcgtcattttacatttgcctaactctccaaaaatcttctctttcgattgccccagcagttttcaagctttaatgaacataggaataattgaagagactcacataaatccagatccctggactcccttcccccacagatcctgattcagtagatctgaggtagagcccaggaatctgcatttgtattcttgtgcctcaccaaagcattctgggtgactagaaagtcaacaccgttgggtcttagagctaagacgaagtatagaggacacacagagaccaagtgctctaactgccttgcaaggggaagaggaaaaaattgtgaccaaggaaagcttaatctggatctttggcatttagagatgaggaggatgtcacgagtaagtagagaggagaaagagattctagtcagaaacaatggcatgtgctggagaaggcaagtgtataatgggtttggtgaatgcggatactttgaatgagggcataaatatatgtgattcattcagaaatgatttattgaactccttctgtgtgcaagtcatcatcccagatacagaggatacagctgtgaagaggcttttgccctcatgaagccatctgtcttcctaagtagagggctngtgagtgaaagcagaggaaaagggtgagataggcggcagccaggctcggagaaaggccccagaagccagtgcagggaatttgtcctgtgagtgaggggagctgcagaaagttataaagcaaagaagggacattnctgagtttttatttagaaaaaccatttcagctttgcagagaatggactggggaacaggtagaaccactggagtaagggagagtggttgggagggtgtggctttctatagaaagagattagtgaagctctacactgaggcaaggcaaggagttgcagaagaagatttgagatacatttagaaggaagaagctttaggatttggtaaattttttttttttttttttttttttttttttacagaaaccagtacatctgtagctttgggcatataaaagtatagttttgagaagaaggtcagctactgccacgtctttatgagatgggcacctatttccctccttatattttctttatccagatcacatcctattccattcttgggatttaaaattccatgttttatgcaaggatacatcttcacatgggatggacagaattctaggattgtcagagaactctaccacattactggctgggtttaaggataaaaactggcatctgtctattggctgtgctttgattaggacagcaagagcaccatatattagagacacaaagttctgggaatttcttaaagataggctaaagtcatccatatatccaacaaatatttattgagcacctcctatgggttcagtcatggttgctactttcaccaaacttatattctaattggggtggggaggcacgaatgtgcaggcatccacaaaatcatggccagattataagcaacatttctgtaatttacttgtttgaacaaagaggcccaaattagtggttttcacacgtttttttctagacatagacttctttctttgaatgaaatctgacttagaaacctatcacactagacaataggagctgctctgatttaggcaatggtgggaccactgaggcacttttgtgggacgccttgtgaattatctgaggggtctcaaagctgctagtctggttgacttttgctacttaagtactaacttttgccttcattacttgttactttctttcactgttctcacacctttgtgtctttaagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcagggtatgctattgtttgtctttgctttcttgtataatggaaatacatgaacacccctttgttttccaataagcatttattaagtcctatcaactgcctaacagagaacagatttcacaattgatcagcaatctcttgttgaatatttagagaatgtactgaagtccctaagtttttcttttggaacatcttttatctgctatcaccacgtgttttttgttgtttgtgtttgtgagtgtttttggcatggcaggaacagctatttaaactgtggggctagaaggtaggatccacccaaagaggtaatcgccyggagcaaggtgaggtagaagcaggtaacccttrtctgcagctatgctgaggctgaattgcacaaattaagaattaggcctaggtctgcagcttaatctagccctnacacatacatacanagccacaagctaagaaagagttcatgttgtaacctagtcaccaaaactggacagatctccaaaagcaaactaaatactagcagacagagggtgcaagacaaagaggaggtctgaaatgggacaggagtaactgcaaagtcagtgagtaaccagctacctgtggcttatatgagatgcctgaagttgtacaggggagcaaagtttagggatgtcatcaggaaatggacaacactcacactcttaagacacaagtattcattaccctcagggtaagaagtactcccaagtttatctttcaattcctgaacattaatgccagataatacttgctattctcaaaagcaatgatccccagaaacctagctggggcccatggccagtctgtgacaaagtttttgctggcaaatagtgaaataagtaagagagyaggtatgtatatcaactctcttttcttgggatgaattgttattattccatgactaagtcctttctatttgggggtattaaaacattatttcttcaatgaaataaaagggtagcagaggcaaggtttttttcagtcctcacttagccaaataaatggttgatatctatattagttcccagataatttctagaaaattgtctttgaaatctaatgacctaggaagcattggtaaatggtattttcattaggacaattggtatgaaaaagagaaaaacttttgacagttttttataaaacattttcagtgaaaccatttctatttagctgctatatgacaatgagaaacakctcacatttatttcctcacctgcaaatttatggtgggatttgatgtctcattactaatagtacttcagatagyrataaccagctgtatacatttgatgttagtgacatgaagcrgttttgctaatatagactaggatttgaatgttgcagttcaggtgagagaagagactcttaatttcccattcattcctatcatctatcatytaagagcatttgagtcttacacattcttagaatttttaaagaccttgaccacttgattgatattcttctctttaccatgttgtcatttgcacagatgattgagacagatgaggacttcartccttttcctggaggatatgactatttggttgactttttagatttatccttcccaaaagaaagaccacaacgagaacatccctatgaggaagtaagcagcaacactggtggaagtctgcttttcttccttctttctttctttccttccttcctcccttccttcctttcctcctaaataaacttttaattttagaataactttagatttacagaaaagttacaaggatattaattataattaatacaatattaattataattaatataattataattaatacaatattaattataattaatataataattaatacaaagtattattaacaactcactttactatggtacatttgtcacaactaacaaaccaatattaaaacattgttattgatcaaagttcacacttatttctttatgagccattcccaaagattgacttctctgtctgctcacttccaaacacctgctcaacctaagctgttattagacctgtgagcattgatctctaccttcattttcctgtgcccctcccaytgggtgtctctggaaagggagttagatcaacatgaagcaacacatattttattgaattcaagttctgaacaaatccctcgccagtggcagcattatgtaaagatccatgacattggagacagtgtcaagatggggactgatgcccctttctgctgatcatgattcctgattaggaggctttgagcagttatttaagctgtctgagctttaggggtttttgtttttgtttgcttgcacagggcttgctccccscttgccagtttgtcgtgatagttaaatgacataatatatgtgagcatgcattgtaatttaaaattgtctatgaatgtaagaatcattagttatgaggatatacggtctgcccttaaacttantgtatgtgccatttaaatgtgtgatgtcctaaatgtagaggtttaaatataccttcacctaatagatgtaataaatgtgctcttgaactacattttaataaattgactagtacttgctattgaagaaatcctatatggaaacttcagtaaaagtaataatctgctacctgatttataggtaataataataaaaaaactggcactgggcanggtggctcacacctgtaatcccagcactttgggaggccaaggcaggtggatcccctgaggtcgggagtttgagaccagcctggccaacatggtgagaccccatctctactaaaaatacaaaaattagctgggcgttgttgtgggcacctgtagtcccagctacttgggaggctgaggcaggagaatcgcttgaacccaggagacggcagtttcagtgagccgagatcatgccattgcactccaacctgggcaacagagcaaaactcggtctcaaaaaacaaacaaaaaaactggatttttacaggtaagaaaatcctgtgtgaggcaccgtatagatgataaataggcttacatctttttagacaaaataaakctttacatttattgctttatatatcaaatacttaccaagcttgctttatgccaagcacagtgttaaacactttggaaatgttaagacatttaatccaacaacaaccctgtgaacagatactactatctgcccccattttgtgggggaagaaactgggnttataagagttagaataacttgcccatggttatacagctaatgaatggtgatgcggggctttaactcaagcagtctagctcaaagtctatgctcttagccactgtgtagcctttcaaatctgaatttacaaaacctataaattgaggtttcttagsctcaagagattcacctttgaaaatttttaaatamcttcatttaaaatatttaatttggaaaaaaaatcactttttcacagctttccataatgcatctgctggawaaagcaagcagcagctctgttgcatatttaaatacaccatggggcaaaatcatgatgcctgctctgcacatggtactgttagactgtggcttgagggcttttatctcccaggattttagggagngttctatatgctgaggtttggttnaagaggttatgcctatgtgtggaagagctccttttcttgctacccggagacttctcatattgcctccctcctgccacctttttggaggtattaattgcctttcaaactcatcatttctatcacactaactctccattcttaaatgcatggctcctgtagctctccatcctcctgctccnacctggaagggctcctctctagctctgctgcaaatctgctacctttcactgcctccagaccccacccatgcctttcccttccttgcttcacttctatgtgggactttctgcttaactgtctcctgcctcatggtgtgtaagtaagtttcagcatgtaattctgggtgactaatcattttccatagacaccggaaggcattgctcctttggcttccagttatagacaaggttgctctaaagaaaacttatgctagcttgatcctcctttctttgtgggtgacttttaagaattacaggattagtccatatttactgataaaaagacttttttcagctgatttggggctcttaygtataggtgtaggatctgtcatccagtaggctctacttacagagggctygcacactggtgcaaggcacatctcataaactggtgaagctggggcagactgcatcaagtagaatgcgggatgagaagggggcaggcctgctgagctccggctgatctgaaatttccagagaacttggaaatctggattttcatgtgaaatacccaaagttataaatgtagaaagctgagtcaatgttcttaaagagttatagactacatgaaatgagagctaggctgtatttggccaaaggatcatcagtatgctttaagctgtgaaggtgaggagagaagccagctaggggacccccgagtgcaaaaatgtggaggctcttgctttcagcatcacaaacacactacctgcccttgttctccccctaccccaaaattgattctatgtattgagagaactgtagaaatatatttgacctgggagccatatataggggtagagaaggggccagctatctcatggacataacttttgtgcttgccctcctgtcatccgcagtacctacttctcttccctccacatctgaacacccctccatgtactgtctgggattgtacagcctctgccctgcatcttcggtttccacttgtctgcatgctttctagattcacgtaattagttgaattctcctgtcaatgaatcacttccttttcttttcaatgtggcagtttattcctgtataattgctttgcaacattttagttggatctggaaatgcagaggagataggttatgcacgcaatttgtccntcattgtgaaccaatagtcttctccttagcccagtgacagtacctccttgttttcctgaatattcttttgcattcttttggagttcctctttccccagccactgcttaagtctcttgtttccttccaggactctgtgttcattccactgttcttcccaagtctcttcctgggtaaactcacctgctaacatcacttctctgttaatgactccaaaaataatccatatgtccagcccagagcgctctctggctacctccagtgctgtcaagctttgggttcttaatagtcaactgcctgctagatataattgtctgaatttctgaatgcttaatacataattttcaacttgttcaaagttcaattcctcatcttccttctttaaaatgttctttttcctttttctatctgatcgttggtaatatcattccccaagtcagtcaagctagaaacaaatgagtaatctttggttcttcccttttccttacatccccaaatctaatcagtcatctagacctttccattttacaccccaaatatttcttaaatctacttccaattctcctgtgtgcttctctcccagctaaaaggccaaaaaaggccatttaccctgcattgggaggaaccaggtcctggtactgcatcttagccaggccgaccttaacctgaccaaattgtagaatcatgtttctaaacctctattagcaaaactctgccctatgtttgtaacctcagttcacgatggatataattgttttatacaaatggtgcaaaaaagagaaatagatctaaaaatgccaaacttccaatcattctgtgtcattyaatagcctgtcacttatggaaagtttgcctctactgatattagcatgatatttaccgggagaaaatttgttgcagacactgaaagggctcctctaaactctaacattggtgccgatggattgttaaaactatgtgcaaccaaggataacttctctttattttctttatataagttatctcatttttttctctcaacagtctcataatagagaaacggaggcttagcaagcttaaggtcacataattagtaagtgcagggctgagactcaagaccatctctgcttgtctcctaatcctgtgctgctttggctcttcarcagtttaaaagttgggattctttaaggataaggatcttgaccacttgatttaaagtaatcctgttctatgacaggccagaaactatagwctgttgtgagcttccaggctctgctttgcctctgaatgttcaggtggagacttgaacactcggcttttagaatgacgataacagcaaagatttcttgagtgcttactatgtgccaggctttaagtattttatatacatcctcacaacaatcctatgaggcatgttctattattgtcttcattttatagatgagaaagccaaggcacagaacggtgaccaagatcacacagctagagtctggatttgaacccatgaatctgcagtttgtgctctcagtcagatgctccccctgctcttaatccatttcctgttttccttctttcgagtcctgctgcacttagcatctttccttttctcctcagcctgtgatatctgctcccagagactcttctccttggctctccgtgcctctgccatcatgggcagctgctcctcccagggacaggagggatccatactctgcttcctgggttgcccctgctagtggttccatgtctatttcagatcyatagccgggtggatgtcatcagacacgtggtgaagaatggtctactctgggatgagttgtatataggattccaaacacggctccagcgggatcctgacatataccatcacctgtaagtctggaagcacctggcgcccccaggccattgctgaggangctgtggatatgcataagcagtcagtgactgccgaagcccccagattctgactaatgtgtgagattccaccattagagcttcattcctttgttagtttgttaaaaagcaaatctggttaggaaggtataacattaaagagtcatttatacattcatgtgaatgtgttattgcacccttctggaagtgggttttggtataagaaagagaaatacattataagagggaaagggtatgtttgccaagacaagaatgagtatttgtgtggcaaagacatggtcattgaattagtgaattcctgcatcacatttttgtctgtgctcacntctgagcaagaatttggtgggctagttggtttaagggaatggcccactgantttctgtctgcctgcacttcaaaactgtttaagtctttaggatcatatctagaatatttgcactgaaattcagaaagggcaatttgccatttttatatttgcaaaataatcaccaaaggaaagagtactttttctcattaccacagatcctctgaaaaaaaatgcagaaatttaattttaaaattctaattatttaaaatgtataagcaaaagtttgtactctgagcttgcaagcagaggcatttattaaaatttcttttttacttatttccttttgaatgtttttaaatgwtatgaaaaagcttaagaatgtggagctatgtaaaataaaaaggaagtaaccccaccaagcacctctcaggaaaccctgtttcctgcccttccctccacccactcttatggtaagctttgataatagctcagtgtgtatcctcccaggcctgtttctggacatagcaacatttctctacatatatttgttttcaataagatgtcccacatagttggtagtgagggagtgttattgttgccrttgtttttatttttttttaattttggcaaagcacacaccacctttgggatgttgctattgtttttaaatgaaatcctagtacagatattctgcaacttgcattttttactcatcaatatattttagatagccttccacattgggacatccaggtcaacctcaaatcttttaacagctgtaagacattccaagtttttttcattttcaacggatcatatacgtaactcttgttctagaaagaaaggaatctggcaacttttgaggggatcttggggattttttttttcttaagaaaataattccatcttagaaatcgctaaactctatcttgttctattgtgttttggtaacaagggtcacaaatataagatgtcatcataaatattgggaagcagtcacagtccactttatcttgttgctctgaaaatgggatttgtgaatttactaaacattcttctggttataaaaataatacatatccactgtcaaaaatttgaaaaaatatttttaaatgaaaaaactacaaataatcccactacccagaaataataattgatattttggtgtctagctaatctttctttttttgcttccaagcacatataccatacatacttttctacctgtgtgtttatcaacgcgattttccacagtattgtattttcctacatcatttttaatgcctgcttacctgataccacatacctrtattagcactttatttaacctctttgacctgtaagtcatttctaacttttcactatttgaaacaatggcaaataatcatgtggatgtgtcttgcacacattcatagtgacttctgtaagttaaattcctaggagcggggctgctggattctatgaatacagcgtctaggcttttagtgccctctgccaaatcgttcttcgggaagccagttcacctttccaaaaataatgtatgagagaatacatttacctgtaccttcactaatactagattctgttgcttttgtgtacaagatatagatctagattttcacatataaggattccttaaagcaaggaacatcatagtacaataaaaataagacaaaatctcgttcaaggagctgtctgtattcaacaccctgaaagttctgagctacatcaacagctggaacagtacagaaacactatctctcagggaggacagagtaccaggtaccaaatagatcctggcaaaggaacaggyatggaagttnccagagcacattcccatgctttatctctcttacaggttttggaatcattttcaaataaaactccccctcacaccacccaactggaagtcattcctgatgtgctgtgagcagaatgggcctgngattttgcaagtaaggaatatcctgtnggtttgggagctgtcctaccgtgcatcccgtgacactctctttgacacctaaattaagcagacgcgttgcctgacagaaacccgacttttgcgggactgagaacagctaacattacaagaccattcaagtgttttaaaaagtaaataggctaggcgtggtggctcacgcctgtaatcccagcacttcaggaggccgaggctggtggatcacctgaggtcagaagtttgagacctgcctggccaacatggtgaaaccacgtctctactaaaaatacaaaaattagccaggcatggtggtgcttgcctataatcacagctactcaagaggctgaggcaggagaattgcttgaayaagggaggcagaggttgtagtgagccgagattatgccattgcactccagcctgggagacgagcaaaagtccrtctccccacccccaccatcagaaaaaaaagtaaatcagtagtgcatccagtccagagtccatagaacctttggcctggttgaggtaaacatacagccaataagtaaacaaaaccaaaatcgtccaggttgtgagtgtttaaaacataatcctgagtacacgagggaaagcagcaacaaaaactgaagagagacaaactaaaaaccgagggtgagatggaaagcagcagctcctcatttccaatagacctctctcctcttttggactaatgacgatgaacttgcctggcacaaatcagatttgacattcctttcctgcagcctgagatatgattttattaagtgaattataaaacctgtctcagctgggctcagtggctcatgcctgtaatcccagcacttgggaggctgaggtgggcaratcacttgaggtcaggagtttgagaccagcctggccaacatggtgaaaccccatctctactaaaaatacaaaaattagccaggtatggtggtgggtgcctgtagtccaaggtacttgggaagctgaggcatgagaatcgcttgagccagggagacggaggttgcagtgagccaagactgtgccactgcactccagcctgggccacagagggaaactcttgtctaaaaaaaaaaactgtctcctcatgcttctgattgaagggaccacataatatgactgcaaagacagtaaactccttgactcatgcatttatttattccwcaaacaggtatcccatcccattgtgttataataatctattaattgtttttcccagtagatactgagattcttaaaartaggaactgtcacctgggtagccctagtgcctagcacagtgctgagcacacgtatggttttattcctaatatgaattcaaggaaggaaggtacaagtgaatttctctttcccattgtcagcatgagtcncctcttaaaataggcttcaatgtctttagcagtaaaattaaggtttgaattagaatatcttttacatactttccagttgtaaagttacttgttccatattctaatctagcataaagcactgggctagaacttctaagttataattataagctagaagggatgctaaggaaatccacatgcaactttattacaaggtagactctcatgagcactgtatttgttgtacaaactgattgtcgggaatactgaggaaagaaggattgcatgtgaggttttgagatgaccaggaagaacgttgtagagagatagcatttgaggagtaaggggtaggggattggcttaaagattgggaaaagttttaaacaagctaaaacagagagagaggaagaatatcccagacagagagagtgggtgaggttaaaaggtggaaaaatacaaggtgaattcatgcaatggcaagtcttcctcatatggcaccgaagtaagggaaaccaggaaaggggcaggagtgggaactgggagaataaggagagttaagagggctcaatgcagatgctgagcaggtttagccattgtgaaaaagcaacaggaataaaagctaaggaggcagcagctagagcaayaagtccaaggtcttagagatagagcagttttgaaggaagacaaattaaaggtgtttctgtataagtgggtgaatgaagcagagcagagatgaaggcaatagaaattaagagatcactgtgtgcatttggacattgctgtctcaaggagacttggagtcngaccttttgagttaaaactccagctctgtcacctaccatatgaccttggacaaattattggatctctttgtgttccagatttccatctgtaaaatgaatgtaatagcacttacctcacagggttatgtcatagtataaggcatgtctagaaaagtgacatgccatggtaagtgaacaatagatgttgaccatatcagccccatgaaataaacaggaataccatgtggcccacagtcagttggtaaatccttaagacttgggaggagggtcatattccmgttcacattccagttttagattctcgcttatcttaaagcattatagaccttgaactaaataagaataaaaatttgccccagtgcagtaagaaaatgaaaaggcattgaaatgagattcatactgttgttcattaataatatcttcatttcacaggantgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggaycactacatagccagattcaaaaatattttacttsttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcantgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatgaatttttctcatactaagtctatctttattctcctgctatctttccagttctctccttctgatatcctgataccaccagttctttgacatcaccaggaccaccagttcactgacctgatatcagctcctatgtcctcacttccctttgcactcctctcgcatataccccacatttcctgctgtctccccatctccagtatctcatgtctcacttccattacttaaataaccatgaaatcatctttctacttggctctcacatccactctgtcaacaaattgtcacctccatcttcagaatatacccagggtctgaccaatctctaccacttccactgctaccaagatcagaagaggaaggaaactcaaaggtacgataatcttggcattagggactgattttcctccacagacacccgccaattccagaaaaggccaagaaactgaatgcctcaaaatttgctcaaagccatttactgggagatgtctcgtggtcgacacattcctagtatgaagtcatcctaaagagtgacagggaagctgctagctcttgtgtgctgccaccacacctggccccctaacttgttttttgaagcaaaaatattgacaccarcacgtgacaagaccatgtggggaaacaaaaatttcaggacaatttcagaaatgatcatagatgcaaaattccaaagtatcaacaaatccaacctagcaatttataaaaaggatgatttattacaattcagttggctttaatctcaatgcaaagttagtttcacatgtgaaaatcaaccacattaactgaataaaggagaaattttagtcccggcatggtggctcacgcctgtgatcccagcactttgggaggatgaggtgggaggatcacttgagtgcaggagtttgagaccagcaatttcagaccagcctgggcaacatagaaagactctacaaaaaaatttttttaaattagctgttcctcatggcatgcacctgtaatctcagctactcagaaggctgaggcaggaagatcatttgagcccaggaggtggaggcttcagtgagccacggtcgtgccactgcactcagcctgggcaacagtgagaccctgattataaatagaagaaattgtataggattatgtcaatttatgtacaaaaaagtttgataaatgctttaatagccattcgtaaacaagtgaataaagaaattcatagtaactaggaatagaaaagatttttctctgaaagaaacactacagcaaatattttagcagtgaaatgtttaaaccttcccagattggcagtatttcaaggagaccagccatcaacacttctttgcaatataatgaaaattctagtcagtgcaataaggcaagaaatatgaagtgtaattattagaagaaatagattagttgcagagaatattcttgtgaacacagaaaattcaaaacattctacagataagtagaaataatgtttagcaaggtttctgatataaggtcaatatacagaaaaaaactaatatttatcagtgatccacagaaaataaaattttaaagataccttttataacagcatcaaaatatcaaatacctaggaataaatctaataaagtatgtgcactatctctaaacaaaagctacaaaacaatattcagataaaacctaaatatcaaagacgtaatagagggacatgtcatgctaatgaactggaagactcaattttttttttttttttttttttgagacagagtcttgctctgccacccaggctggaatacagtggcccgatctcagctctctgcaacttccacctccaggcttcaagcaattctcctgcctcagcctcctgagtagctgggattacaggtgcctgccaccacacccagataatttttgtatatttaatagagatggggtttcaccatgttggcaaagctggtctcgaactcttgacctcaggtgatccgcccatcttggcctcccaaagtgctgggattacaggtgtgggccatcatgccctgccaagactcaatattttttaaagtcaaatttacccaacaacttttaagcctttcaacaggtatttgttttatggaaattaagaggcagtttctaaaatttacatagcaatagaaaatttcaggagtaaccaaggcactctttaaagaagatgaggaataaggaggataggaagaacgagagaaggaggtggagagggaggagtagaagaagatggtatgtgttctacaggataacaaacttatagtaatttgacagtagggtagtggctcaagggagacaaatagatcaatataacataatggaaagcacaaaaactcaggcaaacatggagacttactttcagacgaagatggtactgcagatcagtggagaaggtgcagtcttttaaataaatgtgctagttgaattggatatcatatgctgggagccttgacccctatgttataacagaaacaaggaatcagtgtgaggtgaattatagatctaaatgtgaaaagcaaaacaataaaacttctacatgatgatatatggaaatatctttgtgaccttgctgacaagatttcttaaacagaacacaaacaagcactaaccatcaagagaaaaaaaatgaacaattagactacagtaaatataaactctattcatggctcacagctgtttacccaagagaaatggaaatatgttcacaaaaaacttaatgtttgcagcagcttgattcagaattactcctaaactggaaacaattcaaatacctgtcaactggcacatggctaaacaaaaggtagtgcatctatacaatgacatactatttcataattaaaaggaataaactgttgacacatgcaacatgaatgaatcttgaatgcgttacagcacatgaaagaagccagactcaaaatacaaatatatagatggagaacaaatcaatggttgccagagtgtagtgggagggagaggcagttactatgaaggagcagcatgagtaaaattttgcaggggatggaaccgttctgtatcttgatggtggtggaggatacacaactctatgcatttgacaaaactcatagcactgtacatctaaaagcgtaaattttatgatatgtaaatctcaaaataacctattaagctcttaataacctattcataagctactattaacctattcactaagaatgatattaagggaataaaaaggtaagccacagagtggctcttacaaatttaaaagaccaataatatagtaatagaaaattttgaaccactcacaaaagaagctttgaaaagatgctcaaattaattactcactggggaaaggcaaattaaaattccgctgagacaccactacccatctaccagaatggctaacatgaaaaaggcaacttcaagtgtcactgaggatgtggagccataggaagtctcatactctgctggtgggagtataaattagtacaatccctttggttaatcattaggcacccctaaagtgaacatacgtgtaatctatgactccataatccccttcgtcagtatatacccaacaaaaatgtacacatgtattcacaaaaacacatgttatctgtaagaatgttcatagcatccctttttctaataggaacctggaagcacccccaaatacccgtcaggagaagattaaattgtggtatattcataccatggaattctccactgaagcaattcttttttttttttttttttttgagatggagtctcactctgttgcccaggctggagtgcagtggcctaatctcggctcactgcaagctccgcctcctgggctcaagtgattctcctgcctcagcctcctgagtagctgggattataagcacccgccaccatgcccggcttttgtatttttagtagacacagggtttcaccatgttggtcaggctggtctcaaactcctgaccttgtgatccacccaccttggcccctcaaagtgctgggattacaggtgtgagccaccgcacccagcctgaagcaattctttaaagtgatgatcacagacccatggaggtcccaagacccttttgcaaagtccttgaggtcagaactattttcaaaataatactaaatttttttgccatttcctccacttgttgacccttacattgtagtgtgtataagtactgacaccttattctggacggaggtagaggcatcaaaccatgctgtcattgtattaggtgcttacagttaaaaaaaaaaaaagtttgttttatttaacatccatgatgttgcaagaaaaagcactgatttttccgggcgtggtggctcacacctgtaatcccagcactttgggaggctgaggcgggtggatcaggaggtcaggagatcgaggccatcctggctaacatggtgaaaccccgtctctactaaaaatacaaaacattagctgggcatggtggtgggtgcctgtagtcccagctactcaggaggctgaggcaggagaatggcctgaaccctggaggcagagcttgcagtgagccgagaccgcgccactgcactccagcctgggggacagagcgagactatgtctaaaaaaaaaaaaaaaaaaaaaaagagaaagcactgattttattaagtgtataaatttagtaagaatcttgagtacatgttttataggaagagtgagcacagcacttctgctccatactcaagtgtgacggctgtcccgagggaaggagcctacgttattgagccatgaactacactggccatcttttttcatggaacacagttttgctttgaaagaaaaactgacacaaaaaaactaacgaagcatggtggtgcaggcctgtaatcctagctactcgggaggctgagatgagaggatcacttgaacccaggagttaagagaaaattaaggaaatacaaatggccaatgaataaatgaaaagaagcttaatttactaatatgatgcactgagataaatgtacaagagagggcactggcaaaattatgtatcattttagagcttagaagaaataagcatctatcaattaggaaataaatatattacagtaaatcacattatattaatatgtagtggttaaaaacaatgaggtagctctatgtttattgatccagaaagacgtacaatgcacatttaaaaagaactaagttataaaaatatcacttatgtttaaatagcactttacaggcacaacttgttttattatgctttattgtacttcacagatattacattttgtgtgtgtgtgtgaattgaaggtttgtggcaactgtgcactgaacaagtttatcaagccattttcccagcaccaggggctcacttcatgtctctgtgttacattttgataattctcatatttcaaatgttttcattattattatatctgctattgtgatctgtgatcagtgatctttcatgttactattctaattgttttggggcaccacaaacccatataagacagaaaacttaataaatattgtgtgggttctgacttctccacccacatgctattcctccatcttcctctcttccctctggcctctttattcccttagatgtgacactactgaaattaggccaattaagatccctacaatggcctgtaagtattgaagtgaaaggaagagaaggtcacatgtctctcactttaaatccacagctagaaatgattaagtttagtgagagaggcatgttgaaagccaagataggccaaaagttaggcctcttgcaccaaagagttaggcaagttatgaatgcaaaagaaaagttctttaaggaaattaaaagtgctactccagtgaacacacaaataagaaaacagccttactgatgatacggagaaagttttagtggtctggatagaagatcaacccagccacaacattcccttaagccaaagcctaatccagagcaaagtcctaactttattaaatctatgaagtttgagagaggtgagaaagttgtagaagacaagtttgaagctagcag

SEQ ID NO: 10731 - DNA, 104438 bp, Homo sapiens
  misc_feature (1)...(104438): n = A,T,C or G, or insertion/deletion polymorphism (see Tables 1-2)
ataagaaaaggatacatgggaattagcaaggggttcttgaaatatctatgcttaagtatatttcataactaatgctcagttttagacccttaacatttcagatgttaataacttctgctagattacctttttcctttggaaaaaaaaagttaatgaaagaataattaaaaaatggttcattccatttctgctcactttgtggtaaaggagaaaggtacagaatgataaagaagaggaaaaaaaatctacatgttgtataagctgttggttcatcaattcttaaattgttgattgttgtagattagtaaggaacagaagttcctaagcctgctctttacgggaacttcaggtacctcattgtcttgccttcaaagttaatctaacttcagattaataacttctggtggcatggttttgaaacaatgctcctagaatgtaatacagttcacctggtgatcttgttaaaatgtagattctgattgtgttggcttgggatgggcagagctgctttattctaacaagctcccgggggctgcagctggtgcttgctggtcagagtagcagcaagaggccaaaagtcactgtttgtttaaactgggtagttcatgcttgtctgatggtggtggggtgatatgtatgtgagggttgtttgcatgttaactggtttgcatgcttttgaaaaggaatgccttaataagttagggtctgataaacttgagcattctctacaaatgcttttaaaaaataaagaagcttagtattagcaaactaaggtttgcaaaggttatagttttacagactgcaaccttaataagtccagtttcgtaatgtaactgatgaattatgttaataaataaaactaaaccaattgatttcttttttttcttttttctttttttttgagatggagtctcgctctgtcgcccaggctggagtgcagtggcatgatctccgctcactgaaagctccgcctcccaggttcatgccattctcctgcctcagcctcccgagtagctgggattacaggcgcccaccaccgcgcccggctaattttttttttttgtatttttagtagagacggtggtttcaccatgttagccaggatggtcttgatctcctgacctcgtgatccgcctgccttggcctcccaaagtgctgagattacaggcatgagccaccgtgcccgcccctgatttcttgtatgagatagattcaacagcatgtgtttagaatttacgtgtaggtttttttttttttttttgagacagagtctggctcagttgcccaggctgcagtaccgtagcatgatctcggctcactgcaacctctgcctcccaagttcaagcgattcttctgtctcagcctcccaagtagctgggattacaggcatgtgccaccacactcggctaattttttaatttttttagtagagacggggttttgccatgttggccaggctggtctcaaactcctgacctcgggtgatccgcacatcttggcctcccaaactgctggattactggtgtgagccactgtgcctggcttgagtgtagcatttttaaggtgaattatcagtgttaagtgctaatgattaatagattataaaatagtaaactttagtataactcaataaaatggtaaagtgtagcataatatgtagacagagattgttttacagttttgtatactgacatactaaatgccaagactagaaaccaacacataaatatctcaataaatatttgtgttttaatgaattaatctcagttaattcattaactgtcttaaatgttaggatgggattgccttcctaaatttggttattatttcatccaataaaactgagtttccattcaagattgaatttaaaatatgccttaaactataatgtaatgtacataaacacatatataccaaagtctagtatacattgatacatgtagtcaggaagaggaaatatatggcatgttggaatcaagtgatatatgtagttaatcaaaatttgctcatattagttaatttagtcttaaatattactttattcccaatagagagagaacacagtaagttaatgagaatayaatgatttacatccttaaatatctttccrttgtgtggcccttctttccctaaaatacaagcaaacaggcaataaataaataaataaataataaataaacccaatagcttcattttctttatttttttctttagagatggggtctcactctgttacctaggctggactgcagtggtgagatcatagctcgctgcagccttagactcctgggctcaagtgatcctcctgcctcagcctccctagtagctgggactacaggtgcacaccactaagctcaactaattttttcatttctttgtagagaaggggtctcgttatgttgcccaggctggtttcaatctcctggcctcaagtgatcctcctgccttggcttcccaaagtgctgagattatgggtgtgagccacatgcctgaccaggaatacactttaaaataataaagtatggtagcaacaggaaatggcaaggagtgcctgttaaaaaaaaaaaaaaggtatagtaaatacataaaccagaaacagccacttatcattatgaagtattctgtactgtacataattgtacatactccacttttacacaaatggcaacacagtaggtttgtttataccagcatcaccacaaacacgtgagtaatgtgttgcaataagaccttaggacaaagacagtatcaccaggcaatacgaatttttcagctctttatgggaccaccattgtatattgggcccattgttgattgaaacattgttatgctgtgcatgagtgtgataatttgttttaatagacatcacagcagatacctcattttgttttggtaaggtggaataactacataaaatttcgtaacttcttgtacttgtcatctttaaacattcttttggccagaattgtattagtaccttctgaagaatgtatgatggctctttttcaatctaggttgggtttagactaaattgtatttcacttttaattagtggatactccttatctattagagatgggtcagcagcctatttgctaatttataattggcagctggttacatatatatatatacatatatatatatatttgttgttttaattttttaatttttttgatatggagtctcactctgtggcccaggctggagtgcagtggcatgatctcagttcactgcaacctccacctccatggttcaagcgattctcctgcctcagcttcccgagtggctgggactacaggtgagcaccaccacgcccagctaatttttttttttttttttttaagtggagacaggtttcaccatgttggccaggctggtctcgaactcctgacctccagtgatccacccgccttggcctcccagagtgctgggattacaggtgtgagccactgtgctcggccactttctactatattatatggggaacaaaataaagaagtttcttggcagaggaggactattgtagcaacaagcttttcatgaattgcagtgtctcccaatatgccatttatttggctgaaaaaactaggtccaggttgaatgcagatttcctcctgtctctttattccttctctgctctcaagcctggcacggcttccaatgactcaatcacatgaatgtgagattaatgcattatagttccctcaaatactattttacttccaagaaataaaataattgtggaaatgggtaaaaagttgagagcatgggtaaaaggaatgtggattttcccatatctcctcaagttctaccaatcttctatttctgaagcattgtctacatttggcccaattctttcgcgtctctcttcctttcaaaggttggctgtgaagggtgtccagcacatcaaagaatagcctccaagaaaggggtgagctttgattccagtcagtcctctgttctgtggtggaaactctgggtctcatagagtgaagagggcagatgggatgtggctatggtttaatctcctctacgtataacccaattaaagattcaggtacagatcttccctatgagttagcttatcgtgaattactttacttggctgtcaaatatctagctatggatttgtggaagaataggatttctgcataggaggaagatagcacctgagggaaacaactgtctttaagaaagatgaagtgcttcaggaggaagagggggcatacctggagaatttagtgggaagttagtggtgggaggaggcatgaagctaggatgagacagcggaaaatagattaattttgtttatcatatttggcaacttgtcttgatcttgatggttatggtcagaggtgccactgaaagccattgatgtgtacacctatgcttggtatagcatagtttctttaggcgctgaaaggtacaagttcaaaggtactagaagactggctttacaatttcacttgtatgatttaaacaatgaacctgaattgtgcagtttgattgtggagatagtataaatgtcttggaactaattatttatatctgattgatggttgatattggatgctttctatctaagcagttactatgaactagatatacattaatcctttcaccagaccactaccctgtgaggtcaatattcgctctatttgctgatgaaaaaaacgaagcttagaaacaggatcagtgggctgggcgcggtggctcacgcctgtaatcccagcactttgggaggccgtgggcagatcacctgagattgagagttcgagaccagcctgaccaacatggagaaaccccatctctagtaaaaatacaaaattagccggccgtcgtggcacatgcctgtaatcccagctactcgggaggctgaggcaggagaatcgcttgaacccaggaggtggaggttgctgagattgcgccattgcactccagcctgggcaaaacaagaggaaaaaacttcgtctcaaaaaaaaaaaaaaaagaaagaaacaggatcagtaacttccccaaggctacacagctagtaagtgggagatttatagtaaataggctgggcgtggcggctcacacgggtaatcccagcactttgggaggccaaggcgggtggatcacttgaggtcaggagttcaaggccagcctggccaacatggcgaaaccccatctctactaaaaatacacaaatcagctgggcgtggtggtgcacgcctgtagtcccagctacttaggaagccgaggcaggagaatagcttgaacctgggaggcaaagggtgcagtgagccaagatcgcgccactgcactccagcctgggcgacagggcaagactctgtctctcagaaaaaaagaaagaaagaaagaaagaaaaaaaaagatttatagtaagtctaagatttttcacaacatatttttcctccctaatcatttggctatttgtctttagctcttacagaaaagttgggttatagtcctggctttgattacccatctcagtgtcattgattgtgccacctaaatttctctggacatcttgtctggttggttgaatgagagggttggactatgtgatcaccaggacctttctaatcgtcaactcctagaatatacattttgtggattcagtctttgagtctagctcacttactcagtttcctaaatatttggagcaaatatagtatacttttattgttaaggatatatcacttacccctaatgttagctgactgcatgggttataattgtaatcattcatcgcatttttcgtctattagcaaatatacatgctctccatagatgatcacgtctgctcctcacaacagctttataaggtggattttaaagctcccattttatggaggaggaagctaaggctcagacggttttgattcatccaaggtcaaataggttgggtggcagaaccagaattccagccccgtgtgtctgcaacaaaacctttatatgtttaaagaaacattaatgaagccgtatatattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggrgcgacaacagcatcaggtatgggaccccgaygccgcggtggcctggcgggtggggaaactcggctggaggggacgggcggttcgaggccccggcgccccacgtggagcagacaggagggyctgaggaaaggcccgagtgaggctccgggggagctcaggccgttgggggtggcgacgggaagtgggctgagacaggcccagccttgcggcgcacacgtgtggtttgggccgcctttcccccaactctctgggtcaggggctttcccaggcaggctctgggcgggaaaagaaattgtaggcccatgatgcgcgcgtttctttattttttggcggggatttggaatttgagggtattactcatgttctctcgagggagaaaggaaaagatgtggttgatggcccttatacttgctgttttctggtgtcccttctttagtgtgtttgaggagggggggctgccccttggaatcttaactctggggcagacggggagttgtggggggcgctgttacatggaaagtggaataacttagtctcagcctatgagttaattctcggtttcccctgcctgtggccctcctcgtcttgagagcattggcttagattttattaaccaggttatagttaaccgtggcactggggcattttgaaagtccctctccacccttacgtcttttctctgctgcgcgactcccctccccccccccaacaccgccacccccgcctttattttggaggctggaattggccattctccacagttgaccgggactccagctctgatctcatacacaaaatattttaatattatgaggcgtattctagaagtatagttacttttgacactccaggaatgttggtggtcttatagtttagccactgtatgaactcctggatgtttaaaattataaaaaaggattatcctaattgtaaatgagatagttgattctgagaaaattccatttttaaaatattgattgttagaagtattgaataggaaaatgttaacttattttaataaagccacttatcagtgatactgaggtgggaagtgtgtgtcttaaatttgttgaaaaacaaaagtgtagcaaaaggatctgataacttgttgcctactgttaaaggtagacttcctagattactttattctggatgctaataaagattacacactttcacatggttgatgttgttaaattgtgtcattatcaacagatttttaaaagtaaagatttgggtcgggcgcgttggctcacgcctgtaatcccagcactttgggaggccgaggcgggtggatcaccgaggtcaggagatccagaccatccagagacggtgaaaccccgtccctactaacaaatacaaaaaattagccgggcgtggtggcaggcgcctgtagtcccagctacttgggaggctgaggcaggagaatggcttgaacccgggaggcggagcttgccgtgagcagagatcttgcccctgcactccagcctgggcgacagagcgagactcttgtctcgaagaaaaaaaaaaaaagtaaagatttgaggaatttttttttttttgtcttctagttttcttaaatgttttttattttgagggaaatgtttgagtagtaaaaattgtggttcaggtattttcagtcgttctctactgatggttaggtttggcactgttactactcccaccagttttcccccagatatgtacataaagtgcttagttttcaaatttgtgaagaaaaggggtatttgcgagcagatttaagattagaattcaggtcacaagcctggccatttaacctaatccgtctgtagaatggaagttacacatgcatgctttcttttctcctatgaatgcctttgagtgcttagattttyttgtatgacatgtagaaaaatgacttgttttaaatataggtcattggatggtctgaatagaggttagaagggaattaatattttccagatgtctgaagttatcacagcttttttttttttttttgagacggagtctcgctctgtcacccaggctggagtgcagtggcgcgatcttggctcactgcaagctccgcctcccgggttaatgccattctcctgcctcagcctccagagtagctgggactacaggcgcccgccaccacgcccagctaattttttgtatttttagtagagacggggtttcaccatgttagccaggacgatctcgatctcctgacctcgtgatctccccgcttcggcctcccgaagtgctgggattacaggcgtgagccaccgcgcccggcccctgatcacagcttaaatgtacttagataaaataaaaatctaattttggggagatgatgtcttaacagcataacacctatgatccaaggtgtcttagagttgatacgacttcaggctgtgtagttttgttttaaatcttgataatttatcattgccccttatctaaaatacttttgcttcttgtcctatttaattaaaaaagaaaacatattttagcttttgaattgggaagtaaaggtatttaggggtttcttgatcaacactgtaggtgctatttaatattggcagaaactaccactacccaaggaaagtattcaggtatattcaaaagaatactctccttttttttttttttaatcttaaaaataaggactttctttagtccttattgaggctttggtggacatagggtctacccacttgctgtttattatcctaggctgtcaactggatgttttgcagaagctgctgagtcatcatgaagcaagcttcatgacatggcatgttttatactaatgttatttgattaagtgtccaagggtttctgggcaaaaattaagcttttggtagtatagcagaaagttggagtaagaaacartgagaggtctggcgctgttagttaatggatgtttgccagtgcctgtcagggcaacttggctagtacagtcacccagtacctatgacttctgcatgtgttcatttgacttgtaatttcctgttttgacttctgggtttagctctcctgggaaatgctgtaagtttactactttccttctttaacttattttttttttaatttttttttttttttttgagatggagtctcgttctgtggcccaggctggagtgcagtggctcgatcttggctcactgcaacctttgcctcctgggttcattccattctcttgcctcagcctcccaagtagttgggattacaggcatgcgccaccacgcccggctaatttttgtatttttagagacgggatttcgccatgttggtcaggctggtctcaaactcctgacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataagggtaataactcttaagaattgtagaagcaaatatgaagaacagccctgaataatgcaagctgatcattcttacttgccttctcccctacccctttacctttttgcctagatgcatttaggaaatggtgtcatttttcttttctcctttctttttttgagacggagttttgcatctgttgcccaggctggagtgcaatggtgcaatctcggctcagtgcaacctctgcctcctgggttcaagctattctcctgcctcagcctcccgagtagctggcattacaggcatgcgccaccacaaacggctgattttttttgttttgtttttgagacagagtctcgctctgtcacccaggctggagtgcagtggcacgatctctgctcactgcaagctctgcctcccgggttcacgccattcttctgcctcagcctcccgagtagctgggactacaggtgccttgccaccacgtccggctaattttttgtatttttagcagagacggggtttcaccgtgttagccaggatgttctcgatctcctgaccttgtgatccacccgcctcggcctcccaaagtgctggtattacaggcatgagctacctcgcccggccagaaatggtgtcatttttctagttgagagtgaataggtaactgaagagaatgtggttagttcctgtcttccttttccatttcctttttgttcagattgtcaggcacagaaagtcagctctttggagaggtcaggctgcttgcttttcttagtaaccactacaaaaaacttgagtccatgggcaaaccagaacctactgccacctcctggtgagaggaaaccacttatttttgccctttttgtcccgggatgggggtggggtggggtggtgtgggtagtatgcttcagacatttatcttctggtttagagctaagggactccgcctttaatcctcctagatatagtttgtcttacaagtcagttcctgcatttagcttttttccccccccccccgagacagagtcttgctctgttgcccaggctggagtgcagtggcacaatcttggctcactgcaacttctgcctcccgagttcaagcagctctcctgcctcagctcttgagtagctgggattacaggcgcaggccaccacgcctagctaatttttgtattttttttttttttttgagatggagtcttgttctgtcacccaggctggagtgcaatggtgcgacctcggctcactgcaacctccgcctcctgggttcaagcagttctctgcctcagcctcccgagtagctgggactacaggcacgtgccaccacgcccagctaatttttgtatttttagtagagacagggtttcaccatcttggccaagctgttcttgaactcctgacttcctgatccacctgccttgacctcccaaagtgctgggattatgggtgtgagctaccacactcggcctaatttttgtatttttaatagagactgggtttcaccaagttggccaggctggtctcgaactcctcactgcgtggtctggcctcctcggcctctcaaagtgctgggattataagcgtgagccactgcacctggcgcatttagctttttttttttttttagacagagtttcgctcttgttgcccaggctggagtgcaacggcaccatcttggctcactgcaacctccacctcctgggttcaagcaactctcctgcttcagcctcccaagtagctggaattacaggcatgcgccaccactcccagctaattttgtatttttagtagagatggggtttctccatgttgatcaggctggtctcgaactcccgacctcaagtgatccatccacctgccttggcctcccgcgaagtgctgggattacaggcatgagccactgcttagctatttttaaaaaggggaaggaaacctctttatcagtagcttagatcaggggtcagtaaactttttctgaaagggacacagatagtgaatttttaggctttgctgtggtaaattgtcctttgttttgtttttaacagtcctttagcaaatgtaaaaaccattcttagcttgtatgaaaaaagaccaaggtctgaatttggcccagcccacaggtcattgtttgctataccatggtttatatgatagtattgtttttatttgttttggtagcttctttgtgatactctgtcccaaataagtatgtcctgcctggtatctgatagctggagtgttctcagatttgaaaaggagggatatttagaggtcgaatatttaaatcattccagaagtcaccaagtttttaacttttattttatccttatttgctttatcctagatgcttaatataatcagtgggaatagaaatggaaacattgataggattggatagttgataggatagttgttaggaaaacattgtagtgtaatggagtcagcctgagtttggatccctgttctgcctggacttggacaagttaatttactcatctgtaaagtgaaaattgttgtggaggttaaatgggacaagtgaagattttagaacaggacctggcatatgtatataggtaaggagttattaaaaattgagtccttattatatatatgcaattgaaatttgaaattaaatagaactgtttgatttaggatctttttttttgtgggagaccacagttttattattactcaaattagtctcctgatttagggtcttcatattgtctctgaattttcctgcttcttatcagaagttttgtttcctttaggtgactaaattcaatacttgcatgtattaaattgtttaatgcaaagtaggtcttttgtttgtgatgagaggttttgtgtggtattatattaatttacttaatttttctaataagtgacaaaaaagtccacttgctgtatccattttctgggaagtccctgacaaggcagatatcttagtttgaagtaaaataaaaattgtagtctgatgtcactaattaaaactgtttacttttctttttttttgagacagaatctagctctgtcacccaggctggagtgccatgctgtgatcttggctcactgcagtctctgcctcccaggctcaagggattctcctgcttcagcctcctgagtaactggggttacaggtgtgtgccaccacgcctggctatttttgtatttttagtagacacggggtttcaccatgttggtgtggtggtctcaaacttctgacctcaagtgatctgccctcctcggcttcccaaagtgctgggattacaggcgtgagccaccttgcccagccaaaaccattttcattaggcacagagtattgcaaagattgtaattatcttgtattttctttttttttttttttttgagacgagtctcgccctgtcacccaggctgaagtgcaatggtgcgatttcggctcactgcaacctccgcctgccaggttcaagcrattctcctgcctcagcctctggagtagcacgcaccattattcctggctaagtttttatatctttagtagggacggggtttcaccatgttggccaggctggtcttgaagtcctgaccttgtgatctgcctgcctcagattcccaaagtgttgggattacaggcttgagccaccacgcccagctagcttgtatttaaaaaaaaaaaaaattatttgtagctatttagcttatcttcatggttgtaatatatttttaaaagattcttctgtgttgggaagtttggtttcaagtcttgctgacacataccatttactgtcagaaacaggatgataggatgccttttctatctatagatatttcagtttgcttgattttgcatatctttttcttagtgtgatttaagaaacaaactcttactcccaattttcaaacatgttacctgagaaaaagtgtgatagtatcttgtaggtaacttttagtgagtttaactactgtgagcttttattgagttttctttttttttttttaagacagtgtcactctgttgcccaggctggagtgcaatggcacgatcttggctcactgcaacctccgccccgctctgggattcaagtgattctcctgcttcaggctcccagctcttttttttttttttttttgagacagagtcttgctctgtcgcccaagctggagtgtagtggcgcgatctcggctcactgcaagctctgcctcccgggttcacgccattctcctgcctcagcctcccaagtagctgggactacaggtgcccaccaccacgccccgctaattttttgtattcttagtagagatggggtttcaccatgttagccgggatggtctcaatctcctgaccttgtgatccgcccacctcggcctcccaaagtgctggggttacaggcgtgagccaccacgcccggctgctcccagctaatttttgtattttttcggtagagacagggtttcgccatattccccaggctggtctccaactcctggactgaagcagaacccctgccttggcctccaaagcactgagattacaggcgtgagccacggtgcttggacctgaatctagtttcaataatctgaatttaacatccaaatctaagacattattggttgtattttataagcctatgccattcagcagygaagtttaccctatccaatcagtccaagtcctctagccatttaaagtacttttctagctgaagaattaaaaacctgctccctgggagaataagattccagaaccttaaaactgatgatggactgcatttgatatttatagttaaagatccagtgaaactatttgagaaaggagattttataatctgaacactgctaaggataatgtgaagaaaagggagttgaacagaactgaagtcaagaaaactagtaggaagaaaagagctttgtatagaaggaaggaaggatatataggaatgacaaggagttggccatactgaaaagatgcctctggttattcctgtgaaaaggtttattagaaaagaatgtcgttaattacaagtgagttctgagttagtgttatagaatagccttcccccaccccagctgtttctgagttagtgttatagaatagccttcccccaccccagctgtttctgagttagtgttatagagtagcctgcccccaccccagctgcctttcattaatccttttttttgagatggagtctcgctcagtcgcccaggctggagtgcagtgatgtratctcggctcactgcaacctctgcctcctgggttcaagcaattctccctccctcagcctctcaagtagctgggattacaggtgcctgccaccacgcctggctaatttttgcattttttaatggagacagggtttcgccatgttggccaggcttgtcttgaactcctgacctcaggtgacctgtctgcctcagcctcccaaagtgctgggattacaggcatgagccactgcgcccagctcattaatccttcaactcaggttaaatataatttgaaaagctaatgtattcacaataccttatacgttgaatgttcctgatatgtatgtagtattgaattctaatccccagattgaatttttaattagtctaaatctcagtggcatttttgacatgttttgccaaatgaagaacccttctttcttggagagagaatacccagtggatttagccagttcacattctaaaattcactcctttaatccttgaacttaaatttattatttatgattatgaagtgtggactttgctttagggccacagagtattttttaagattaatttttttttttttgagacggagtcttgctctgtagcccaggctggagtgcagtggtgtgatctgggctcactgcaacctccgtctcccaggttcaagtgattctcctgcctcagcctcctgggtagctgggattacaggcggacaccacctgccagctaatttttgtagttttagtagaaatggtatttcaccatgttggtcaggctggtctcaaactcctgacctcaagtgatctgcccacctcggcctcccaatgtgctgggattacagacgtaagctactgcacctggctgttttttaagattttatttatttgttttatttttttgagatggagtcttgctctgtggcccaggttggagtgcagtggcgccatcttggctcactgcaagctccgcctgccgggttcacgccattctcctgcctcagcctcccgaggagctgggactacaggcatccaccaccacacccagctaattttttatatttttaatagagacggggtttcaccgtgttagccaggatggtctcgatctcctgaccttgtgatccacccgcctcggcctctcaaagtactgggattacaggcgtgagccaccgtgcctggccttgtttttaaatcttaaagcacttttcaggtccatacagaaagcttatttccctcatgcctgcttatttcctgtaaagacctgaagaactcttctctcaagaactcctcaaaacataggtgggttacattgggccttccttggtagtaaggtcaaaggaaccttttcttccataagaaaaccgtttttcctcttgtcagactctttttactcttatttgttagtggctgaagtctttagtacttcaaaactcttttaaaaaactgccagtcaaggaggtacctctccagatctgtttggtaggcagggtcccttaacttttttggggttggttggtttgtttgttttgagacagtttcactcttgtcacccaggctggagtgcaatggcacgatcaactggaacatcaacttcattttattttcaaaaaattgttccagtattttctttttctgtttttttttttgagacggagtctcactctgtcacccaggctggagtgcagtggtgcaatctcagctcactgcaagctccgccttccgggttcacgccattctcctgcctcagcctcctgagaagctgggactacaggtgcccgccaccatgtccagctaattttttgtatttttagtagagacagggtttcaccgtgttagccaggatggtctcgatctcctgacctcatgatccgcccaccttggcctcctaaagtgttgggattacaggcgtgagccaccgtgcccagccccctgttaactcttgatagtctcctttccaatactgtgcatatttcttttccgtagtagttttttaaaaatttctaatgtcttatagttggctgtgcatcataaacacatattctgtgtaagtctttaacggtggaaatcaactcgaaggtcggcttttatgttaacttctcattgatttttcagagttgatattaaaaatatgtttataaatatgtgtttggtagacaataagatactaattaaaatggtggtcttttaggtaaaattctattgtagttaagcttataatcatggttatgtataccaaggccttaattagaataacaggtcactgagtttttgatggtttcagtatagtggttctcaaacattaatttgcagaagaatcaaattcaagagcttattaaaataaatttgcctttctaatgagctcataggctacaccaatgctgctgatctgagaactacactttgagaaccactgttttagtccttttataagtgactagatatataaactacagaactaaagattacacagattgtcacacatgggtatgcacacaatttaaagggaattttgtgagatttaaagctattttaagttttactagatttagcatttattgataaggttaccagaagctttgaattgcatgatccaaggacacgcctgtatttgggtcttagcacctttttgttcgttcagtccatagtacttcccactctctctttttttttttccttgagacagagtctygctttgttgctcaggctggagtgcagtggcgtgaactctgctcactgcaacctctgcgtcctgggttcaagcgattctcctacctcagccttccaagtagctgggtctacaggtgcccaccaccatgcccggctactttttttttatttttagtagagacggggtttcactatgttggccaggctggtcttgaacttctgacctcgtgattctccctcttcagcctcccaaagcgctgggcttataggagtaagcyaccgtggccccagccccatcctttatttctttttcttttcttttcttttttgtgagacggagtcttgctctgtcacccaggctggagtgcaatggcgcgatcttggctcactgcaacctccgcctcccaggttcaagcgattcttccccctcagcctcctgagtagctaggattacaggcatcaccatcatgcccagctgaattttgtatttctgtagagacagggtttcaccatgttggccaggctggtcttgaactcttgacctcaggtaatccgcccgcgtcggcctccggaagtgctgggattacaggcgtgagccaccgggcccagctcctatcctttatttctttatcccaaccttcatctctgtaaaacagtacataaatggaccagaaaagggtctttatcctggtgaatattttagaatctatactaactcatggaggtaaaggcaaacattactattcttcattcaatcaatacttyctgatcacataccacatgtcaagcattaaatacagaggatacagcagtgaacaagttcctgccttcttggagcttatgttctaagttaggaagacaaggaaacaagtaaacataatatgtaacgcataaacatataatatggtgattcagtgctatcaataaagtaggtggaatgggatacccaattttgaaaaaaatatagaaaaaaagttttaataaaaaataaagctgggaagcaaaatgagatgggtgtcctattatataagcaaagacctgaaaaagtaaagaggccatgcaaatttctactagagaagtattaggccaggcgcggtggtggtgcactttgggagtgctgggattacaggctggagtgcagtggcacgatctcagctcactgcaacctctgcctcctgggttcaagcgttttttctgcctcagccttcctagtagctgggattacaggagtgtgccaccacacccagctaatttttgtatttttagtagtgctggggtttcaccacgttggccaggctggtctcagctcctgacttcaagtgatctgcccgcctcggcctcccaaagtgctgggattacaggcgtgagccactgttcccggcctcaaaggaagtatctttaagaagggtctacttagagatatgctggtggttaatggaataaatacaagatagcaagatacccagagaccaatagcagaacgctactaccttctctaggactggaagaatacagggaagaaatgctgtaactggagtggaggggtgctggagtggtagttttggagatggagcaagatttaagcagggaggagcacaaaaaaagacctctctttactcccattctctaatatctagtgtttaatatctctcatggggcagtcttaccagaaaccagttggtagtgcagtccatagaaacagcctatcaaaaatgggctgagaaaagggcaagtggataccagcacagcatcaaatctgtgattttataagtgtgtgtgtgtgtgtgtgtgtgtgtgtgtgtgtgtgtktaggaaaaagctaaattttaagaaaagtgagtaaagaaaaactttaaatccaagtgagtggattcagagaaaaacagtacaggtgaaaatcatggctaaagtttgggaaacactaggaaaataattttatgaactgtatgtatttagcacagtctaaaatggtctgtaagatttgtttacctgattcactttagaatattttcattataatcttaaatattgtctgactagtgctccacatgtatattttttctagataactgaagattaagcctttcaagaatgcacaattttattcatctgttttggaggggcttctctaaaatgtatcttaatttcctgaaatgtatctgatttccaatattagaatcacttcagagggcttgataaaacaggtgggacctacctctggagattatcctactaagggctggagaaggacctgggatgatgctgataatactgctaaaaagggatcacactttgaggaccactcaattatattaagcttaatttaactttttcttaatgacttagggtcatttaacctacaaaggtatattagggtattgaaacacaaggatgtttgttccttcatactggttccaggtccattttattattttccttccttcttcccatcctccctcctttctttttgtctttttgtttttagaaacagggtctctgtcacccaggcaggagcgcagtggtacaatcatagctgactgcaaccttgaattcctaggctcaagtgattctcctgtctcagcctcccaagtagctaagactacaggcctgtgccacagttctagctaatatagcctgcattcctttttactcctcatgctgtcattcactgtgccactagtaatgtctctgtctcactgttcctctattaagctcttctgggctgagactagttaagttggttaaattttagtatagaaaatcggtctgtaatctaagttcatgtattttagtgagtgagctttattatatccactttgaccagttatgttttccagttgtttttgaagatacctaatgttgccacatgagggatctatgagtgagggtggagccaatttaaagttgttctatacttgccttccagatggatagggatcacaggaatctctgatacgtttagtagctaaacaccttacttgaagtcccccaaaaaatttttaaatctacattaaattctagaattgctatagctggatgtggtagtcggcctgtagtcctggctacttggaaggctgagatgagagcccaggagtttgaggctgcagtgggccatgatcacgtgccattgcactctacctggtatgacacaggtctctggaaaaaaaaaaattcttgctatagtgctttagctagcctgtcacctatatcaagtatgtctttgtttttaagtctttttttgtttttctgagctggagtctcgctgtgtcacccaggctggagtgcaatggcccgtctgcctcccacgttcaagcgattctcctgcctcagcctctctagtaactgggattacaggcatgcaccatcatgcctggctaatttttgtatttttagtagatacggggttttgccatgttggccaggctggtctccagctcctggcctcaagtgatccaccagactcggcctcccaaagtgctgagattacaggcatgagccaccacgcccagccttaagtctgtcttaaactgtattatagcttttaaacactttcaagtcttgaagtatggaaatgggataagtaactagtattaggtgtgtttttacaaatattaaatattggatataggtatataggctttctttccatagtaactaatactgtgtaatattagcaaagaaaaagggaacagtgaattggtgttgttcagtagttagtgttctagaacttggcttcatgtgtttgatagagagcttacttgtagatctattgaaaatttgcacaatacatggaagaataattacatgcttcccagttgttacctatacctttcctttttttttcttgagacggagtctcgcttttgctctgttgcccaggctggagtgcaatggcgtgatcttagctcactgcaacctccatctgccagttccaagcaattttcctgcctcagcctcctgagtagctgggattacagatgcacaccaccacacccggctaatttttttttgtatttttaggagaggcggggtttcatcatattggtcaggctggtcttgaactcctgatctcatgatccacccacctcggcctcccaaagtgctgggattacaggcgtgagccaccacgcccggctaccttttcacatagtaaggaaattactattcaagtgcctgtatcagaaatgtcttccattttttttgttggcaggatattttaaggcctctgtcttgagtttcccttctaggtagatttatatattctgccttgattttattgttttctgtacctactgagtcatttttttcctttctttgactctttctttgaaatcctactaaatctgcttcgtgaaataaattgttgcctaaaatcggttaccttaccccagtttattgccagcttttttccttgttagtaaaaaagttttcagtatgtttctgttataccttgtaaattgatacatgccttcacattatttcatttgattttcattataattactataaataataggaggcagtgttattttacctagagtaaatcaaagtacagggaggtcctccaattttaccctaggtcctggcaatcccaaagcccatacttttttttttgagacggagtctcgctctgtcgcccaggagatcttggctcactgcaagctttctcaagcaattattttactgcacattcggctcactgcaagctacgccacccgggttcacgccattctcctgcctcagcctcccgagtagctgggactacatgcgcccgccaccacgcctggctaattttttgtatttttagtagagacgcggtttcactgtgttagccaggatggtctcaatctcctgacctcgtgatccacttacctcagcctcccaaagtgctgagattacaggcatgagcccaaagcccatacttttactctgtcttagatatactgtggtagttgtgtttctactttgggcaagttatttaacttcattgtttgtcttatccataaggtggggatattagttcataaagttatggtgaggattaaactaaataatatgtataaattgcttagaatagtgtctagcacatagccaaactacaataaaaataatagtgaaagctattataccacattactttccctttcttctttgaaaagttaccataatagctgggcacggtggctcatgcttgtaatcccagcactttgggaggcagaggtgggcggatcacctgaggtcgggagtttgaggccagcctgaccaacatggagaaaccccgtctctactaaaaatacaaaattagctgggtgtggtgtaatcccagctaattgggaggctgaggcaggagaatccattgaacccaggaggcggaggttgtggtgagccgagatcgcaccgttgcactccagcctgggcaacaagagtgaaactccgtctcaaaaaaaaaaaaaagaagttaccgtaataaaattaatcactgagattttcagccaacatttgctgtagtgaaatgtcaacatcagaaaagattttagattgtttcttgagtttatttttgttggattgtttttttttgtttgtttatttgtttygttttgttttttgagatggagttttgcccttgttgcccgggctagagtgccatggtgcagtctgggctccctgtaacctctgtctcctggatataagtgattctcctgcctcagcctcctgagtagctgggattataggcatgcgccaccatgccctgctaattttttgtatttttagtagagatggggtttctccatgttggtcaggctggtcttgaactcccgacctcaggtgatctgcccacctcagtcccccaaagtgctaggattacaggcatgaaccacctcgcttggccagattgttttagttcctgtatttttttttttaactcttgtatttctagttgtctgaatttttatttatcttaaagcatgtgcagtaaaataattgcttgagaaagctattgaaagtattgtttatgttttaacatactgggaaaaaatggatgccttttctctgagattaaaacatgtattacatattaataaatctaaaatcgacattgagtatttgatggccttttggggtttttttaaggattagaataatgcagccatttgggacaattattgccttatgtatgcatatagaagaaagaaagaatttcacatctgtagaatttgtaaaaaccattatgttagcagtaactgtagtaactgaattttggcaaacttgttggacaccattgtgttttgcttggcctggctttcagtgagtaggtacttattttaaaaagataaatttctaaaactgtcataatatgttttttctctcaacagggcattcttagcagggttacagaatctgttaagaatattgtgccagggtggytacaaagatmcttcaacaagaatgaagatgtatgcagctgttcaacagacacaagcgaggttccacgctggccagaaaataaagaggaccatctggtatatgccratgaggagagctctaatattactgatgggagaatcacacctgagccagcagtcagtaatacagaaggtaagtaaaatgtgaatattttgtcatgaatgataggytttcatgccctaattttgaagacactacctagttatggtaaatctaatcaggcggtacataaaccatatgggaagaggatgataatcaggttcaaattggatgtcttttttatttatcagtgttttatttattaaggaaggttgataaactatatcagttaagactgcaagctctgatgttggattttgggttttaattttcttttctttttctttttttctttcttttttttgttttttgagacggagtctcgctctgtggcccaggctggagtgcagggtgtgatctctgctcactgcaagctccgcctcccgaattcatgccaytctcctgcctcagcctcccaagtagctgggactacaggcgcctgccaccacacctagctaattttttttttggtattttttatagagacggggtttcaccgtgttagccaggatggtctcgatctcctgacctcatgatccatccgcctcagccttccaaagtgctgagattacaggcgtgagccaccgtgcccagccaagcctatcctttaaagcacgtgttttaaatttcgatgaagcccaatttatctctcagtgtatgtttctttcagtatatacattttttctttcactacatgttttgaaatacataattacaaaactttttgtagccctatgttaaagtctcaaataaataattgatttggttgtatgccctgttaattttggtgtacttagtaacatctccctgcctgatttgtccatagtaaaaaatagcgataatgaaatggccctgaaagaatggtttttattttagagaaatggcaaacctaatttttcttagtaatgttcaactagatgtattctttgaatgttcacttacttttattagagtaacttaagttttaatgtctgtacttttcaagattgcttttaaatatataaccagcagccatcttgaggttttatctggtagatctctaagctgactgcctctgtgttattttcttttctggccagtgaaagggactctggcttttctttttctgttttcccccctctgtttcctggttatgagatttgtttccttttggttagagagttctagtatatccacagcgactgtcttctaagatagctgtagaaatgatcttttctatcctaatgagcatatttgaaaggattaactaacttcaagaatttaggtgtgaaagacatggagagtttcttattctctgtacagtttatgtatatttgtattttcatgaaaatagcaggatgaatttatgccaaggtcaactcaaactgattttattcattatattattaaatgtataaggaggattttctgttacatgtccttattctttaagcttttttgtataacttctgaactttattatggaaaatttttaaacctagagaaataaagaggatagtacaatgacaccccccactccccgcccccctcccccgccgcccgcccccggctgcccattactgagcttcaacaataatcaagtcacggttgatcttgtttatactctattcgcacgcctatttccctaccttcctacccccaactcacctgatgtacttagaagcaagttgtgggcagcattttgatatctacttcaaaaacttaaaaaattttttttttctatagtactgtttttttttcttaacttttaaaactttgttaatcccagaactttgggaggccgaggtgggtggatcatgaggtcaggagattgagaccatcctggctaacatggtgaaaccccgtctctactaaaaatacaaaaaattagccaggcatggtggcacatgcctgtagtcccagctactccggaggctgaggcaggagaatggcatgaacccgggaggcggagcttgcagtgagccgagatcgcaccactgcactccagcctgggcgacagcgagactccgtctcaaaaaaaaaaaagaaataaaaaaaaggtttgttaacaattaagacatgcgcacattaacctagccctacataaagtcagtatcagcwatatcatggctttctacccccacatcttgtcgcactggatactcttcaggggcattaacatccatggagctatcatctcctatgataacaatgccttcttctggaatacttccagaaggacttacctaaggctgtttacagttggctttttctttctttctttctttcttttttttaaagacaagatctcattctgttacccaggctggagtgcagtggcaccatcatggctcactgcaacctcaaccttccaggctcaagcgatcctcccacctcagcctcccaagtagttgggactataggcgtgtgctaccacgcccagcaaattttttttaatttttttgtggagacgaggtcaaactctgttgcttaggctgggcttcaactggcctcaagtgagcctcctgccttggcctcccaaagtgctgagattacaggtgtgagccaccacctgtgagtcaattttttttttttaatgtaagtggaaggagtatactctagtgataaaaggtatagtaagtacataaaacagttacatagtcatttattatcattaccaagtatagtattctatagagtacataaatgtatttgctctagttttacatgactggtaacactgagtttatttacattagcatgactgcagactcctgagtaatgcattgcactaaggccttaggatggctatgatgtcactagggaatacagatttttcagcttcttcataatcttatgggacaactgtttatataacagtttttttttttttttttgagacggagtcttgctctgttgcccaggctggagtgcagtggctcgatctcggctcattgcaagctccgcctcctgggttcacaccattctcctgcctcagcctcccaagtagctgggactgcaggtgcccgccaccaggcccagctatttttttttgtatttttagtaaagacggggtttctccgtgttagccaggatggttttgatctcctgacctcatgatccaccttcctcagcctcccaaagtgttgggattacaggcrtgagccaccgctcccaactagttgactgttcttatgtggcacatgactatatatctgctgttgaagtagtgtcagattctggaaagctaacatatggcagtcctaaataaatttagttgtttactaaatattaattttataaatacatattttattgcactttgcacatactgcattttttacaaattgagtttgtggcaatcccatgtcaagaaagttgatcagtgccatttttccaccagcacacgctaacatgtctgtcactttggtaattcttgcagtatttcaaacttttaaattatgtatctatcatggtgatcagtgctctttggtattactattgtaattgttttggggtgccacgagccacacccatataagatgatgaacttaatcagtaaatgttgtgtgtgttccagctgctccaccaactggctattcccctcttttctccctctttctgggcctccctattctctgacagtattgaaattaggctaattagtaaccttacagtggcctctaagtgttcaagtggaaatcagagttccccgtcttttatccaaaagctgtaagtatgtaagtttagtgaggaaggcatgtggacagctgagacaggcctgaagctaggcctcttgcaccagttagccaacttgtgaatgcaaaggaaaagttattgatggaaattaaaagtgctgctctagtaaacacacaaaggataatatgaaagcaaagcagccagttgctgatgtgtagaaagtttgagttggtttagatagaagatcaaactagctacaaaattcccttaagccaaagtgtaatccagagcaagccctaactcccttcagttctgtgaagtctgagggagatgataaagctgcaggagaaaagctggaagccagcagagatttattcatgaggtttagggaaagaatctgtctctgtaacataaaagggcaaggtgaagcaacaagtgctgatgtaggagctgcaataagttatccagaagatttagctaagagcactgacgaaggtggtttattagtccattttgcattctataaaggaatacttgagactgggtaatttataaagaaaagaggcttatttggctcatggttctgcaaactgtgtgggcatggcaccagcatctgcttggcttttagtgtggtctcaaggttttactcatggcagaaggcagagtgggagcaggcatatcagtcacatggagggagaagggagcaagagtaaggaggtcccagactattttaacaaccaaatatcatgtgaacccactaccttgggtagggtaccaagccattcatgaggaatctgcccccatgacccaaagacttcccatgaccccacttccaacattgaggatcaaatttcagcataggatttggagggacaaacatctaaactatcagatgactacactaaacaacatattttcagatgaaacatggcccgccgttggaagaagwtaccatctaggattttgatagccagagaagagacatcaatgcctggcatcaaaggataggctaactctcttattaggggttaatgcaactggtgactgtaagttgaagccaatgcttatttaccatatcaaagatcctagggctcctaagaattatgctaaatctactctgcctgtgctgtgtaattgaaacaacaaaacctggatgacaacacatctatttacagcatggtttactgaacattttaagccagttgttgagacctcttgcttggggacaaaaagattctttgcaaaacaacactgctyattaacaatgcatttggtcacccaagagctctaatgagatgtgcatagagattaatgttgttctgatgcttgataatacaatgtccattctgcagcccatggatcaaggaggcattttgactttccagtctcattatttaagaaatacctttcatatggctatagctatcatagtcattcctcagatagatctgggtaaagtaaattgtaaaccttttggaaaaggttcaccattctagatgacattaagaacatttgttgagtttcaagtcaaggctaatttgggggagaaaaaccatttgtgatttacaggaggaggtccaaatattgacatgaataggagtttagagaaagttgattccagcccccatggataactttgaggggttcaggacttcagtggaggaaggaactacaaatgtggtggaaatagaaagaaaactaaaattagaagtggagtatgaagatgtgactgaattactgcaatatcttatgctcaaactcgaatggatgaggagttgcttcttgtggatgcgcaaagaaagtgtttttttttttttttttcttcttttttgagacagtcttgctctgtcacccactctggagtgcagtggcacaatctcagcccactgcaacttcagcctcctgcgataaagcaattctcctgcctcggtttcccgagtagctgggactacaggcatgtgccaccacacccagctaattttttgtatttttagtagagatggggtttcaccgtgttggcaaggatggtctcgagctcctgacctagtgatctgcacccctcagcctcccgaagtgctgggcttacaggtgtgagccaccacacctggcaaaagtggtttcgtgagatggaatctactcttggtgaagatactgtgcacatttttaagattacagaataatttagaatattacataaacttagttgataaagcagcagcgaaatttgagaggattgactcccattttgaaaattcygcagttagaatgctatcaaaaacattgcatgccacagagaaatctttcgttaaaggaatagtcagtcgatgaggcaaacttcattgttgtcttattttaagaaattgctacaaccaacccagccttcactactcatcaccctgatcagtcagtagccatcaacattgaggcaaagacctgttaacaccacctaaaagattatgactttctaaaggctcagcagattgttatttgttagcaatttttttttaagtaggtatgttgtttttattgtcataatgctgttgcacacttaataggctatagtgtagtgtaaacataacttttgtatgcactgggaaaccaaaaacgtgtgtgactcactttacattctcctcctcactctcccaggtagctgggactacaagagcgtgctgccatgcctagctatgttttaaaaatttttagtagacgtgaggcctcactgtgttgcccaggctggtcttgaactcctggccttaagtgatcctcctgcctcagcctcctaaaagtgctgggattatagggatgagccaccacacctggcctgtgttggatttctttttcctctttggtttctgtatatactaggtttagttgatgtctgccaagagttagaaaattatcctatcacttttctcctataggagaaactgatgcagggatgagagaatgggataagtaaaaagcatgttcatagtgtaatatactacagtaatattggaatacttgataccctgggaaacatttcaacctatgtgtatgtaaatcctgattgcagataaattgaaatatttattatgtgtaaatgctaattggtttaaatacctataccagcagatttctaaaccccagacagtatctctggttttttatttttgttttgttttgagacaggttcttggctctgtcgcccaggctggagtacagtggcatgatctcagctcactgcaacctccatctgggttcacgccactctcctgtctcagcctcccaagtagctgggactacaggcgcccgccaccacacccggctaattttttgtatttttagtagacacggggtttcaccatgttagccaggatggtctcgatctcctgacctcgtgatccgcccacctcggcctcccaaagtgctaggattacaggcatgagccgccttctggtaaccatcattctattctctgtctccatgagttgcccactggtattcgtcattctattctgtttccatgagttcttttgagtccgttttttttttttaaagctgtcacatttgagaacatgtgatagttgtctttttgtgcctggtgtatttcacttaatgtgatgttctgcagttccatctatattgttgcaaatgacaagatttaattctttttttttaatggctgaataatactccattgtgtatatgtagcacagtttctttgtccattcatttgtggatggatacttaggtcaattccgtatcttggctattgtgaatagtgctgcgagtgcagattatctctttgatatactrgtttcctttaacttggatatatacccagcagtgggattgttggatcatattgtggttctacttttagtttttgtgagaaacctcaatgatgttctccatgatggctgtactaattgataattcccaccaacaacagtgtacaaggattctcctttctctacatcctcaccagcatccattattgcctttttgataaaagccattttcactgggggttggagtactttttatgttctggatattaatcccttatcacatatataatttgtggatattttctcccatcctgtaggttgaccttttactctgttgattacattctttgatgcataaaagtttttacatttcatgtagtcctgtttgtctgtttttgcttccatggcctgtgcttttagtgttgtatctgataaatcattgtcaaatctcatgtcctgaaattctgttttcttctataagttttatagttttgggtgttatactttggtctttaatccatttagagttaatttttgtatatggttcaagataagggttcattctttttcatgtggatatccagttttccaaaaccatttaatgaagagactgtccttttcccattgagtggtcttgaaatccttgttgaagatcgtttgatcatatatggtagtttatttctgggccctgtgttcacrtccatggtctgtattgcctgtctttattacagtattacagaccacaggctctttggtttcccatgtaatggaaattaacacggacccaagcagatttcccagacaggacttttatttcagggcttgtgcttgagcgcaagggaaacagtggaggtgaggctcaaggatcctcttcctggcttcccggaaaaagccagtaggaattttttttattaggcaaagcgcaggaattgacatggggtaaggtatgcaggctgggctgggcaaagcacctgcagggtagggtacgcaaggcagcatatctggttgcgatgattaccttgagtagtggtctggccggtggcaacaatgctgtaaatcagttatttcgcattccttcctgaggtggactstctgcaaccttggtttgattttggatctcctaagagcaattcctggaattctttaaaaggtatggttacctattatgagagcaccgaagaatggctgttttctttttgtgactaaagcctcagggttagcatgtgtaacatcagcgaggtagtcttgtggattttgtgaagagaagaaaaaaatacatatgtgaaggagaaactacctcccacctcctgttctctctcaccagtgccacattgttttcattactgtacttctgtattaagttttaaaatcagaaagcttgagacctccaacttttttgttgtttttaaagattattttggcattttgaggttccttgagattccatatgaattttaggatgggttttctatttctgcaaaaatgtctttgggatttacatagaggttatattgaatctgtagattgcttagaatagtattgacatcccaacaatatttagtcttgtagtccatgtacgtgggatatttttccatttctgttttctttctttcggtactgttttgtagtttccatgtgcacatcttttaccttggttcattcctaaatattttattctttttgatgctattataaatgaaattgttttcttacttttcagattgttcattattagtgcctagaaacacatttttttgtgttgatttttgtatcctggtacttggctaaatttgctctaacagcttttggctgaatcttcactgttatttacatgtaagattatatcatctgcaaacatgtttttttactttattatgttgtagtttcgttctagtcttagtttgttgagtgtttttatctgcagctggctttttttgttatagtactttggaactaaataatccagaattgttttgtattgcttaagctgtaaaatatttgttaagacttatttttttttttttttaaatgagatagtcttgctttgttggtcaggctggagtgcagtggtgccatcatagctcaytgcagccttgaactcctgggctcaagtgatcctcccacctcagcctccttgagtagctgggactacagctgtgtgcaaccacacccagctgactttttaaatttttagtagagatgaagtctcagtatgttgcccaggctggtctcgaactcctgggctcaagtaatcctcctgccttggcctcctaaagtgttgggactacaggcgtgagccactgtgtccagccaagacaattttttaggaagatagcacatagaagaacactacagaatggcaaatacagtctagcagcacatcacaaaatacttactgaggagagcattaatcaaggaatgcaagtaatcattcagcgtttaatatagtttaccatgttactaggtaaaatgatcttatttttgctttttagtaaatagacatttgctaaaatttaaaattcactctttatttctatttggagtttagaaactgttacttccttaacatgtcagtttttcaaaccaaaggccagaatcttttttttttttttttttttttttgagacagagggttctgtcaaccaggctggaattcagtggcaagatcttagctcactgcaacctctgcctcccaggttcaagcaattctcgtgcttcagcctcccaggtagctggaattacaggcgtgtgccaccatgcccgggtaatttttgtgtttttagtagggatgggattttgccgtgttggccagtctggtcttgaactcctgacctcaagtcatctgcccgccttggcctcccaaagtgctgggattacaggtgtgaaccactgtgcccagcccagaatcatatttaatggtgaaacattrgaagcaatcttattaaagttgggaataaggtagaagtccatcaccaccacttctagatattaagaatgtaattagttatggggatgtggtaatgtgttagaataagaaaactctagcaattgacacaaagttaatattgaaaaatacctaacgactctcttatttaagcagtagtcagaaaacacgaaagaagaaaggatcccatttgtaatatcaaacaattgggaggtggaggctgcagtgagcgaagattgcgccactgcactctagcctgggcgacagagtgagactgtctcaaaaaaaaaaaaaaaaggaaaaaaaaaattatgtactttaacaagtgtgtgacactctaaaagaagaaattctcttaagttccactgagggacataaaggagatctgaaccaaaggaaaggtgggtaggaaagcagtgttgggaatgctatcagttcttcttaaaaatcttaaattcagtgtgatcctagtcaaaataattttaagggctcttttaggaactttgaacatattccagatagctgctttaaagtcttgtaatgctaaatgttttaaggtctttgtctgctacctttggttaaagtttctaacacctactctcccccaccccctacccccgtgcatggatcacagttttcttttttctatacattgagtttttactatattggcattttgaatgataatgtgtagagactcttggttctgtcatcttcctctgaagagtgttggttcttgtttttagcaggcagttcagttaatgataattttgaacttctgtagatgtagttttgtgctgtattaatgtatatttgtggggacaagtccagggtgtttcctaagcctcccaatgtggtgggccttagcctccaagctctgtctcccctgtggctttttaggagagatctgtagtaggtcttattttagttatatacttaytccttatttttaagggcgaaccttttggtacatcagctgaatgccattagtaatgagatctttaaattctggcagccctaaaacttgagagtcctcagcattgtttttttcccctagcacggtacactgtctagtatctctgttttctcaactccatagcagctgctgcgtaaggcttaggtggtcttgatataggtatgtgcagcctctctgctcactggacactcccttgtggatttctgggagaccctctctgcacagttccctactctgcagygtcctaaattctgatttcttcccgctctgttttacttgactctaggtctctgttcaaggtctgaaaatgttcctagacagagagctgggtaatcgtagggctcaccttgtgagtttttttttgtgctgttttccactgtctgaaagcagtagcttcatattttttctccagtcttataattgtttacagtagaaggactggtctggtcccacttattccgttctaactggaagcctctttttgggaactttagaaacaattctaaagtttttgaaaatgcctctgaagacaaattctgaaaaatgatttattttaataatttaatattttaataacgggaaggtggggtggagtaacttcaacacgcattaaatttattctaaagcataatatttaaaacatttggtactcgtgcagaagtataaagatacatcattagaggaagagaggaataaagactctgggaatttagtatggtttagtatgtggtaacagtggcttctcaatcattgaggaaaggatggcttatttaagagattaccttaggttataaacaggttaaccatttggaaaacagygaagccgaatcctttctttactcctgcatcataactaatttcagatgggagtcaagattagacatattgaaataaaagcaacagtatcaaaatacgggtaaaacttattttttatggtctcagaatgataggactataaggcagaagttactttctgtattacaaaatacaccatcaaaaaagtgaatgggtttaatcaactggcaaaaaatagttgtatttcaactgttgtatcgtatcacatcactcttactggtttaaaaaaattagctcttatttaaattaattttagttagttgaaactttgttttgcctaggagtatgttatattgggcttattatgggatgccccagtgatttgaattgaagctattatatactgtaatgtgttttcttaaagtaaaaaccatttgtggtagtgtatcgctctaagttgtatattcataatattaatgcttttcttttaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaaggtattcttgacatgtggtagtacataatttgggtagtaacattaaattttatgggttttttttctgacttggttgtaatttttattttctatttataaaaatctaggctcttgtattggtgttattactatggattatgtaattttgtttcagatataactgtttcaaagaacacttcattgccacctctgtggtccccrgaagctgaacgttctcactcactctcacagcacactgccaccagctcaaaaaaaccagcattcaacttgtctgcctttggaacactttcccctgtgagtactaactgggttggatttaatcacattagttttgagtgtttattgcttataatttttttttttttttctgagacaagagtcttttgctgttgcccaggcttgagtgtgtagcagcatgatcttaactcactgcaacctccacctcctgggttcatatggcttataatttatcattctgtttctgtgcagtcacttgggaattcttcartccttaaaaccagtcagcttggagattctcctttttatcctggaaaaacaacatacggtggggcagcagctgctgtaagacagtctaaactacgaaatacaccttatcaggtaggttccaatagaagggttgatgatctttttttttctttttttttacactttaactggataataaattactttgtgctcaaaaaaatagttttgatttattttttatttttcttttatttatattttttcgagatggagtcttggctctgtcgcccaggctggagtgcggtggcacaatctcggaccacactgcaacctccgtctcctggtttcaagcgattctcctgccttagcctcccaagtagctgggagtacaggcacatgccaccacgcccagctaattttttgtatttttagtagagacgggtttcactgtgttggccaggatggtcttgatgatctcttgacctcgtgatgcgcccaccccggcctcccaaagtgttaggattacaggcgtgagccactgcacccggccagtagttttgatttaatattgttctttgggaaaacaacagctatgggttatatttttttcatttagggtatataaacattattttagacctaagtgagtgttttatgtattagatatgtgcgtgtatctcaagaaatgtgattcttttttttaaatgacgtataaattacacatactacaatttttcattgttttagagtatttgagctttaacaaaacatattattatgtatataaccacttctacaatcaaatattgatcagacattttcatcaccccaaaacgttaccttatgtatctcttgagtcaacccttctcctacaaccctctggcaaccacggatctgttttctttctctgtagttttggcctttccagaatgtcatatacgtttagtcatatgtaaccttttgagtctggcttattctacttagcataatgcatttgagatccatttgtttttgcatcttttaatagttcctttttattgctgagtagtatggttagtacagttggtttattattcaccagtgaaaagacactgagttgtttccagtttctggcaattatgaatgaagctgctatgaatgttttttgtgagcattcattttcatctcaggtaaatacaaatacctaggagttgaattgatgggtcatatggtaagtatacagtaaactttataataaactgccaaactgttttccagagtggctggtaccaggtttcattctgactggtaatataagagttgctgttcatccttgtcagcacttggtggtgtcaggttttttgtttgtttttgctattctagtaggcatgtagtggtaaccccaacttctgattttgatttgtacttccgtaatgactaatgatgttgcatgtcttttcatgtgtttatttggtgcttatttgctatcagcctatcttttggtgaaatatcttctttggtgaagtgtctgttcaaatcttccacccatttaaaaattgggttattttcttattaataaattttgagagagttcatttttcagggtacaaatactttgttatatgttttgcgaatattttctcccattctctggtgtatcttaacagtgtcttttgaagagcagaagttgttattttttttttctctgagacaggtcttgtgctgtcgcccaagcttgagtgcagtggcgcaccctccacctcctgggttcaagcaattctctgcgtcagcctcctgagtagctgggattacaggtgcctgccaccacacctggctgatttttgtatttttagtagagacggagtttctcaccatcttagccaggctggtctcgaactcttgaccttgtgattcacccgcgttggcctcccaaagtgctgggattacaggcgtgagccaccgcgcccagccagaagttttacttttgatgacatcttttgtgtgtgtgtgtgcgtgtgtgtgtattcttaatggtttcatgcttttggtgtcgtatctgagatatttttactattataatcccatgtcacaaagattttgtcttatgttttcttctacaagttttatagttttaggttttaatttatgcctatgattcattttgagtagatttttgtgtgtggtatgaggtattggtcaaggttcattttattttctaaattaaaaagtttttttaaaaaatgaaaggtaggagtcttactacgttgctcaggctgatcctgaactgctgggctcaagcaatcctcctgcctcagcctcccaaagttctgagattacaggtgtgcctggccaaggttttttgttttttgttttttgtttttttaacatatgggtgtgcaattgttctagtgttatttgttaaaaagactgttctttgttcattgaatagcttttgcaccgtctttgttctgtgtttttgtttgagacagggccttgctctgtcacacaggttggagtgcagtggcacgatcatggctcactgcaaccagaacctcctgggctcaagtgatcctcccactttagcctcctgagtagctgggaccacaggcgtgtgccaccattcccagctaaattttttttttggtagtgacagggtctcactaagttgcctaggctggtgttgtactcctgggctcaagcgatcctcctgtgttggcttcccaaagtgttcggattacaagcatgaaccaccaggcctggcctgcacctttgttgaaatccagttcacatggctttatttctggacttttgaccatccctcccccgacccacccattgatctgtgtgtctttccttttgccaactgcactgtcttgattgccataggcttcccggtaggtcttaaaattaggtgatgtgagtagtccaattttgttctttttcaagcttgttttggcttttttaggtcctttgcttttctataaaaatctaaaattggcttgtttctacagtctgctaggattttgattggaattgctttttttattttttagatgggatcttgctctgttgcccaagctgaagtgctgtggcatgatcttggttcactgcaacctccacctcccaggttcacacaattttcctgcctcagcctcccaagtagctgggactacaggcacacaccaccatgccccactaatttttgtatttttagtagagacagggttttaccatgttggccaggctggtctcgaactcctgacctcaggtgatccgcccaccttggcctcccaaaagtgctggtattataggtatgagccagcatgcccagccatgattgagattgcatttgagtctaaagaccaatttggggagaataggcatcttaacaaaattgagtcttccaaaccatgaacatggtatatcttcccatttaggtggtttataaatttttttcatcagtgttttgtagtgttcagcatacagatctcgaacatattttgttagacttatttgttagacttttgttatttggtattagtcaagaatatgtagcctgaataacttttatcttttcagtgaattgagttcataatttaaaatacgttccagcaaagaagcttcaggctcagatagcttccctggtgaatcctaccaaacatttaagaaagaaataataccaattctacacaaactcttatgtatagtaggagagtagggaacacttcccagtaccttttatgaggccaacattattaccccgagaccaaaatcagacaaagacattagaagacagcaacagactattatttctcatgaattatagacacaaacctcaacaaaaatatttgtaaatggaatccaacaaatttaaaaaggaaactgcatcatgatcaagtggggtttatcctgggaaggcarggttgactcaacatatgaaaattaatgggattagaccaggtgtggtggctcatgcctgtaatcccagcactttggaaggccttagatcacctgaggtcaggagttcgagaccagcctggccaacatggtgaaaccctatctctactaaaaatacaaaaattagccggttgcagttggaygtgcctgtaatcccagctactcgggaggctgaggcaggagaatcatttgaacctgggaggcggaggttgcagtgagccgagattgtgccaccrcactccagcctgggcaacagactgagactctgtctaaaaaaaaataaaaaataaaaaattaatgggatttaccatgtaaacaatctaaagagtactatatgaacatctctatagatacataaaatattttttaaaaatccaacatttagtcatgataaaaatttttgaacaaacctaggtatagttgagatccttctacctgataaagtgcatttacaaaaaaatcatctggcaacatacttaatggtatgaggaagcaagcaaggatgtctgctatcactgctactgtttaacatcatactgcaggtgctagccagtgcagtaggcacagaaatcaatgcatgcagattggaaagggtattattcctgtaatatttttactgtacacagataacatgcttatctacgtagaaaaatccaaagaaaatacaaaaaaagccaccacaactaataagcgagtttaacagggtcacaggatacaaggtcaatatacaaaagtctgttgtatttatatacatatattggcagcagtgactatgaaatgcctatatttgaagatttttgtcttgtttttagatgttgtacttgctttcctgattattctcccatatataattaacagtaattatgagacttatttctgagtgttggtggaggacagtattctgttattaccgaaggggttaacagaatggtgtaagtatgtagagagctttttctaaagcttaagctagcgtgtagtactttttttttttttttttttttttttgagaaagagtctcgctctgttgcccaggctggagtagagtggtgcagtctcggctcaccacaacctccgcctcctgggttcaaagcagttctcctgcctcagcctctcgagtagctgggactgcaggcacacactgccacgcctggctaattttttgtattttaatacagatggggtttcaccatgttgcccaggctggtcttgaactcctgagctcaggcagtccgccctcctcacacctcccaaagtgctgggattacagacatgagccaccatgcccggcccatactttctttaaaatggtgcatgctgtcttatcattcttttgttattgtaaaggtaatttctcaatcagagaattggatttccagtaaaggcataaagaaaaaaattgaacttttaatgataccacccaaagataaattgctgttaatgcattaaatcctgttttactttggacatccattctatcttgtaaatattttcactgcatgaaatatgtgccttagattttatgttgcaacaaataatatagggtttactttacaggcaccagttagaagacaaatgaaagctaagcaactcagtgcacartcttacggtgtgaccagttcaacagctcggcgaatattgcagtctttagagaagatgtcaagccctttagcggtaaatttttaaaatcacgattaatacaggagtgtaacaaaacttgatattattgaaaaatcttaattttgttattttttcaactttaacaggatgcaaaaagaattccatccattgtttcttctcctctgaattctgtaagttgagatttaaacctttttacaaaatattgttcatacaaaaattwgccgggtgtggtggtgcacacctgtagtcccagctacttgggaggctgaggcaggagaatcacttgaacttgggaggcagaggttgcagtgagtcaagatcrcgccactgcactccagcctgggcgacagagtgagactccatctcaaaaaaaaaaaaaaaggtatttttcataactccccatctattctaatagtgttttttttttttttcagcctcttgataggagtgggatagatatcacagattttcaggccaaaagagaaaaggtaaaacttctttagcatttagttatttaaactgtctacaattttgttgtgtttaaagttcacaagtatacaaattggatttagtttagacattagggaacatgtttgaaaaataatattctttttttttttgagtctcagtctcgctctgtcatccagactggtgtgcagtggtgccatcttgactcactgcgacctatggctcccaggttcaagcgattctcgtgccccagcctccctagtaactgagattacaggcacgtgccatcatgccctgctcatttttgtatttttagtagagatagggtttcaccgttttggctagactggtctcaaactcctgagctcaggtgatctgcctgccgtggcctcccaaagtgccgggactaaggtgtgagccactgtgcctgaccctgaaaaatagtattcttctacttggacattttactctcttctgcagtcctcaggacaatattgtatatgtagtagatactcatccaatttttttttgggctattcagcatttccatcttgaggatcttgacagactttatggcttactgttaccttttgataaataaaaataggagtgatcggccaggtgcggtggcttacgcctgtaatcctagcactttgggaggcccaggccagtggatcacttgaggtcaggagttcaaaaccagcctggacaacatggtgaaaccctgtctctactaaaaatacaaaaaaaaattagccaggtgtggcggtgcgcacctgtaatctcagctactccggaggctgaggcaggagaatcacttgaacccgggaggcggagggtgcagtgagccgaggccgcgccactgcactccagcctgggagacaaagtgagactctatctcaaaaaaaaaaaaaaaaaaaaaaagttcagtaaactaaagtcctcattgcacatcatcatctttgtatactttcctcattaaccaaaattttgtgaaatctattgtgtgtagtagaatttcaattaggcagatctctcatcagccaaacaaaatactgtttcaagatagtggaactgataaagttgatcattatatcttgctgcccttttaatatatcctatttgcttaaaattaactttggcggttactgtgggaaaaaaatacaatgtttgatagtttgggttaaagaggtatcttttgttagtttatttatagctggttaagcatccttcagggaaagcagactgttggatttttcttttttttcttttctttttgaggcagcgtctcgctctgtcacccaggctggagtgtgcagtggcacagtcgcagctcactgcaacctccacctccagggctcaagcaattctcctgcctcagcctcgcaggtagctgggactacaggcgcctatcaccatgcctggccgattttttgtatttttagtagagatggggtttcaccgtattagccagggtagccttgatctcttgacctcgtgatccgcccgcctcggcctcccaaagtgctgggattacaggcgtgagccaccgtgcctggcttggatttttcttttgaaaacatttcttgsaataccaagttcctcaaaagtaattatttaaattataattttatgaattaattgcaatgactaagatattgataaattattatctgtaatgaaattctgatgcaaagaaagctaatattgaactttttattggaagagtgttgcttctcaatttttggaattacctagacatttggaattaggcaagaaggaatctattagtagtttctatgatgggcttaatttaagctactagcttttctcaacccctcatttatatcaggttattttataataagaggtgaaattttaaaattatgtcataatgtaagttcttatcaataacagttttactaatggttgagtatcgtatccataaaagtttattaatgggtgctaagaaataaaaagccagaatacagtatcatagcccatgtttcacagatgttatcagaacagtctacaaaatagactctcttattgagttgtatgtaaggtcacatttgcgaagaggttttagggaagagttagtaaccatacagaggctttgccctggaaaccaatgttgttcacagctgctgctgaatgaaaggaccttattcataggattacagtctttggacagagttagaagcttctggctttatagtggttttataccaacaggatttttactatgtttcagtttagcaaaggactgttaacaaaacagttggtgtacttacataataaattgagttcattttacagtttggaagtcttaacagtgatttaccatttagacttacattgtaagatttttggtttggtttggtatttaaataacaatgggggaaataacttggagagggattcggtcacatttttgggagttaaaatattttcatagctagtttttttgtttgttttgggagactgactcttgctctgtctcccaggctggagtgcggtggcacaatctcggcccattgaaagctctgcctccgggttcaaacgattctcctgcctcagcctcctgaatagccgggattacangcgcatgccaccacgcctggctaatttttacatttttagtagagacgttttcaccatgttggccaggctggtctcaaactcctgacctcaaatgatccacctgcttcggcctcccacattgctgggattacaggtgtgagccaccacgcctggcccatagctagttttaaaatatcttatttgcagctcaaaaaatatggacagtaattcagggaaaatgtgacaaaagtacattttagttcatgcatttaaaattcactctgggccaggtgcagtggctcatgcctgtaatcccagcactctttgagaggctgaggcagaaggattgcttgagcccagaagtttgagatcagcctgggcaacacagcaagacctagtctccatttaaaaaaaaaaaaaaaagccaggtgagttgcctcatgtctgtaatctcagcactttgggaggttgaggcaggcagattgcttgagcccaggagtttgagaccagcctgagcaacatggcgagaccctgtctctacaaaaaaaaaccaaaaaaattagccgggtgtggtggcgcacgcctgtgtacacaggaggctgtggtgggaggatcacccaggtctcacctacagtgagctgtggtctgggtgacagagcaggagtccgtctcttaaaaaaaaaaaacaaaaaactgtaaaaggtttgatctgtagtgctgttttgaatatagttccattttgtatgcatgcatgtgtgtgaaaagtcattaagtctggaatgaaatatagagtatccgtgaagccattttagaattatatgtgtgtatatttatgtrcataggtatatgaatacataccttaggttccattattatcagtttttcctcttatttgtttgtatctactgtatatttctctgggaaatactcatggtctttaggtcatgttagctattgtcaaaatttagatatgaatcattgatttatatgaaaataaatgtttttgatttctctttacctgtaaggtggattctcaatatcctcctgttcagagacttatgaccccaaagccagtttccatagcaacaaatcgaagtgtttattttaaaccatctctgactccttctggtgaattcaggaagactaatcaaagaatagataasaagtgcagtgtgagtatatgtatatttctaccagtctttgaatattgattagaataagtaagactaaataatgtaaaatataactaccattgtattctagcaactgtataacacataaaggttgtgaattagtgatgattatgaattggtatgcttttaaaatagctgtcaccttgatcaaattttttttttttttttttttttttttgagacggagtctcactctgtctccaggggtggagtgcaatggcatggtctcagctcactgcaacctctgcctcccgggttcaagtgattctcctgcttcagccccccgagtagctgggactacaggcatgtgccacctcacccagctaatttttgtatttttagtagagacagggtttcactatgttggccaggctggtctcgaactcctgacctcaagtgacccacctgccttggcctcccaaagtgctgggattacagatgtgagccaccgcgcctggccactaccttggtcagatcttaagttagtgttgactagtaaactctagcatgtacccattgtttaggttacataattttgccggatttgctttatctgtttctttcatgtggtggtgttgaactatctgcaagtaaatttcagacattatcttttgaaccctaagtactttgatatgcatctcctaagtactttgtcctatattatcccatctaagaaaattaattctaattccttaaaattatctaatatccagtccatattgaaacgtttttcataattgcttttttgaaccaggactcgagcaaggttcagatactgcttttggttttgtttttccagacctcaaaccctcaccctggccacattggtttctgtttcttgagataattcacatatcatacaattctcctatttaaagttttcaattcagtggttttagcatgtttggaaaacactttataaataaagtggtgtctgtgagttgttcaactgttaagccatcataatggtaaattttagaacatttgtattaccatctctcccaccctttgaaaatctcatacccatacccgtcagtagccacttagcatagtgttttcaaggttcattcacgtcgtagtatgtatcagtacttcattttttccctttttatggctgaataatatttcattgtaaggaatactagattttgtagatatttcattgtatggatatactagattttgttttatccattaatcacttgaaggacattggggttggttttactttttggctgtaatgaataatgctcctgtcaacatttatgtataagtgtttttttgtgtgtktgtgtgtgtggacatgtttttatttctcttgggtttatacctagaaatagaattgctggatcataggtttttgaagagaccaggccagttgtcttataaaatgtcccataatctgggtttgtctggttttttgtgtcatttaacttgtatttattttgtttacttaacaccttattgtttatgcctttagttatattttatctcatttctaacaactcaatttattgaaaaccttgaaacttagaaagattagtacagtgatttgccatgtatttctttatgttgattcaccagtcattaacattttgtcatatttgctttatctccctccatacttttaagttaacattaaaattttgaaaaatattttgaacatagtgtgatcatggtggctcatgcctataatcccagtgctttgagaggctcaggcagaaggatcacttgagtccaggaattcaagactagcccaggcaccatagcaagaccttatctctagaagaaataaaaaaattagccagatgtggtggtgcgtgtctgtaatcctagcaaggcaggaggttgcggtaggaggatcacgtgagagcccaggagttcgaggmtaaagtgaactgtgatagcaccactgcactctggcttgggtgagagagtaagaccctgactcaaaatatatatatatatrtrtrtrtgtgtgtgtgtgtgtgtgtgkgtatttttttctttttagcataatattggacttctacagatttgcaagaaaaatttcatgaacttcacattttactacatttgctctatctttttctctgtgttcttattaacaaggagttcccttacataatgcatagcagtggtcaaacccagaaacttaacattggcacaacactgtaatctacagattctatttacatgttgtcacttggcctaaaagaagaaattctaacatcatgtcttgcatttagttgtcatgtctcttcatctcctttagtctagaacagttccttttgttttttgttcttgttgttttgtgtttcacaatattgataattttgaagtatagaagccagttattttgtagaatgttctgcagttttatgattgtctgatgtttcctcatgattagatttcagttacctacttttggcagtgaagaccgttgagggagtgtgctgagctgttctcactgttcagaaggcacaggctaccagtttgtcccattcctggcagtgtggttattacataaagtggtgtctgtgaggattctctactataaaattactattttacctttcgtaatgaataagtattttgtgggaaggaaacttcccaattatattcttttcagccactagtgttagcattattgatgattcttgcctgtatctttttgagcacttaattggtttttgatattataagataattcaggctcatcacatgcatttcctgccccagccctgtaatcagccatttttccaagaagtcttgattcctttcagtggaagtattaattctttaagttgtagggagctatttcgaaaggaatagctttgtatatttggttgcacaattaacaggacaaaaagagggataagtaaagtaattttgtggttaggttagtgagtgtattgtctgtatactaccattttattaaaataatgattgtgctcactgacatttttcatatatataatctcactgtaactcttggttaccattcagaaggcagggtgtaatttcaaatttcaggattcattaactaaaaagccatcaaattcctgattctaaatattaaaattaataggaagcaaggtggtactaagaaaattacaacaaataagcaaacgtaaatatgtgtgtatttcccctgcagactggatatgaaaaaaatatgacacccggacaaaatagagaacaacgagaaaggtactgtcatttcttatacagctatacttctttatatttaacttgtaaggtctgtatttaatttacatgtacctttttgaagattaaaatcaaagaacagaaactttatataaagaaatctaagattttagaatcacgttcagctgtatattttttttttacttgttagcagttctagttaacaagttatggaccacaataatatatcagttgttttaattttctttttatttgccagtggcttttcatatccaaatttcagtttgcctgcagccaatggtttatcttctggagtaggtggtggaggtggcaagatgagacgagaaagaacacgctttgttgcttctaaacctctggaggaggaggtagggttgtatactcatatactcttgaggtttatttaaaaagcattggtgtggtggtggtaaggggagacctgtaggggtggggttcgaagagacccagagcaaaattaatctgctattgaatcagttctttcaaaatgtatgctgaaaacctaatctagtaccttaaatttcatgggtatcatagaacaaaacaaaactacccatactttttcaaataagggaattgcaattgaaattatttgacccttggtattactgtatagttttgtctgtttgtaaaacatacgtaaataagttcataaataggattaatactatacgtattcttctttttttaagatacagtcttgctctgtcgctcaggctggagtgcagtggcgcagtctcggctcagtgcaacctctgcctcctgggttcaagcaattcctgtgcctcagccacgcaagtagctgggactataggcatttgccaccacacctggataatttttgtatttttagtagagatggggtttcaccatgttggccaggctgggtcgaactcctgatgtcaagtgatccacctgcctcggccttgcaaagtgctgggattacaggcgagagccaccgtgccctgcctgtcttcttcttgcttgcctgtttctccttttttgatgttgtattgtgaaaggtaactgtaagttttttaatttcactgcttatatatttatccagtttgaagatttaccgtaatccattctgccatcaggatacattttggtagatttctaatacacattaaagtgaatatgcacttttctgtctgcacacgtgcagtattttctctagagtatttatctaggaatggaattgttggattataggggatgatccacatcttctgctgtattagatgttgccatgttttctcttcaagatagttttgcagttcaacatttccaccatatgacaatagatagatcttggggcatccttttgtgtgttttttggacatttgagttttctcttgatccatttttttcctatggggttatttcctgtagggatatatatataatttcttatatgtatattaagaaatatgtatgtatatgtatatataatttattattagaaagagttctctatatattctgaccataaatgtttggaaaagatagggacagatttaagattggttacattaacctttctgtctatatattgctctttttttctaactactttaagttgaatgcaagtctcattttagttgtattataaatgcatttcagcttagcttaaccatttgagttttgatacatagtccttgtatttgtcatttgtttctaattaaaatttcaccagtgactccctcattgaccaatgagttttaggagtatatttttagctttttaaacatgcttttcctatttatattgacagaaacaaaatcatgttttggttgaagttgttggatgtcttagatttcttcatgcctattggtattttgctctgcaggtttggagtgtgatgccttgcttccttttaactatgcttttcctagctagcagtactatagctcaccagaattatgacctccttggcagttttcactttctgccatataaattgacttgtaatgagctttgggattatgttagtagacttggctctattgctggtctggaggctctgtctttcctttagtctctgtttctcactctactagagtgttgtgaagggagggaatctattactgtatatcattatctgaaaaggaaataccttgaatgccattgatcatacaaacagtatataaattttataggttttgtagcaaaccaattttcttttgtcattaaagctctttattaattatatttaagaaacgggttggcggctgggcacggtggctcatgcctgtaatcccagcactttgggaggccaaggcgggcggatcacgaggtcaagagatcgagaccatcctggccaacatgatgaaaccccgtctttactaaaaatacaaaaattagctgggtgtgatagcgtatgtgtgtagtcccagctactcgggaggctgaggcaggagaatcacttgaaccctggaggtggaggttgcagtgagccaagattgcaccagtgtactccagcctggcaacagagcgagactttgtctcaaaaacaaaacaaaacaaaaacaaaagaaatgggctgtcttaccttgtgtaaataaggaatttattaggttggtacaaaagtaattggggttttggaccatgaattttaaatcattatttaactaggctcaaacacatctttattgaacaaaacaggaaccactacaatcaacacatttttgccaacgagaaataaatttgcttattcttatagcacaaaaatctgtgctttgggattcgacaagctcttggaaagcattttctgcatcccgctgttgcggaagtgttttccctgcaaaaagttttcgagatgcttgaagaagtgatagtcagttggcgagaggtcaggtgaatatggcagatgaggcaaaactttgtagcccaattccttcaacttttgaagcgttggttgtgcagtgtgccattgggtgttgttgtagagaagtaggccctttcggttgaccaatgccagctgcagacattgcagtttttggtgcatctcattgatttgctgagcagacttctcagatgtagtggtttcgctgggattctgaaagctgtagtggattagaccggcggcagaccaccagacagtgaccatggcctttttttgtgtgcaagtttggctttggaaagtgctttgaagctacttcttggttaaccactgagctggtcgtaaccggttatcgtataaaatccactttttgtcccatgtctcaatctgagaaatggtttgttgttgcatagaataggagaagacgacacttcaaaacaattttttaaattttcactcagcttgtgagacacccacttattgagctttttcacctttccaattttcttcaaatggtgaatgaccatagaatggctaacgttgagttctttggcaacttcttgtgtagtttaaaaggatcagctttgatgattgctctcaattggtccttgtcaacttccagtgactggttattgtcaacttccagtggctggccattatgcttctcatcttcaaggctctcgtctcctttgcaaactttgttttttgttgttattgtgtgcttctttgggtgttttgttttgttttgttttgttttctgttttgagacagtcttgctctgtggcccaggctggagggcagtagcatgatctcagctcactgcagcctctgcctcttgggttcaagctatttttgtgcctcagcctcccgagtaactgtgattacaggcatgtgccacaggcccagctaattttttgtatttttagcgagacagggtttcaccatcttgaccaggctggtcttgaactcctgacaaatgatctgcctgcctcagcctcccagagtgctgggattataggcgtgagccatcacgcccagcctcctttgcaaaacttmtttaaccaccactgcactgtatgttcattagcagttctgggccaaatgtgttgttgatgttggcaagttgtctttgctgctttacaacccattttgaactcgaataagaaaatcgctcgaacttgtcttttgtctaacatcatttccacagtctaaaataatataaaataaatagcaagtagtaagtcatcagctaaaaaacataaagcaagaaatttgcattaaaatgatgtataatgtaaccacatttaagaatgtattccaattatcaagtggcaaattgttataatgcaaaactgcaattacgtttgcaccaacctaatatctgattcatataccatgagcttattttttttgacaagtttttacatttcctggtaaaatctgtagcatgttttgtgaagtttatctctgtatgaggaaaatacaggttagctttatttgccagatgatgcattgtatagatactgctcatttcccttactgcctgatgagcacagaagccaataccatggcaccaggttttgttttgttttttttgagacagggtctcactctatttgttgcccaggctggagtgcacgatcttggctcatggcaccctccacctcctgagttcaagtgattctcatgtctcagcctcccaagtagctgggattacaggcatgcaccaccaaggctagctattttttttttttttatttttttatttttttattttagtagagacggggttttgccatgttgtccaggctggtctcgaactcctggccttaagtgatccccacccgccttgcttcccaaagtgctgggattacaggtgtgagtcactgtgcctagccagaaaataatttttagtataccggacaaataagagcaaaatattattaatattaataaactgttcagtacagcaaagtcacaccaaacatgtatctgcaagacagccaaaactaagctataaataatcaacctgagcttcagccgaagatctcagaacttttatttttaaaaactgaagctgaaggtgaagccatgctccaaagaattaaagaaatcagtggctaacaggtattcttgaacttacaagatggcagataagaaacagcttgctaaagccctctccacttgcaagataacaaaactgactgaaattggctggaactaatatgaccaactagagtctgtgcagactgagcttgctgacatcacagcccaaatttccacatttcattccagctactccagaatttgcacatgtggcccataaagaggcatgaagagacaactgtgcacgtcsaaggacttttcagacttcctctttccttccccagaatctaccccctaaacctttcctaataaacatactaccttaaggccaatttgcggggagacagatttgagctggactcctgtcttccttgttggttatctaagtaaagctttcctttcttcaaaaacctggtgccccctaagtttggaggtttgcttgagcccaggagtttgagattagcctgagcaacatggcaaaaccccacgtgtacaaaaaaataacaaaaattaaccaggcatggtggttagcgcctgtggtcccagctaccagggaggctgaagtgggaggatcaccccagctggggagactctgtctttaaaaaaataacaaataaaaaaaactcctcttcactcatgtttgtatcacctcctcccctctttgggcctcttctcttcattctggccaactgccaattttgtgtcacaggattcttcacccagtccttcccatcactggctctgttccaccctgaagttataatgtccacatttctgaggaaagaggtactaatgtgatgttggccccacactttctgcccaccttgtggtttgtttgtttatttatttgtcagagtcttgctctgtctcccagggtggagtgcagtggcgcaatcttggctcactgcaacctccacctcctgagttcaagcaattctcctgcctcagcctcctgagtagctgggattacaagcgtacgccaccatgcccagctaaattttgtattgttagtagagatggggtttcaccatgttggccaggctggtctcaaactcctgacctcaagagatccacccaccttggcctcccaaagggctgggattgcagggttgaaccactgcgcccagccctaccttgtgttttatatctgtatagaataggtttggatacacaattatatagttgttttgaatgcagtgctgcttgtttgcatcagaagtcagatatgttgagaccacaaattgtttctttcttcagttataattagtgggaatttttggtaaaaaattaaaagattggctggtcacggtggctcacacctgtaatcccagtactttgggaaggctgaggccggcagatcacctgaggtcaggagctcgagaccagcctggccaacatggtgaaaccccgtctctactaaaaacacaaaaattagccgggtgtgatggcgggcacatgtaatcccagctactcgggaagctgaggcagaagaatcgcttgaacctgggagggggaggttgcagtgagctgagatcgtaccactgcactcctgcctgggtgacagattgagactttgtcttaaaaaaaaaaaaagtaataataagattaaagttatttttgtgggggcggcattttcatgggcctttggaagagtgacatggaagagatttagttttaatgaaatgtaaacacattatgctaactgatttcagatagtgttgctatttagcaggaatggatgtattctgatccattaaattcaggttaatagaaytctatatgtaaaattacccatttggaatgatcttttacctttcaccttatcctggattctaaaatgtgcaaggattgtagtcattaaatatattggccttttgcttttactgtcctaccaatcaatccatgagtttttttgtgtgtgttgttaaaaagctcattgatacaaaacatgtagcagtatacaaaacatgtagcagtatataagaagacttgagtttggagagacttaattgcttgctcttgtcttgtataatcctgccacttactagctgggtgaccttggtcaaattaacctcttgtgtacctcctcagtttttttatctgtaaaatggaaataagaataaatattgtgttcatgtctgtaagatttctgccacttaatagctgtatggtattatgccatatatctccctgccttactttcttcatatgtaacaatagtatctacctcatatgagataacccatgtaaggatattacaaaggtattagatagtgaattgtgaaatgtgtgttctacttgagatgtctctaagcatcaagttagcagaattcttggcttttttttcctcttagattagtgggacccacttatgatctactaagtcaaaatttgggggagtagaaatcaaatgatagaattggttcaaggtcagctgggcgcggtggttcatgcctgtaatcgcagcactttcggaggccgaggtgggcggatcacgaggtcaggaattcgagaccagcctggccaacatggtgaaaccctgtctgtactaaaaatacaaaaattagctgggcgtagtggcaggtgcctgtagtcccagatacttgggaggctgaggcaggagaatcggttgaaaccagaaggcagaggttgcagtgagccaagatcgcaccactgcagtccggcccgggcaacaagatcgaaactccgtctcaaaaaaaaaaaaaaattggttcaaggtcagtaatataaggaaccagtgtggacaagtgtgtgccttaaggagttggcatgagagagtagattatatagttgatgtttttagggttctacgctggaggttggacagagaagagaagcttccctacaaaaatagccagatgcatcttttgtttgttcctcctccctcagttgattatgacaaatttcaaacatgaaatgttgaaagaactgtgcagcgtatacacacagtagcagttagattccaacattttgtgttacatttgctttatcaaaaaagaaaaatttacctgtccatctttttttattttttggtgcattttaaagatagwtgaagacattagtacacttcacccccaaatacgtcagcatacatagcgtgaagtagagttaaatatttgttgttctttttataacatagcaaaattgacatatagtgaaatgttaaattcttaggtgtgccatttaataaatttgacaaatgcttacatctgtgtaatgcaagccctatcaagagattgaatatttctatcatcctagaaatttcagttgtcctccttctcagtcagttgccgtcacctcctaccccagaggcaatcactgttctcattttttccaccatgtattggtttcacttgttctgcaacttcatatagttactcactatgtatccttttgtccctggctattgtgagtaaagctactaggaacattcttgttcaggtctttttgtaaataaatttatttctctggggtaaatacctggaagaagaggtgctaagttgtatgtttaactttctaaggagccatcatactgttttctaaagtgtgccattttatatccctcttagcagtgtatgaacattttatttagtttgtatccttaccaatagttgatagtcatcttttaaattttagtcattctggtttgtgtgtggtggtatctcattgtaattttaatttgcatttccttgatgactaatagtattgtgttcttttttatgtgctcattggccatttgtgtatctttttttgtgaggtgtctgttcagttctttttttgagatggagcctcgctctgtcgcccaggctggagtgcagtagcacgatcttggctcactgcagcctccacctcccaagttcaagcaactctcccgtgtcagcctcccaagtggctgggattacaggcggacactgccatgcccggctaattttttatatttcattagagacagggtttcaccatgttgcccaggctggtctcaaactcctgagctaaggcagtccacccgcctcggcctaccaaatgctaggctggagtacaatggcgtggtctcagctcactgcaacctccgcctcgtgggttcaagtgattctcctacctcagtctccctagtagctgggattacaggtgtgcgccaccacgcccagctaatttttttttttgtatttttagtagagatgggtttcaccatgttggtcaggctggtctcgaactcctgaccttaggtgatccacctgccttggcctcccagagtgctgggattacaggccatgagccaccgcacccagccagctgtcttcttactgagttttaggaggtctttataaattttggacctaggtactttgtcagatacatttcttaacaaatatttttttcccagtgttgcttgcctaytcattttcttaatgatatcttttgattggcagatgttctaaattttatgaagactggatwtttttttctaatatttttattcttctttgtgtcctaagaaaattttgcctatccccgggctacaaagatagtttcctgtgcttgcttctagaagcattgtaattttgcttttatagtttttctaatttcttttgatttttgtatttgacccatggattatttagaaatgtattgaatttcctaatatttgggggggagggtattgatttctaatataatttcattgtgattagaaaaagattgagattatgacttcagtgttttgaaatgtattgagacttgttttatagttcactgtatggtctgcttgataattcttaaagaaaatatattctgtagttgttgggtatagtgatctgtagaagtaagctgatagtattagatctttgttcttattcatttttcatggggagggagggtatggttagcctgttaaattattgagagatgggggttaaaattgccaacttttatttggtgaatttgtcttatccccttggttatttatttatttatttatttttgagatgagatgtcactctgtcacccaggctggagtgcagtggcgtggccacctgagcctcccaagtagctgggaccacaggcatgtgccatcatacctcgccaatttttaaaattatttgtagagacaaggtctcaccgtattgcccaagctgatctcgagctcctgcgctcaagcgatcatcccatcttggcctctcaaagtgctgagattacaggtatgtgctaccatgcctaacctcaatttttgtttcatggattttgaggccctcatgagagcatacactttacatttattctatggctccatagtgatttgtccttttaatattattaagtgtccttttaaaaaaaacttttggaaatattttttgtyttgaaatctactttggtattaatacagccactcttactggaataagccttcttatgcttagtagtttcagggcatatctttttccattcatatactttgagcctgtccatgtttatatttaaagtaggtctcaggtaaacaacatataactgagttttgcctttctgtccattttctgtgttttaattggaacaccaaatccatttatagttaatataatttttgatatggttggaatgagggctatcattcatccactgttttctgttgttccttttgaaagctgccatttgggggttaagggaatatttattatttaattatttaatatttattattataattctgtttttattggttttgtttttgttttttgagatgggttcttgctgtcacccaggatggagtgcagtggcacagtcatggcccactacagcctcgaactcctggactcaggccattctcccacctcagcctcccaggtactgggactacaggcatgccactgcacctggctagttttttgtttgtttagtttttatagagacggggtcttgctgtgttgcccagactggtctcgaactcttggcctcaagctgtcctgccttggcctcccaaagtgctaggattacaagtcattttaatttatttgttagatttttaactctccctcttttgcactatttagtggtttctcttgggatttctgtgtcttccataatgtttttcagattactttatgttactttcataccacatcctgtaaaaataacaagattgcagctgtgtagttagatttactacctgtcttccctggcatttatgctgtacttacttgtattacatctggagaggctgtaaattcaatgtgtactttttgctttatatagttaaatatattttaaggaaattaagagaaaaaagtttttgtttgctcacatattcctcatgtctttctgaaatctgaattttcatttggtaacatttcctttcagcatgaagaacttgtagagcaggttttatagaagtagattctttgttttatctggaagtgcctttattttgctttgggcttttggatcaattttattgagctgtgatttatttgcaataaactgcatccatttgaagtattcaaattattttagctggcaatggacttctctgaactcattctgtctcccctgtggtaggcagcagctgaaactttttagttttctttggcagcttggagtctgccttacagctgtgtagtttacaggtccaccagagattcgggtggcttatatgtagactttgaggttccctttctgtggctcttcatttctgcatctcacctccttttctggctgattgttcagttaacacgtttgctgttttctctcagaacttcaggtattcagtggcagcaactcatgaagagaacaggaagcttactcagtgcccttcccattttccaagtgtcctctcccatccagtttcttcttgcttttggttgctcttgtgccttcagatgattgtttctttatacttttttccagagtttatcatatatctaaacgtttatcaggtagaagctactctgcstttagcacaagtggaactcattttgtttgttctttatctagggatcattggagacttagggtgctctttgttcagttgggttaaaaatcaaagtggctctccagactcctcagtactgacagttactaaatgcttgtttcacatgccaagaccatataatgctccccctcacccccttatctgcaagggatatgttccaagaatcccaggtcatacctgaaactgcagataatattgaaccctgtatatactgtgttttttcttatacatacatatctatgatgaaatttaatttataagtaggcacagtcagagattaacaacaacaataaaatagaacaattataacactataatgtaataaaggttatatgaatgtagtctctttctctctcaaaatatcttattgtatataatatctttggatcatggttgaccatgggtcagggaaactggaaattgaaaccatggataaggtaggctactatatataactttatgtttcatattagtacaacaactgtagtatatcgtaagaattactatcttttttccctcagttttaccaattaggaaattggtacagaaggcagttaggttccccaagtcaaatggctggttggtggcacagctgggattaaaaatcatgttcagtttttctgattgaagaacccataatgttaacactacatggtaccatcttcttcctgtatactttcatgctgaaaataagtagagataaaagaatgatgtgaaagatgaaatatatcatgcaacatgttatgttttaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaaaccattatataaatacaggtgacatttgttctttcttaattctttatttaaaaaaaaccctatattataaacagtgtttaattttcattatggaaattaataacatagtaaacagagaaatggaaatgctgttttgcttttttaaaaaaatgtacaaatatcttggatacattataatggagtgttcctcaactcttatgcaataccatagagaaggatattcttgtaaatttgtttccaaataatgtttccagtaagatgctttttgggtaggagtgcactcaatgtttcatgtttttacttctcagctaggcgtaacatcttttaatgtgctcctgaatttttttttttttgagatggtgtctcgctgtattgccgaggctagagagcagtggtgcaatcacagctcattgcagcttccatctcctgggctcaagtgatcctcccacctcagcctcctgagtagctgggactacaggtgtacaccaccacacccagctaattaaaaaaatttttttttaaatatttatttattttttcagcttgagtctcgccctgtcacccaggctggagtgcagtggcacgatcttggctcactgcaacctccacctcccgggttcaagtggttatcctgcctcagcctcctgagtagctgggattacaggtgcgcaccaccatgcccggctaatttttgtatttttagtagagacagggtttcaccatgttggttaggctgatcttgaactcctgacttcaggtgatccgcctgccttggcctcccaaagtgctaggattacaagcgtgagcccccactcctggccaaaaaatatttttatgggtgaggtcttgctgtgttacccaggctggtcttgaaatcttgcgttcaagcaattccctctgtcatggcttcccaaagtgctgggatcacaggtgtgaggcactgtacctggcctgctcctgaaattttaatacttgctttcttgctttcacttcttctgaacatattcttatagatgttactttacttttttatacaaatatccacctctaagattgtgtgtactccttagaggaagccacattttataacacagttctgtgtttttcagaatttaaagtgagatttttaaatttaaaaggaaaaaatacttagtgtctttggaataatcagtttgcttaatgtcttttttgtcactttatttttctaaaaagctctttttgtatcatttcttaataatttggaaaaccaggtacaaatgacctctccgagcagcactggcagtcccatgtttaaattttcatctccaatcgtaaaatctactgaggcaaatgtactacctccatcatctgtaagtaacaagcaaggaatagtatatatttactgatttcaaagccatgttatatttttatcaaatctaagatgccactggtggtgagaaacactgttatttttcttccaacttaaaaaatactctgtgtaaaaaacttttgaacaatcatgtattcttcactacataatgtacatatgtatgcatattcattttcttctgtaccatttgaaagttaaaatgcaaacaactggatttccttaattcttctccatgtgtcccttaagaaaaaagacattcctttgcatccccacaatacagctatcatacccaagaaatttgacatgatataataacgacatggtccatattcagatttccccattatccccagactgtcctttaattgctggtttatttctgttggtcctagagccaattaaagactaggacctaatcaactacatgatattgcatttagttaaaacatgtgtcttgatttacctttaatctagaaaagttctgggcatttttttctttcatgattgaaaagtgaatgtttggggtaagaataacacgtagtttaatattcaaattgccccagatttggcatgtttatattattttaatatgtcattttctagttttgactgtgtccttgtcttctgacacaagtagatgttacagatcaaatgtaatttccttgccacatgctgaaatccatcagttgccccagaagtgtcatactttttattagaaaatggcatttgaggccgggcacggtggctcatgcctgtaatcccagcactttgggaggccgaggcaggtggatcacttgaggtcaagagttcgagaccagcctgaccaacatagtggaacctcgtctctactaaaaaaaaaaaaaaaaaaagaaaatacagaattagccaggcatggtggtgcacgcctataatcccaactactcaggaggctgagacaggagaattgtttgaacctgggaggtagaggttgcagtgagccgagattgtgccgttgcactccagctcaggcaacaagagtgaaactccacctcaaaacaaaaaaaaaaggaaagaaaatggcattcagaaattggaactgggcattaggaacacaccatcattattttatatactgttttgaaagaaaaagtgcctgagaaatttaaaatgctgcctgttaaactgtgacattgccattcaatataagaatctcacttttagagatagtgaaatattataaactatatcttaaaataggtgaaagtatgtttttgacttgggataaaaataacctctatatttgggccaggcgcggtggctcacgcctgtaatcccagcactttgggaggccgaggcgggcggatcacaaggtcagtagatcgagaccatcctggctaacacggtgaaaccccatctctactaaaatacaaaaaattagccgggtgtggtggcgagttcctgtaktcccagctgctcgggaggccgaggcaggagaatggcgtgaacccgggaggcggaggttgcagtgagccaggattgcgccactgcactccagcctgggcgacagagtaagactccgtctcgggggaataaaaaagctctatatttgatacttattgaaaacgaagtataaggatattctttctctttacagattggatttacatttagtgtgcctgttgcaaaaacagcagaactttctggttctagtagtactttagaaccaattataagtagttcaggtaagtaaaaatttcttacattttaacatacaaacaattgcatacagtagattagtatttcagcttctttcacctttggtaattcttataaatgccttcatttggatgaaattagctctgaaaagcaagcaggcactattatttaacctttttgacggtgctttttattaattatctttagagatacttagctccttaaatggaagtgtcagtttggttttgagagagataggcatggtagcaaatttatccactatctttgtttagtcaaaacaaggtgacaagttagttataaagcaagtctcattataagaaatttataggttgtctacattatagttgtagtagrttttatttctagtttttacctttcagttcacaagcatttttatgtataaaggttatgcaggcccatgtagattgtgatacataatttctgaaccgaagaaatcagcatcattgaaggaaggaggccatgggtcattcctgtaaacccagcagtttgggaggctgtggtgggaggattgcttgaggccagaagctcaagacgatcctaggcagcacagtgagactcatccctaccgaaaaaaaaaaaaaaagaaaaagaaataaccaggtggtggtgtgagcctgtagtcccagctacctgggatgctgaagtgggaggattgcttgagcccaggaattcaaggctacagtgagctatgattgcactaccacactacagctggctgacagagcaagaccctatctcaaaaaaaaagaaagaaatgaatgaataatcagagaattaaaacatagaattcttttttttttttttttttgagacagagtctcgctctgttgcccaggctggagtgcaatggcacggtcttggctcactgcaacctctgcctcccgaattcaaacgatttctcctgccagtagcttggattacaggtgcctgccaccctgctggctactttttttttcttttaattgtgagacggagccttgttgtgtcccccaggttggagtacagtggcgtaatcttggctcactgcaacctccgcctcccaggttcatgccattctcctcctcaacctcccgagtagctggcaccacaggcgcctgccaccacgcctggctaatttttttgtatttttaatagwgacagggtttcaacatgttagctcggatggtctcgatctcctaacctcgtgatctgcctgcctcggcctcccaaagtgctgggattacaggcgtgaaccaccgcgccctgcccctggctaattttttgtatttttagtagagaggtgtttcaccacgtttggccaggctggtcaggaactcctgtcctcaggtgatctgcccaccttggcctcccaaagtattgggattacagacgtgagccactgtgcctggccgaatttgtttttttataatggtggttttcttttaagtgtttgggaaaatcagaaacacctgagctgagttactcaggtcaagaattttgagcaagggcattttacccaagaaatataaacacaaagctcaagggcacaggaacaagagaaaaagcatgacacgctttagaattgcaaacaatttgtcatgaggttggagaggtagctttaaatcctaaaagttctggaatgctatgctaatgaattggattttattctgactgcattagggagatgttgaatgatttttacttgggggtgagatggatgtgagtatagtgatagcagtgtggtgagtgctagtgtgggttggagtggcatgttagaggcagaaacatgagttgggagatattaccttatcgaaaagcgtttcttcaatgatcttctgagtttgggaatttttaaaaactagatcctcaaaagatagattaaaaaataaaaagagtcaggacatagaagctaaagaaatatctttggctttgaatggtcttgaagataagaggccagattatggaagtggcccaaactaagaatttgactggtatgtttgcaaccttatcttttttttttaattggctaacacagccttacgtaatagaaattaataaggaatttccattgtgtttcctgtcacaaaagttttttttctttaatgttaactattaattcaagaggattaaatttcttcaaattaccaatttcatgacttattatgaggaaaggcattaaaatgtttcccactatttgctaatgctttactaatgataactgaataattaacaatttgttacaacaactttgtttcattatatctcaggaagttacccagatttttaaggagtcgattatgagtggcctatttagagttgtgtgttctcactttgacaccgttggttctcaccacttctatcatttaaaaaagctaattgaaaatgtggaagtcatgattactttgtgacaggagctaagttttccattgtctccttttcccctctttttgagcatactttagggaatcctaacattttaccgtaaattactaaaagcaatttaactttcattataaaggaagatagaacgtgattaaattataagtttgttttggcatagttgtacgagtggtggttatttttggtggggatggttgggggtgggtgttgcacattctgtcacccaggctggagtgcagttgcacaatctcagctcaccgcaacctccgtctcctgggttcaggcgattcttgtgcctcagcctcccgagtagctgtgattacaggcacctgccaccatgcctggctaatttttgtatttttagtagagaaggggtttcgtcatgttgccaggctggtcttgaactcctgacctcaggtgatctggccgcctaggcgtctcaragtgctgggattacaggtgtgagccaccgcgtccagcctatatttttgttattgtgatgaagttgacatgatacagccattttaaagggaataattcagtggcctttagtaccttgacagcgttgtgcagccaccactttttatctagttccaaaacatttatcaccctcaccaggaaacccctgtccattaaaaagttgctccccattctgccttccccctagctaactgtcaacttgtgttctgtctctatggattgacttattctgaatatgtcatgtaagtagaatcatacaatgtggcttcgtacagctgagttctttcacttagcacagtggtttcaaggttcttatgtctcaatacttcattccttttatggctgaataatattccattgtattgatgtgccacagtttatttttgttcatccattaatggacatttgggctgtttccaccatttggctattgtgaatagtgctgctgtgaacatatgtgtatgtgtatttgtttgagtactggtttcaatgctttttcatatgtgcctaggaatggaattgatgggtcagatggtagttctgtattaaactttttgaagaatcactaaactgttttccacagtagttgaaccatgtcacattaccattagcagtatacaacttcaccaacacttagtattttctcttttttgactatagcaatcctagtggatgtaaagtaatactttgttgtagttttgatttgcatttccctaatgcaaatgatgttgcatttttttcaggtgcttattgtccatttaaatatcttagggaggaatgcctttcacgtcctttacccattgaacagtttgtctttttgttactgagttataagagttcttagtctggacactagacccttaccagatacgtgatttgcagatattttttcccatttatagattgtcttttcactttcttgataatttccttgaatggacagaggtatttaattttgatgaagtccatttttttcttctgttgctgtgcttttcgtgtcatatctaagaatacattgccaaatccatggtcttgaagctatactccctaggttttcttctaagagttttatggtgtttatgtcatatttaggatattgatccattttgaatttttgtttattgtgtgaggtagggaaaggtttttttcaaaagtactttacctactactttttaaattggcaaacacttaaaaagaaaaacttggttattagtatatttcattatggaaaacttgattctcagaagtagaattgtagactgaatccccatatactatttagccagcttcaacttttaccattttgacccatcttgtttctttttctttcttttttttttctgagacagagtctcgctctgtctcccaacctggagtgcagttgtgcaagctcgtttcactgcaagctccacctctcaggttcactccattttgcctcagcctcctgagcagctgggactacaggcgcctgccaccacgcccggctaatttgttttgtatttttagtagaaacggggtttcaccatgttagcctgggtggtctcgatctcctgacctcgtgatctgcctgcctcagcctcccagaatgctgggattacaggcgtgagccaccgctgcctggcctttttgtttgtttgtttgtttgttttgttttgtttttgagacggagtctcgctctgtcaccaggctggagtacagtggcacgatcttggctcactgcaacctccgcctcccaggttcaagcaattctcctgcctcagcctcctgagtagctgagactacaggtgtgtaccaccacacccagctactttttgtatttttagtggagatggggtttcactatgttggccgggatggtctccatctcttgacctcgtgatctgcccgccttggcctcccaaagtccttgggattacaggcacgrgcccccgtgcctggccgcatcttgtttcttattgtttcttttgttccatccctcctctccccatcccacacagaaacttacatgtcaggtcactcttcaacaatcccaaacatcttagttttatctgtaaatagaaatcgccccttaaaaatataacgataaaaccattatcacactgaaaatgtagatctctaaatacaaggatgcaagtttagaaagcataaaaagtaaaagcagtaagtcactcatcttactgctagcagctaccattactctttagatgtaaacattctagacttttcaacctgcttttacccrtaactacacttttaagaatgatttttgtgggccaggcatgatgactcatgccagtaatgccagtgctttgggaggccgatgtgggaggatcacctgaggccaggagtttaagaccagtctggccagccatagtgagaccccatgtctacaaaaaagtaaaaaaaaaaatgagctagatgtggtggcatgcgcctgtgttcctggctacttgagaggctaaggtgggaggattgcttaagcccaggagtttgaggatgcattaagctatgattgcaccactgtactccggccttgctgacaacaagacactcactctctgttttgaaaaagaatgatttctgtggctgcataagtatttcatcatgtcactgttatgtaatttatgtaaccatatacccttatttaatattttaccatataggttttcaatattataactgaaggatattttcaattatattaatagtgtgaatttctaaaaatgaaataattgctcagttgaaaattactttttttgattagttttgtaaattgttgtgtaatcagatatttcatgcagtggatgggcttgccctagttgccatatcctctccagttttttagtttgattgttttgattatcagtcagttaattggacgataattatagtttatatttttttgcctttttattggtgggggaagttatatagtatgggaatagtgtttttatctccttgtaatggcaaattatccctgtaaagtcatttgtttattgaattaaagtgacttttttcatgaacttttagaaattaatccaaaagatggttttgaaagatttttaaaaatgcatttgagagtccagtgttttatttggcataatgttattaaatttaaaaaaattacagctcatcatgtcactacagtgaacagtacaaattgtaagaagacaccacctgaagattgtgagggtccttttagacctgcmgaaatcctgaaagaaggaagtgttctwgatattctgaaaagccctggtaagataattaaaagataagccttttgattacaaactcatgatctcaatttaatgtcattttgtattatactttaggcttttaaaaatttctgactagtttggtaggagatttacttttgaatagagatgtagttaggtgtaattcttttgctggaaatatcttacaagccaaaggactctatactaaaatgaaatttctaataggcaagtgtaggaggaggaaatggattctccattaatagaggtaggtcagtgaggaataagagtaagtaaacctgatgatacacatagacatgtctttctcttatgagagcactgaactgccttcttgaattattccccagtttggtaaatatggaacaaggccaagtggaaagcatctgctgaattgtaacatatacatagggagcagtactcacttgaattgaagcaagatttgaaagctagtaggtaataattagaaaggggataaatagttctcagataagaataattttttgtttgaaaacaggatgttcataattccatttatgatacatagtataagaatgtaaaacttgccaggcgcggtggctcacccttgtaatcccagcactttgggaggccaagacgggcagatcacttgaggccaggagttgaagaccagcctggccaacatggcgaaaccccatctctattaaaaagagaaaaaattagctgggcgtsctggcatgcacctgtagttccagctactcgggaggctgaggcaggagaattgcttgaacctgggaggtggaggttgcagtgaaccgagatcgaaccactgcactccagcctgggcgacagagcaagactctgtctttwaaaaaaaaagaaaggaaaagaaaaaaagaataaaagaatgtaaaactgtgagataatctaatagctcagaaagaatttaaacgtacccaccagatgtgtccatgtgtaataagataggttttcttaaaaaataaggttggcttttacaacaggatttagaaggattcaatttttctggtccagctctctcattttatagataagtatactgcctacaggagtccagtagcttggacagttccatgcagttatggtagaactccagagtgcttgtgctggaattaaccaagtagtaggcaagcctcaaatgtgtatagtctgtcttgtgtatctggggttacactttgcattcatgatgccaacctccccctgctccctttttacttcttaaataggaaatgtttggggagaatcttcatttgactgaaattaggaaaatctgaaaaagtagaagaaaaagaaatctgtaatgccttgagatggttactgttaatatcttgccaatcttagtgatttaaattaatcataagcaaaataacacgttgcccactgggaataactcaagcatgtggtattttgtccttaagctaaaaatagctctaggctggattattytgtggaactagaaaacctctaataaccttctacatcttctctccttttaatttctttttctttggcgggtaaggctggagaaacagatcacagatggtggtgttgtgtgtaagacaaaagttaactggtcctaagtaaacaattacaaaagtcattctcatgagtaaaatacagcttgagtgaatgaactcaatgacagcagttttggtaacagaaggacttgctcagctgattttactgaaggtagagaataccacagcagtaggttatgactggacaaaattcaaagatgacattgaagccatttggtgtagccaatggaacacttaaaagaagaaatggatgaaggagaaagaggactgcgagtattgtgtgtttgtagagagacagaatatagcaaaatgtggatggcaataatacatatcagtaaattagtaccattgaaagcatcaaactagaaattccttgaaggagaaggtgatatcctgtaaacaaaacatcttttgtagaattttaaatggtttaagtgtaacttattaggtaattgataaatatgattacttaagtgaaaaacaattcttaagtagttcatcttggattgtagtaagtgtgcagtgaggtaaacgtcttctcagtaataataatcaaattaatgctttgatttataaagcttctctaacgttgcactctctccttcgttcattgtaggtttcgcatcgccgaagatagattctgttgctgctcagcccacygcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggtatgtttttggctttatggagtaattttgcttattacttctgttgaacagtttaatttattctaagaatccttgttttagatgtttcaggatgagcatttctcatacatattaatttttctaaactatcttgaggtaaaaatgtcttgtttgcagctagatctttatgttcagttaggataggttatgtgttaactagtctggtatatatgacgacctcctctttttgtacagttttatcagaaatttcttgttcaaagttgactaatacagattctgaaagatcttagaatggggtaatatttctcaaacctttgtacagagtaaaatattacttctccaaatagaaatcaggatagctagtggtcatttacagggaaggtttctttagggggtagactatagtcgttaatgaaaaggctgtagctgttgcaatgattgtaaattaccaaatcactaattctaatctaggcagccagaaacatggagttagttttgagttttttctgtttctctgttcaaagttggaagaattagtgaagattcatattgaatctttaactcatccagaagtggatgatggttttgtaatattatataattatatggtacagatgtatgataacatggatatcctgggaattacactgttttcaatgcattattcatgaatatgcagttttgtgtctgtaatgtacagctctgagttactaacctagaccttttgcctgagccctcatgccatatttctgattcctactggatatttccctatgagtaagattttagaatcttcattcctttttttttttttttttgagacagagtctcactgtgtcacccaggctggagtgcagtggcacaatcttggctcactgagacctccatctcccagatgcatgcaattcttgtgcctcagcctctcaagtagctggaattacaggtgcatgccaccacacccaactaattttttgtatttttagtagagacagggtttcgccatgttggccaggctggtcttggactcctgacatcaagtgatctatccgccttggccttccaaagtgctgggattacaggcgtgagccaccatgcccggcctagaatcttcattatgaaatatttttgtcttcccatctggttcccctgctcacctacaaaaagaaagcccttgatgtatgcaggaaagcaaaattaattttaagttgaaggggaataacaaaactttgagtcaggaagtaatttgttacacatgaacaaaggaagctcacatatgtattaaagaacttggatgtcctcctttcaatgatgaaccatcattttcagcagaggagtgatacagtcaagtttgtatttttgatgagtcactggctttttagataatggatttgaaaacaaaaaaatttggagaccggaagatagattaggaagtggtatcaatcatataggcaataggccagacactgtggctcacgcctgtaatcccagcactgggagaagccaaggcgggtatattgcttgaacccagtttaagaccagcccgagcagcatggtgaagcactgtctctacaaaaaacacaaaaattagcctggcttggtggcacccgcctatagtcccagctacttaggaggccaaagtgggaggattgcttgagctcgggaggtagaggttgcagttacctgagatcatgctactgcgcttcagcctgggtgacagagtgagaccctgtctcaaataatgataggccgggtgcggtggcttacacctgtaatcccagcactttgggaggccgaggcgagtggatcaccaggtcaggagattgagaccatcctggctaacacagtgaacccctgtctctactaacaatacaaaaaattagccgggtgtggtggcgggtgcctgtagtcccagctactcgggaggctgaggcaggagaatggtgtgaatctgggaggtggagyttgcagtgagccgagatcatgccactgcactccagcctgggcgacagagcgagactccgtctcaaaaaaaaaaaaaaaaaaaaaaagataagycaagctgtgcaacctgtgggctgcatgtggcttaggatggctatgaatgaggctcaacacagatttgtgaattttctaaaacattatgagattcttttgcgatttatttttttttttattttttaatttgttttaaagctcatcagctgttgctagtgttagtatattttacttgtggtccaagacaattctttttgtccagtgtggactagggaagccaaaagattggaccacccccrcctcccctgctgatacaggcaatagataatgtactgatygaactgaataaggaatggaggacatamaattaaagacgttgatttcaagctgctgaagtcaacattcagatgtatgtaatgtgaccaggcatggtggctcacgtctgtaatcccagcacttcgtgaggctgaggcaggcagatcacctgaggtcaggagtttgagaccagcctggccaacatggcaaagccctgtctctactaaaaatacaaaaattagctgggcgtggtcgtggatgcccgtaatcccagctacttgggaggcagaggcaggagaatagcttgaacctgggaggtggaggttgctgtgagctgagattgtgccactctactccaccctgggcaacagagtgagactctgtctcaaaaaaaaaaaaatgtatgtaaggcctttggatacaccctttgggtggagatacggatttggggtcattaatccatagttttgatatttgaagtcatgagagtagagttgagtgtgttcactcaagatggcctgaaatgaaagtccgctaacttacagggagtggcaggaataaagcttttgaacagttaatcttttaaaaaggtgcaaccagaaaggaaaaacaaaaactacatggcactggttgcttcagaggaagatggatttcaaaggaacaggatcagaggtctcaataaaaaagctgttactcaagcaagagatgggttagtggtgggagtaatggggggggttcatgaaccagaatagcagtagaagagtcagaaattgattgaaatagatttgagaaaaatgtagaggaggaggagtatccagccaagctaaccaagtaagacagtggagtcaccaactaagagactacagtgacaagctcagaagtgtagattgcaggtgtagattaggaaactgttttttggggatttaaaaaccactggagtaaatgagagtttgtgaggacagtgggccaagatggaaccccagggagcaatttggttggcaagatggaagagaacatacctataaaatgtagagatcagttaggtaactatggaagaggtggcgacagttgtaggccatctagagaagtaggaataccagaatgaatggcttcactgtcagcactatattttgggccttaccaagccgttcttcctgtgccacctctcccacaaacatgctagttttgcttaagatttgtcacctctgtgtatccttttcctgcctcttagtcatttcttccttctttgcacacttgttttaggttgtcacttggtgatggtgccactgtgcttttattttccccctttaagaccatgagcatcttacaagttaagcaacattttattcatctttaatgtccccagaacccaagtatattatgatgcttaataaatgtctgttaaatggctagcatgtaacaaatgtcaggaatgtagtaggtgtcaagttagattgtgaagtggatgtgaagtagatgcacttctgtgcaaaagctatcattcagaggcagagatctatgctttcaaatcttgaaattcatatggtctgtggctgtgtattttatatgttaggatattgcctacaatttacatcttatgtcttagaatgcttgctgctttgaagaaatttgaaaaagattcttaagaaaaatttagtctttgagcccctaatttgcgagcatgattttttttcttaaaccacagcagttcaaacatgtggttaagggggagctcaccagtgagcaaggtgattatgagctgctcatttataaggttaaaagaaatcatttataaggttaaaagagaggtctattcttttttttaaacaatgtaaatatgaacagttgtctatttctggcacattctgtgttttaataggaaatattattagaaactgaacacttaaacttagcagtgccattaagatactgacatactgtaaattaaaattttcatgaaatctccccccactccccgtttttttttttttttttttaggaagttcagtacctrcttcaagtagcagcactgtacctgtctstctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggtaaggccaaaaaaataaaaataaaggtgatggtaaagcgcctttttgtaaggccatttaaaaatgaagtatttgagaacagcttcagtgttcactcattctctcttgaaaattaatataaaatgagattatcctgagatgttttagttatatctgtttctgaatattgtaaggtcatattagttgcttgtcaacagtgaggtatcttttctccaggtgggaaaaaaaatttcttgtgtcattgagcctcagagagtttttgttttttgtttttaactgctagccccctaggtgaactgttctttgtttttttgtttgtttgtttttttgtttgtttgtttgtttgtttttgagacagttttgttcttttgcccaggctggagtacgggggcgcgatctctgctcactgcaatctccgcctcccaggttcaagcaattccctgcctcagcctcccaagtagctgggattacaggtgtgagccaccgcgcccagatgaacttactgacttttatttgactgggaatacacctctaaattaaaagcgatacaggctgtggctttggtttcccaaagtaggtcccaggaaaagaactcttaatattttactatataagtacaaaggaagactccctcaaagtaattaatcctaaactaactggaggccagatttttgtgttttttttgagatggtgtcttgctctgtcgcccaggccggagtgcagtggccgatctctgctcactgcaagctccgcctcctgggttcatgccattctcctgcttcagcctcccgagtagctgggactacaggaacctgccaccacgcctagctaattttttgtgtttttagtagagacgggggtttcaccatgttagccaggatggtctcaatctcctgacttcgtgatccaccygcctcggcctcccaaagtgctgggattacaggcgtgagccaacacgcctggtctggaggccagatttttcaagtcttctgtaaaagagtaagcccgcaaggagaaaatgtgtgaggattaatgtcttgaaacaactcagacagatatttcatcttcttacttataagttgtagctaaataaagtgtactcagtggacagagtgtagacccctagaacggtgagaggatgggatggggggtagatgatgagaaattaattaatgggcacaatgtacattatttgggtgatgaatatactaaaagcccaaacttcactgccaggcaacatatccatgtaacaaaattgcactggtaatccttaaatttatacaaattaaacaaaaataatagcaagctttatctacyttgtaattagctttcaaactcttgattgcaaaccaaaagtcaggaataaaccttttatattgtgagccatcacctgcacagcgtatatgtctatatgattgaaatctgttttgcaaaataatacttgcctctggtaggtgtaaggttccctggtattttctgttttattttattttaaaagagaagtgctggttgcagcctgctaaattaattgatgattaatggtatacaactagcagtttgaaaaacactgcatttaagtgttttagaagtttgtgctttctggttcattttatctctttctgtagctgttaattcatgctcccctttttatactgttctctacctgtagtgtggtaatcaccatacttttaagtatcttagtacttcttaatgatccttgttttgagccagtaggtcaagtacttcatttctgatttccttagctgcagaaaagcattatgaaaccaagactttgatcttgtcagtataatgcttgctctcttctcttttctcttctctcctctctcttctctcctgtcttctctcttctctcctctcccctctcccctctcccctcccttctcccctcccctctcccctcttgtctcccctcccctctcgtctcccgtctcctctgctctcctctgttttcttttctttatttattttgaagtggagtctcactgttgaccgggctggagtgctgtggcgcaatcttggctcactgcaacttctacctcccgggctcaagcaattctcctgcctcagcctctcaagcagctgagactacaggcacagaccaccatgcctggctgattttttttgtatttttagtagagatggggtttcgccatgttggccaggctggtcttgaactcctgacctcgggtgatctgcccgccttggcctcccaaagtgctgggattccaagcgtgagctaccacgcccagtctgatgtttaactttataaacattgcttcaactctgtaattcttctgtttttctgttgccttccttttttaaatgcttgagtgaataacacatttattcacaagatttaaaaatcaagaaattgtgacaaggttcaatctcttctctccattgtctctttttccaccttccctcccacttccaaatgtaactgtggttagtttcttgtaaatctttcaaagtttctttatgcccatccaaggcaaacatacatacccctatatattcttacttccttttaccttgttagaaaagtctgtataccgcactccctttctgcycctttgattttatcagggattatcttggacacatctttgttcttccttcttcgtttatagctgcctggattgcatatggcattttgcatgtctatgagtttatctttaaaacaaactccagctatagaattgcaaggtcaaagggtatatgcatttgtaattttcggtaactattgacagattgctctctatgagttttgtgttcatttatacacccacctgcaatgtgtagcctgttacttccagtctcatcactagtacaaactttatcaaactttatcgcagccagtctgataaatgaaaagtggcttgtcaggatagttgtgaggattgagatatcattctcataccgactaaatataggtcaccttggattatgtttacagctgctggtaatactcttcaaagtaggccctttcaaagttactcctatgtttctttggctttcacagtgtttacattttgtttgagaggatcagtacattgagtgtctatgtggtgtcttttatatttttgtaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatcngattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaaygtggagcctgcctctctgccatctgcctcagtgtttgttttgggaaggacagaagagaaacagcaagagcctgtcacttcyacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctggtaagtattaactttttattattattattattwttwtttttttttacaagttgtcgttttacaagttgccttgacagatgcagcaagtcaattaatggtttacactgaacatagttgagaaatacagaactctttgggaaggaacctaggattttcagtttgaactgctctttaaaaccctcatgattctggtgaagtcatctgtggatctaattttgagaaatacagcagtaatgcaaagctcaatatagtgcatatttatgtgtgtctttctcttctgtttgggcttttataatcagaattggtatctactacctggaaaataaggattcttagcttatgaagtattttctaccataatctatgggaaggcctttatttacaaatagttacagataaccagtyctcatcaaacattaagaaacatagacaacaaatataattaatcctgagaaaacaagagattttgaaagctgaagtcctggggaaaaaaatgacatagcaccttaaaggttaaaagcatgattgttggtggatcctattaaagtcattctgtgagctgaatagcaggaagaacttcatagctgataatcagattagtgaactagaatttccccaaacttagtgcaccagtacaaagagtgatccaagttagatccacaagttcctttgggataggagtggcctagaagataagaagttttggggaaatatcaaagaagtgacagaagaaaattttctagatctaaagaaagacattggtcttaaaaatggaaattacctattggcaaagatcactgaaatttaggacaccaaagctaaaaccccaaatgctttcagagagaaaagctatttgccacaaataggcaggtatcagattagcatcatcttctaatttgtaacatcacatgctaaaaacaacagtgcccttaaagtgaaaatgttcttgaacctagaattctgttactagccaaatgtgtttaaatataaagacaatccgggtgccgtagctcacacctataatcccaactagtcgggaggctgaagcacaagaatctcttgaacctgggaggcggaggtggcagtgagcagagattggcccagtgcactccagcttgggcaacagaacaaggctctgtctcaagaaaacccaacaacaacaaaaaaacaccaacacaaaggcaaaatacagatgtttttagatgtgcaaaaaatgcaaaagttgaatatccatgaatacttttgaataataaattggaaacactcaaaattaacctttaaaaagtatggaattcarcaaatagctatgagcagttttttgtctgttatatatttacttagaaatataaagacaaaatcaaaactaaaattacatattatttggaaagcaacraaaacatgatagggtctaatcagatttgatgatgaaaacaccaggctatggtagacactcttaaccattcttccattagccaggttgaaagtaagccaacatgttccattttctgtaagtcatactaatgcccatagtgtactgtgaccagccctggatagtgtgcggtattggaactgagagattattggaatagtttagaaaaaaatcttcaataaggtggctggattcagaatcaccatataaaaatcaaaagtttttcttcaaatcagcatgtctcatttgtttttcctaacatttctaacttgtattttataaaagcagcagaacttgtaacatgccaaataactaaaagaacacaaaaggcatacttgttgctgggtgaaggtattcccttcctcctcccataattttagttcttaggggaatttttgtagagcttgacaagctaaacttattctaaaattcacatggaaaggaaaccacacaagaaattttgggaagaagggcaggcacacaggcagctttgtcctactaatatcagtccatggtataaagttataataattaaaacagtctagtgataacagtagaggaaacaagtatatgcattttaggaaatgtagtgtgtgataaagacagcattgcaaattagtgcacaaaggctgtactagttgatgctgtggagaaacttggctatccatttagataaattgaagttatgattttgccacatactgtaatataaattgcaaaataaaacatataaaagtacagctgtcttccactatctaagcttgctattcaactacagtatccagttagatttggattcgaggtgtatttttattaacctgaatgccaaaggccttcctatgaaaggcctaaaatccataasctataaaagaagatgaatgtatttgactttgtcaaaatctaatataaacagatgtccatttgatgaagtaatctatataaaaaatctattttctagcgaattctagggtaggaaaattctrgcaattgtagggtaggaaaaagtactttctgagactattcttaaggatttatgtttgtttcttaatttctgtcttacagatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggtacatttacaaaagaaaaaatgcattgtaattggatggactttacttattagtgtgtcagttcttagcgaatatcatatagcaggttatcacaaaatggtgrgaatgccttttggtcatctataccagggttgttttaattattcactgtatggaataatgtacactctctgtgttcaactttaacatatttacctcttgggagcaatttttctaattgtggtaagagtgtaatacttaatttttctaagctttgttttttgtttttgttttctttcgagacggagtcttgctctgtcacccaggctggagtgcagtggtgcaatctcagctcactgcaacctgcctctcccgagttcaagcaattctcctgcctcagcctcctgagtagctgggattacaggtgcccgccaccacacccacctaatttttgtatttttagtagagatggggttttaccatgttggccaggctcgaattcctgacctcatgatttgcccgcctcggcctttcaaagtgctgagattacaggtgtgagccactgtgcctggccccaagctttgtttttaaaatgttaggttgtcagtaaccagacactggaagttgttttattaaacatcagtctttattatgcaatgtatatatgcacatcatgaggcaatttctgcacacattaaatttctggtgggagattattctgagatatgttcctttaccagaaattgtcggctgtaaaggtgtggagtagttgttaattgcagtttttgtttatatgaatttagtatgtttcactaaataatggtagagagcgttgtattctcaatcattatttaaaacttgtcttgatggaatttggttagcaaggtaagagtctgaaacgaagcttgacatttgcttgtgggtttacagaaatttcttgaggataatctgacattagccaccatggtgacttaagtgtttctttgggcctccaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagtaagtgtgctgtgatgctgttagtatctgtatgggttttgtgtgtcttaaaatattttcctttgagcttggaaaccattcatatgtctaattttaaaattatctcttgtacttggcagaatagagaggtaatatggttggatttatatataaacaacattcgcaggtttcacagacttgtaacttttttaaggtagtaatgtattttaaagtgttaatttttactctgacttaagtatgggattcattcactctcatttcttctcaactttgaatttttgggcttgcaaggctagctttgaagtgcattttctgatcctgtttatgattggatttgcgttaggaagttacccccaggtccagtgctctctcctggggcagtcccgctgagttgtctcatgacactttctatttactgatgataccagcctttccatttgaactgcatatttaaatatgactaatcaaattgtattataatcctatattttcttaaaattgttgttgatttttttctaattgtgaaatataatattatgtagaaaggggtgtaaaatataagtgaacagtgtaatattgaagcaaatgctgtataacaaccacctggaagcccctcatgtatctctttttgaaaacactcctctctttctccactctaatgatgaccaccgccttgtcttttatggtaatcactgttctttgggttttattactgcatttattggctaatamatgcatccctagaaaatgtagttttgcctgcttttatataaatggaatattactgcatgcagtcttttgatttgtgattgttttgctctaaggcttgtaagggtcatccatgttttgcatatagtttgtttattgtcattgccatagagtaaatcattgtatgaatatactgcagtttatttactgttgacatatgtttcagttgtttttaactactaggaaatgctactctgtacattcttgtatatgtaccttggtgcacatatgtatgtttttctagagtatatacagtggcatgggattgctgaattaaaaggtttgtatatcttatactagaagataataaaaacttttcctgatggattctgccaattcatatcctaccaccattgtatgagttcttatatgtgggttctatttgatttctcatgtgtgtaaattgttttaaaaggtttttttttttttttttttggccatttttcagtttggcttttgcgtgtaagtttgtagaggttctttatgtattctggatattggtactttgtcagctaatgtacataccaaaatttctcctgttttctgatatacattaaccattttgatcaggattttttcctctaatatgaaattggaaagtttctatttctttcacacaggtaacattttcctctgttgtcatcgtcttttttttttttttttgagacagaatctcactgtgtcgcccatgctggagtgcagtggcttgatctccgctcactgcaacctccgcttcccgggttcaagtgattcttctgcctcagcctcccaagtagctgggactacaggcacgtgccaccacacctggctgattttttatatttttagtagagatggggtttcaccgtgttagccagggtggtcttgatctcctgacctcatgatccacccacctcggcctcccacagtgctgggattacaggtgtgagccaccacgcccagcctttatctgcttaatatagagacactgtaaggttagatcaggattctgattatggaaatgctgattattgctgagccatatggtatactataactttctatcctatacaaaatttgtttctctgacattattgacttcctctctttattttttttttatgtaaagagcaatcaattttataaactaaatacaaagaaaaagtcaattttaggagatctttcttccagttaaagaattgagaaaaggctacagaggccctaaaaattagagtcacactgttgttgaaacttggggaaagacagcattttagggttgaggttctcagttctataacaaggtagacctggatagtaaagatgttagaaaatccttttttaaattttttgagacagggtctcaccttgccgcacaaactggagtacagtggtggaatctcggctcactactgcctcaacctgctgggctcaagccatcctcctgcctgagcctgccaagaaactgggactacaggcagacaccaccactacacccatctgtttcatttttggaggggggcgtggtttgtagagacagggttttgccatgttatccaggctggtctctaactcccgagctcaagcagtccacccacctcagcctcctaaagtgctaggattacaggcgtgagctactgtgcccagccaagatgttagaaaactcttgactctgkgtagcagcataactgtccaaaaaaacacaaaacaaaacaaaagaaaagccatgctacaaagtctagtgaaggtcattcccacagaaaacacaaagcattaatttttgtcatacatagaaatatagttttagtaataatccaaaagcatttttgataaaaatgaaaaactttaaaaaaatattttaaagtttttcatttttaaaaactgatgtgttattttgttacatacatacaatgtgtaataaattagggcatttaggatatccatcaccttgaacattcatcatttctttgtgttgggaacatttcagaacttctagctattttgaaatgtacaataaattattgttaactctactgtgctctcaaatactagaatttattccttctatctagctatatgtttgtattcgttaaccaccttcccttcctaccaccaccccaacgaagcctctgaaccatcatttgttctctacctttatgagatcaacttgttttttagctcctacacatgagtgagaacattgaatatgtgtctttgtgcctggcttatttcacctaacataatgtccttcagtgccatagatgttgtagtaaatgacaagatgttattttcttttaatgaccaaatagtattttattgtatattaaaccacattttctgtatccatctgttgatggacacttagattgattccgtatcttggctgttgtgaatagtgctgcactaaacatcaggtacaggtgtctctttgatatactgatttcctctcctttggataaatagccagtagtgggattgctggatcataaggtgattctatttttagattttttgagaaacttccttactgttttccataacggttatactaatttacattcactccaacagtgtgtaagtttccatttccttgccagcagttgttaatttttgtccttttgctaatagccattctaagaggtgaaatgctacctcattgtggttttgatttgcatttcccttatgatagtgatgttgagcattttttcaggtctattggccatttgtgtgttgtgttttaagaaatgtctgttcagatcctttgcccgcttttcagtgggattatttggttgtttttgttttgctgttgagttctttgagctcattgtgtattctggatattagtcccctgttggatgaatagttagcaaactttttttccctttcaacaaatttttcactcctgattgcttcttttgctgtgcagaagcttttcagtttaatatagtccctcttgtctatttttgtttttgttgcctgtgcttttgatgtcttagccataaaatctttgcctaggccaggggggtcctatcttttggcttccaggggctactttggaagaattattgtcttcggccaaacacaagatacattaacactaacaatagctgatgaactgaaaaagaaaattgccaagaaaaaaaatctccacgttttaagaaagtttatgaatttgtgttggacggcattcagagccatcctgggctacatgtggcctctcggttggacaagcttggcttagaccaatgtcctggagcatttctcactatgttttcttctaggggttttgtggtctcatgtcttacacttaagtctaatccattttgagttgatttttgtatagggtgagaagtaggggtctagtttcatactgcatatggatctccagttttccaagcaccatttactgaagagagtatccttttcccaatgcgtgttcttgtcatcattgtcgaaaatcagttggctgtaaatacgtggatttgtttctgaattctctattctattccattggtctatgtgtctttttataccagtctcatatagctatatatggtaagtatagctttgtgtagtatattttgaagtcagatagtatgatacctcagcttttttctttttgctcaggattgctttagctatttggactcctgtggttccatatgaattttaggatttgttcctccctcccttcctttttttttttttttttttttttttgatggtgtcttgctctgttgcccaggctggagtataatggtgcaatcttggctcactgcagcctctgcctcccaggttccagcaattctcctgcctcagcttcctgggtagctgggattacaggcgcgtgccaccacacttggctaatttttgtatttttagtagagacggggttttgccatgttggccacgctggtctcgaactcctgacctcaggtgatctgcccgcctcggcctcccaaactgctaggattataggtgtgagccacagcgcctggccggatatgtttctatttctatggagaatgtcattggtatttttggtagggattgcattgaatccatagattgctttgagtagtatggccattttaacaataatagttcttctgatccatgaatataggatgtctttacatttgtttgtgttctctttaatttctttcatcagtttttagtttaaaaatatagaacacttcacaaatttgggtgtcatccttgtgcagggggccatgctaatcttctttgttcaagttttgggtatgtgctgctgaagtaagcactgaaagaacttttctcacagggtcttttaacctgttcctcctaccaggctttcttggcttgctgtttaactgtgctcttgggaaacctctttttaccattcttttggagattccttttagcttcgtagaggaacccgtttcctgggtgtcatgtctttcctgttactcccctattttctgatacagcacatcttccagtgattcttgagggttcagggatggaaaacattgaggccatacatctctgcagggatctttattctctccccatgtttggtaagattttgattgaatatagatgtagattggaaatcatttttataattttgaaagcatttctccattgtagacttttctggcttccagagttgcctgaagtcttgatctttgctctttggcctgtttcttctttctggaattgttagactctcctcttttgcctccattgttctgatacatcaggatgtgtcttgatgtgggtttgtttttatcgtttgtgtagggagtgcagcatgctcttttgtgaacttccattttggggaattttcctgaattatttatttgaagattttgtcccctaatccttcctttccttcttaccttttgtctttgtgtcatactttctcagatttatctttcattaccattctgttgagattttaacttctgctgggcgcagtggctcacgcctgtaatcccagcactttgggaggccaaggcgggcagatcacgaggtcaggatatcgagaccatcctggctaacacggtgaaaccccatctctactaagaaatacaaaaaattagccaggcgtggtggcgggcgcctgtagtcccagctactcaggagactgaggcaggagaatggcgtgaactcgggaggtggagcttgcagtgagctgagaccgtgccactgcactccagcctgggcaacagagccagactccatctttaaaaaaaaaaaaaaaaaaagagagattttaacttccactatttctttaatttctaagtattcttttttattttctggatgtttcctttttatgcccctctgggttcccccccacccaactctccagtggatgaagtattcattaaagatatggagttcagatttttctccttaaaattttgtttctttgctgagtcagttttcccaaaattgcttttattatttttgtctcagtgtttcttattaaatactgtcctcaaatgcctggtactccttggctacctgtagttkttatgagtgtaggacacrtaaataccacttaaatcctttctacattgatagggcttacagatcttgaatttcattgtagatttatctggtttatctagcattattttacttgggaaagtttggatgttagtatccttcattcttttcacttagtctgtcagataccccaaagaagatgcatccagtctcctgcatggagggtatcagagaacttcatttgccagtgttctgggagctaagattgggaagatggctggagcgctcggtattttgtgaatatcgagctacacttaattcctgttttcaaaatgatattcttgcccttaactgtatgtggtgtctcccagtccagacacttctacaaagactaaaacactaaacttctgttctggtgcggtggaagaggagaattaccatcttttttttctttttttttcttttccttctgagatagggtctcactctgtttcccaggctggaaggcagtggcagagtcagggcacactgcgtcctcgacctcctaggctcagaagatcttcccacctcagcctcctgagtagctgggattacaggtgcacgccactacgcctggctaattttgaaaaattttttatagagataggatctcgccatgttgcctaggttgttctcaaactcctgggctcaagcagtccacctgccttggcctcccaaagtgctaggattatacgcatgagtcactgcacccactgataattaccatctttgtgttggtgttgggagggattgattctgggtatctgcttctaaacatactctgccatcctttttttttttttttttttttaattcccactacatcctcacttccataggtatctggaacctaaacattttgggtatgtttggtgtaaatgcaattgcttctgttctttccctactgctcgtttagtatcaactctagtcagccttccagcttctaaacctatatctttgtaaaaatcccttgttgttttaatgcacttttcaaagaagatagagctaagtgtatttgttgatttcactgtctttaaccataagtccagggtgcccttttccccttggtcataggtaagttgtgtgatttgttggaggtgtcaagtatgtactatgtgtcagtggagaaaatagttttctttagattaaaagaccagaatattttaattctttgcatgtttttatatgtaaaggtcagagtctttaatttaaaaacctatcatgttgcggccgggtgcagtggcttacgcctgtaatccagcactttgggaggccgaggtggacagatcacaaggtcaggagatcgagaccatcctggccaacatggtgaaaccacgtctctactaaaatacaaaaaattagccaggcatggtggcacgcacctatatagtcccagctactggggaggctgaggcaggggaatcacttgaacccaggaggcaagggttgcagtgagccaagattgtgccactgtactccagcctgggcaagagagcgagactccgtctcaaaaaacaaacaaacaaacaaaaaaacctatcattttgccctaatgaagtatttctgctttaactattgcaggttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtaagagaattttttattgaaatggagaagttacattggtaagggtatgtgcatgtatatgttttgtttttaaaagtcatcaagattccgtatggtttgggtaaaattaaatatgttctccaacataaatttaccatactataattctggaggattatattacagtttgagaaaaaaataacagtagcgtgtgtgttaggtrtagcagaaaatgtatataccaatgtgagtctactccccccccacccgaccccccttacccttctgctgctcatggtaaatgttagcatttggaaattttgctcagagcatcatgtcacattatgaagtttttatttttcacaggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatrgaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacatactttttgttctagttttacctcataatgaaggcacacagtattattggggggactttgtaaaataaagattaacagtgtctcattagaagaatacattgacatgatttagacaactcctaagagaaagggaaagtatctgaaagtatctgaatgcacaacatatagaaggtaccctacttcttgcctggtgctaggaatcatgcctaatttgcatatcgacttaggtaccttttttaaaagttgaaaatacacacattcatttctctttgtgcttctatcttccttggtaagttactggatagtgtttattaaagttcttggaaatacatacacaaaaactacagttgtctcttggtgtgtgcaggagattgttcccagaactgcactcccccccccccccagttctcccgcccccaaaccacaatccacaaatttcagcagtggaccctgcagaacctgagtataccaaaagccagccctccgaatgtgcaggttttatatcccacgaatactgtgtttttgatctgtttttggttgagttaaaaaaaaaaaaaaaacccgtgataagtgggcccacggttcaaacccgggttgttcaagggtcagctgcactttcttttgtattattttactgcattcttttttttttttttaaactggattcccatggtccataaaagagctcttggaacaatatttggtaattttatttttcagttggaaatgtacagttatttaaattgtgctcagttttaatttactgaacttctggttggttggagtttatgtttttccaagacggagtcttgctctgtcgcccaggctggagtgcagtggtgcggtctcagctcactgcaacctctgcctcctgggttcaagcaattctcctgcctcagcctcctaagtagctgtgattacaggcgcccgccaccatgcccggctaattttttgtgtgtatttttagtagagacacggtttcaccatgttggccaggctggtctggaactcttgaccttgtgatccacccgcctcagcctcccaaagtgctgggattacaggcgtgagccaccgcgcctggcctggttgcagtttaaatttagaactcaaggtatttttcttacttgagatattttagtccatcatcaaatgctggttgggggtagaaattttgctttattagcagtatacatttgacacctgttgagggggcaaaatgtgatgaatactggaagaggtaactgggaatttgtgtcttactgctgagaagttaattcttactttgaaggttcttagccattctctaggcccctatcgctgaagtgttctgcttttctctaaaaattgcaagaaatgatgtttacttttatttagtactgtttaaaactcactaaaaccatacttaatctgtttgttaaaaatggaatctttagcccccaacctgattagtctatagaactgcactcagaacttggggcttttttcagtctgactactttatttcttgggaacctccgccttttgggttcaagcgattctcctgcctcagcctcctgagtagctgggactacaggtgtgctccaccacacctggccagtttttgtatttttagtagacagagggtttcgccatgttggccaggctggtctcgacctcctgacctcgtgatccgcctgccttggcctcccaaaatgctgggattacaggcgtgagccacatgcccaaccttgctttgggttgtatactgcatacacaagtgaaaattgaggatatttatggatggcagggaaacaaatgttggaaagaaagtaataaaagcccatacttcttatgctgggccaatgagtaatgaagatagattgccagggtctccctctgtcacccaggctggaatgcagtggtgctgtcatagctcactgcagccttcaactcctaagctcaagccatcttcctgcctcagccttcagagtagctggggactacaggtatgtgccaccatgctaagatttttattttttatagagacagggtcttggtatgatcctcttgccttctaacatgctgcaattacaggtgtaagctaccaaacccagccaggaattgtttttaatgaaaaagaatctctaagggaggaaagtcatgttcagaaagtttaattgaataattaagtaggtgtttttataatttggtcgattgacgagaggactggtggctctcactgaatgtaccgttagtagtagttggcagggtatgtcaaatatatgttctaggacccccatcaccagaaactgggactggataggttccaaaagtctgcatcatcaaataagcacctggcagactgatgcactgaggtttgggggtgtcactttaagcaaagtgctaggtggttttgagtaattacgattccgggcattgagaaaaaggtacggttcagaccactgaaaaatgtctttaagctgcctattaatacttgttacaaattctcctctgaaattacttgtttatctaattattattttattacttgaaattagttattgaactaattttaacaacatataaccaggccatatgctggttaagcctggaaagaacttttcaattggaaagtattattttactttggaaaagtaaaatacaatggaaattttatagtggttattttagccggtgcatttaatggaaactgacaaaaatttggtctagtaaaattgagaaaatggaggtagtaggtctagctacacgcatcagctgtatgaccatgtcggtcagagacttccttttgtaatatagggcacctttgtaaacttgtctcaaaaatctactgtagttctaaaacaagtttgtggctaggctcataacagcagcacattgtctacaggacttggaccatcttttagctacagtctagtttatcctttattatctttgcccctgttgagtgaggaacccgttgttttgcttcctgccttctctctggacctgttcataaaagttgttagaatgggaaaggcttttaaggtcagaactgggtttaaattgcccagatgagacttgtgtggtggttgtgatggttaacaactcttgaaggactggattagtttaatagtaagcttaattcatgtacaggtaacttctgagtgtgcctgctaaaagaatatatccttaaagatgggcgattcttttttcatagatctctatttctgaaagcattctagtttactgctaaacccactggaaaacctgtatttggaggcaaggtctccctaagcagattctagagcaaactgtctcaaagaaatagacaaaatacagatgcattgatgactaagtatttattgagacaaataatacaaattggtggcatacaaattattaaaaatagaatgctgaattttatttataggtgggccatcagatactgtttacaggttaagccttactataatgaactgcaaagaagtatgtatactgtttgaaatgaggaactttatccaggcaaacatgggatgtcaagagtggcctgtggtactggagacaaggaatatcaagtaattgacatgttacttgtctgtcagattttaagaatactgttatttaggcatattcaaagaaacaactgcctgttttaatagggataagtatataacgaaaacatttaatatccatacccccctcaaaaagccctttattcccaagtagcaactagtgtaaattaattttcaattcctttctacccttcctttgctagaaatacttatgcataactaaaacactcaagtcactgaagggaacaaatccttttactgtcacttgaatctaaaaacactcattttgtaatttgggcgaagtagctctcaaatataatgcatttttttctatcctatatatatacttgggtaaaatcggaaggtgagtgcttaggcagaaataagtaactattaaaccagtgggagcaaagttcagttgggcaatactctttatgatactgacaagtgaaggcttattagttccaaaagtgctggctttatttctgtagtcacagagtagtctaaaggtaaggcttacccagctcttggctcccaagttaatgttatttattcagtatgccagatttttctcaaggtgcattagctactcaggataattttactggtgggaactgagattttctagacgcctaaattaactgccaattctggtttatcttagggacatgctcattgaaacagtattctcactcagcttgaatactaaattttgttcccttattgttaaagtgatgaatatgtttgtacaatgaagacaactttcttttggctttttaggctacagcttcagcatgagaattatactttgacacagaaaatcaggtctataagtgaaatataataaagtgttctggaaagcaggagactaccttacaaccccaagagaaaaatatgtggcactaaggtctggttccttcttccctcgttgttttgtcatttttttccaaactttgggaatcaaaatctcggtgcaaatactgaattcataaattgaaacagactcttgggttctattatgaaggcaaataatacttctatgtattttgtagggttatacagtataatacctcgaatccatggttggatctgactgaacctacatagatactaatctgaataactcatatatagaaaatgtgcaatattctaagtacaaaaaattaaactggactagtttgcttttgttttatagtataaatgaaaataatctcgatggcaaactattcaattatctgagcagaaattatgaatgaaagatgtattccagacctatatgattgagggacatttcaacttgaattccccagcggcaaaagtggtgtataaactaatgctagtgtatacactactaaagtgccaagttacgtaacatctcctaattttaaaaatgaaagatttttctttttttcactgtgaagggcagtaacacaatcttccccatgggtgcaactgaatgatttatttagtacattgatgtacttaattattagtgtttctgggaagctggatttgacataaacttattttgaaaaacacggtttatgaaattttgtactaaaattattaatagacattaagtttctataatcaaatgtgaatatctgttgtcacagttttaaacgtcaaagaaaaacctttgaaaattaatatagtgataatagatatgtgctgtgtttgctgttaaatttaagaccaagaacaccacctagattgatcccttaagtaatcaaattttgaactgtgcaatgcagtttagtgtgtctttggaaaacaatgtcagagctggagaaaatacctaagaatcaaaacttaaaccataaatagtacaggtatatctcagcacagctaactgggacatctaggaaaagcacacacacataataaaaccccacaattttgcttcaacagaagaataaagcaaaatggcaacatacacagtatcactttgcgtaacatttccccccaaactttagcagacccaaaatgagcttaaagaccctagaatgatgtctgggaatgctagtctctcttgctttagagagaatagtccataatgggaaaattgctaatatttcgcaagctattaattaatagtacttagagttaatcatgaaatattaagatttttttaactccttgatgtttcaacagtcatagaactatataaaatataaggaaagtagtatgtgaatatgctgtatataaatagaatttacactgagaacactgagaagcactaatactttcttcatgctgcacacatactgggaatacttttacagtaaatatgcaactgtttgatggaggtgatttctccccacatttatagtttgattcagggcactgaaaacacttgcacataaattataagttcaatttacagtgaaaacttactcccccaccattaacagtaatcactaacttaccttttaaaaaaaaaaaccaattaacatagcaatatgacttgatactttttcatcatcatgagaaacttgcccctaaatacatgttcaa

SEQ ID NO: 10732 - DNA, 138434 bp, Homo sapiens
tcctttgtagcactttggagtttgatatgaagtatcttcttatcttgttaagggatccctataccaagaatgttttcatctcaaccccactatttctaagttagcttaaaaacaaaacaaaaccctgtgtgctctaataagaagatataagaaccaaaatggaaatgcaggttctcaaatgagctgaaagattccacatagcagcggggcagattgaaacactctttaccaaaggaacatgggagagaaaaggagattaaatcaagaaaggaagaaagctaatgacatatgaggagccacaaatgccacaaatgaaaaaacaaagtacgtaatacttgttgcaattattcagtgtgcttgctctaatgcctccaaacattaaaaacattgagttcctgcttatggcaacatttatctcatttatctgctgatagctgcctcatccttgaatcaggtattgcttaaactaagttctgccagcataaagaataaagtcaaccaggacacccattgggcatttcacgcatatgagcacaaattgtgatattttaggttgcttatgatgaaatcattgaaagcatcatgaaagacagcaaaacagcaggaaagctagtaataatttagcatttcccagtccaggcgggaatgttaattctaattacaacgaggaataccaaagtggagttcattatgattaagaacttgctgtactagtgtgaattgtttataataggcatgtctggcataaaatacaaatattgaagcagacagagatggctcattcaaagctcagctgggttcccttgaacctcttaccttataaagttaaataggaatagaagtattttccaaagtcaagatattattttaaagagacaaataatagctatgatagctgcaggaataattttttaaagtaagttctaaccaccaataaaagctgtttgtgtgggcttaacatgttcaaaatacacaatacacatgtacacaatacacgtatacatggttcccatttatatttaacatcacacatttaaagtgagagagtacagaaaaaaagaataaatggaaactgaagccatgacaaagaatcacggactataggaaaataagtcacaaagaagtatgcttatgtaagaggaaatatatgtgataaacaacaggagacatgggaatgaatgtggtgtcttatgtcctttctttaacagaatcgtgtaacagacactactcaatatcgatctcaactgatccagttctccagtctccctggaaaacaatggattgatgcccagggtgcgctgaacactggaaccatggtcacttctgcacttcacacgattctgctcccaccagttgagctaccaacagttcctggtgcttttgcttcccaaacatgtttatgccatttgttgcttattactgtacttacttaatttgattaaatattaagtaaaatgatgaaatgagtgtaaaaaattgttctataaaatctaaatggaaagatgccctatagccttccttgacttacagttgcgtcaagtaaggtggatgtaagacaattttaaaagactggtgtgggggcaggagtgaggaatcataaaaatttagaaatctgcacgaaaattattctaaaagtacacattgaacatccctaacttgaaaatctgaattttgaagtgctccaaaatccaaaactttttgagcattgttatgataccacaaatgaaaaatcctacatggaagtacttaccacaaactttgcttcatgccccaaattattttaaatattgtataaaattatcttcaggctataaggtgtatatgaaacaaaaaatgaatttcctatttagacttgggtcccatggccgagatatctcattataatgcaaatattccaaaatcagaaaaaaaaaaatccaaaatctaaaacactttcagtattaagcatttcaggtcatggatactgaatgtgtatctttaatttcttgttctactttgtttaaaaaaaagggggaaaatagtaattctacagatgaataataattgctaatgatgagcaaatacttcctatgacccaggaattcgtctaagcacttcacatatatcaaactggtttaatctttataaatcagtactattattatccccattttacagatgatggaaaaaggcacagagagttagcctgcccaaggttacattccttttagtggtggagactgtatttggcctttatagtctggcttttaactgctacactatatcaatgcattacaggtatagtttatacacacactaaagaagacatggaactccagtcagtgggctcataaaagctttagaccttcatcaaaagattagaaaataaatgttcaatcacaggttttaggtttcaaaagtttcaaaagtttaaagtttgcaagttatctttcttaaaattatttccttcttttaactaatttttaaattaaactccagttcaatcacatccactagaaggcttcactttctacaaaggggtaggtaaaggtgatgatcttaaataccatactgggagttgggatctgtgtagcactagaatcaagagttattgtatatacttgagaaggagcacagcctgatttagttgatgttttggaggggtaatctggcagtacagcttggattattttagtgggaatggagatgacaaaacatgaagagaatgggagaactcacttgggtaatatatcagtttctgaaatcaatgtatcaagtggtttggttattagtcaggcttaaggttttattggccttaggacatagtctctaagaccatatattatcttcattcattcatttaaccaacacccactgagcaccaactatgcactagtgatacaggggtgaacaaacagacacagtccctgcctttgcagaacttatgttctggtgggtgatacagagaaataacaaatgagggcacaaataatgaactatcattgtaatgtgctaacaaagtatgcagaatactataagaacatacaatcaagaatctaatctagtttattttaaaaaaaagtggggggagcactcagatgtttaaacacaaaacaataaaaatgaggatcttgagggttatctgtacactttttattaacccatttggccacaacaataacccagtaaaagtgattttacatctagttaactagttgactcaatgttattataaccctgtaatgtatttgttgggtgcctgctatgtagtgggctgtgttccaggagtgggacataaagctatgacaagatagatcaggtccttgccttgactgagtctgaatacatcaccttcatttccacctctgcttctaagacaatcaaataccttcccactcagatagggattcatcctatttcttgtagtaattataagttcccagggttacagattagtaaatgccatacctaaagacttaggatactgtgcataaaacactttcaatagtgtctgtcagacagcagatgcgcaataaatgttgactttcgttagaattgtgttattattataatgctaaatctcacgtcctttctggcacactggagttcatctcttcaattaaattccgtaagcacatattgtaagtagtctatcagaattgatatactacttcatgttaatgattgagatcagtgaggaaaaccactttaatattgtctaattcctctcttaatgcataggagccatgtgaacttagacaagcatcaacctctgtaagcctgttgtcctcatattgaaaaatcgaataacaatacctatctcatttaattgttgtcagcaaaagtgggcagcagaagagtggggatcaataaatgttagccacaaatcataactatttgtattactctgaaaaagaggggttaacttatagttcatgcatgcttccaaatgaatgtgaaagactaaagaatgagaatttttttgctatcaaattaaaaaattaacaggcacatttagattgctgaagagagaaattaggataagtttttttttttttttgctcaattaaaaacgttttcaatggcatatttaaaactacgtattcttccccattaagatctgcagagaaaaaaaaatgaagggagaataattgggaactcttgtgaaatcataaattatttaagcagagtacctaccactaaggatttgagcatgtatgagcgatgaggtggattcttagagcagagattcagcagtgagacaggctaatggcatggggagatgtgttctattagacaactgtattgtccccttaattatatacatatatatgtatataatatatatgtgtatacatatgtatacatacatgtatatataaatagaattcttaatcattttaagcagtgtacaaggataattattagcatgggctatttaactcacttttaaaacgtgtaaaacattattgtagggttgggtcttgatttgtttcccatgaaactgttggtagtttaggggccaaattaacgaaagacatctcattctagtgcttgaggctcagaaattggaaaaacgggcaactaggtcaagcagtgttctcatagcctcacagatgagcatccaaagcaagggcctccttctagttgacttgtgccaagggacaggagaagcggagtctgccttctgggtccagaagggggttttgttaacatggagttgctcagcgcccttcataaaaattcttctggctgagggttctacgttggcatacggttggttccctcttcttttccgaggtggcgagtatctcttcctttgccaagatggcggctccagaatcctctggaggcggcccccgtagatcgtctccggacaagaggcttgctgaaagcctacttctttcctttcacatcagacaatgcacagggaaccgtttacccttgagaaccaaggaaggacggcttaggctacccgcgatcgcgaacctttgccaagatggtggccgcggggacgggctggcgacactgtaccctaccaagatggcggcgggcggcttccgggacgcgcttccccaatcgtcttcaagatgtcagagcagggggagccgccgtcagtctgagcgcggcgggaggtgagagagtggctgtggccgagcgcccgagcaggattaggtggagctgcggcagcccccgcccgtgtcaggagctggcaagcgatgtcacctgtgggggcgcaaaagttacctccccaaaccctaaacccacacagcacaacctttcccagagtcacaaaaatcataatctgtgccgcacaaggtaggaggctcggtcccggcatcgtccaagccttcccgacgcggcgagctggggaagggagctggggcgggggcttcccgcacgggcacccctcgccccacggccctctcctttctcaggacggaccacgagttcccttccccttggactgaggggraagctcctaacaggaacatctgtagggagttgaacgctggcattttaaagctgcctgtattttgttttatttgtaggggcaggggtcctatgaacgtgatagggtgagcaacgcacagagtcgagggcagcaaatgtcaagattcgggggtggggcctgcaccgggaacttggacgcgggccctggccggggtggaagaagaggtcaggagtttcggaaggggggctatatttcgccagcaacttactatttcgcctgcaacttgcttttaagcctgccgccccctgctttccttaatcataataataaaaaaaaagtgcaaagaaatccagctcgctggaggttttgcatttggcgtgcaacttccttcgagtgtgagcacattgggcgggaggggtgggggttgaacttggcaggcggcgcctccttctgccgccgccgccgcctcgcagactcggggaagagggtgggggacggtcggggcgcgggggagggtgggttctgctttgcaacttctctcccagtgcgagagcgcggcggcggcagctgaagacccggccgcccagatgatgcggtggtgggggacctgccggcacgcgactccccccgggcccaaagtacgtatgcgccgacccccgctatcccgtcccttccctgaagcctccccagagggcgtgtcaggccgcccggccccgagcgcggccgagacgctgcggcaccgtttccgtgcaaccccgtagcccctttcgaagtgacacacttcacgcaactcggcccggcggcggcggcgcgggccactcacgcagctcagccgcgggaggcgccccggctcttgtggcccgcccgctgtcacccgcaggggcactggcggcgcttgccgccaaggggcagagcgagctcccgagtgggtctggagccgcggagctgggcgggggcgggaaggaggtagcgagaaaagaaactggagaaactcggtggccctcttaacgccgccccagagagaccaggtcggcccccgccgctgccgccgccaccctttttcctggggagttgggggcggggggcgaagcgcggcgcaccgggcggggcggccacgccaggggacgcgggcgtgcaggcgccgtcggggccggggtggcggggcccgcgcggagggcgtgggggcagggaccgcgggcgcccctgcagttgccaagcgtcaccaacaggttgcatcgttccccgcggccgccgcgcggcccctcgggcggggagcggccgggggtggagtgggagcgcgtgtgtgcgagtgtgtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagaggtaagaagcgaggcgggagggggccggggcgcgctcgctcccccgaggtgccgctgggaccggagacaactcgggggccrccgcgggagcctacaaacttttattagcctcggggagtgggggtggggggctggcaagggccgggcgacggtgacgaaagggcagcgcgcgggtgacagcgctggcctcttcctctccctccgccggcgtcccctggccgggccgagggggaggaacctgacctcggacggcgagcggagccctgtcgaactgccgggggcttcgagcctctcattcctcgcgggaatcctggcctcttttctccccctagtgtcccctttccctccaagggggtcgcccgacacccgttttcgtggtgaacgctaagccgcgtctgaattttactcgcccgaatatttgcacgccaccccggcgcgcccgagcgcgagcccgggctccggggaggccccggcggcgcctggcttgaggagggcgtgcggggcgcgtgagggtgcacacgcggggggctgacagcccgcaacttggagactgcggccggggccggcgttatctgttagaagtgggcgtgtcggagagagaactcaacaggtctggacgtacttctcttttaacctcgcacttttttctcttctccacccccgccccgcaagggcttgctctttagcgtttgttgttaattcgcgcctgaggtttctaagtggccccttttagaaaaagaccccctgtaaccgtaatggttttgtgctgcgatttttacaagtgctagtttgacgtttggggttgcagacttgataattgcaaccttgtaataccacttaagaccctctggcatggttcattagggccaattaatgtggctgggttatttgcaacttaaactgggggataatgtcgcttgagggagcgttttcgttttaggaaatattgttttggtttcgggtttgaaggcagctgtcaaaaaagcggcatggaaattcattgggctccattcgatacctcgtgtttagagatcgttatcgcctcagataaacggggcagagaggtggggagataagcagtttaccctcaagatttgtagtggcaagtccacacccctctctctaccttcatattcacttttcagtgagggccagtgacatttatgctgcctaacgtcatcgcataggaaaagttaccttttattggacgggatttgactatagtgtcccaaatgcgcttctccgtcttagcccatctcttaaaacaccctgattaacgatatactaacagtcttactctcttgagaataggctgagaattgggataggtgaaggtttggataggtgaaggcagagaaaattattttgaacattttactggatacagttgtacctgaatttatatgaatgtgattttacggttctgtgtttttccatttttcagtacttcgatatttgtttggaaaggaaagaacttagagatgtaatagcatttcatattgaggatctcaagcaatgtaaacaaatgtagcttaatctagatgtttttgtgagttatgataagggtcagctatatttaagttatgtaagctaacaacgtagtgagaaactactacaccttctcttctgctctttaaaatctaaattttagttggcctatataaagtgtatctcatttcatatatccaaaatttggaggtaggcacatccagtcagaagtatgggttaaaaagccttttcccagcctgtcggaagataagcagatcagcattgtttatttttcaaagaaaacgtgcatggttcaccagttggttgtactcaaaggtttggatgtgtgactagctggtaggagggaaatttggaagtaattagggattgagaattctagcatagtatttatcaaatgttatatgtattggttctcagaaaagcaaacagccgtgattgaaaagaggtaggaattttaatgatcacacttcctttttttgaaattaaatactttgacatcaacttgaaccttcagaataatcagatgtaatgaattataatgtctgtgattaacaaagctacacgttcagtaatcggcaggatgaatagccaagcttagttcgatacacttttgccctcagctgtgcaaatggattgcattgtacttttaaatgtggcatgctgaatgggagcaggggacatggctttttattctggaagatagaaactactcttctggtaacaaagaatttgattyggagttaactaaaaggttcatttaacaagctgcctcttactaatcggatcaggaagataatgtgactttagagcttatgatgttttccccccgtttttgttttttgttttgtagttgatattcactgatggactccaaagaatcattaactcctggtagagaagaaaaccccagcagtgtgcttgctcaggarargggagatgtgatggacttctataaaaccctaagaggaggagctactgtgaaggtttctgcgtcttcaccctcactggctgtcgcttctcaatcagactccaagcagcgaagacttttggttgatkttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagcccyagtaatgtaacactgccccaagtgaaaacagaaaaagaagatttcatcgaactctgcacccctggggtaattaarcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaarttggartaggtgccaaggatctggagatgacaacttgacttctctggggactctgaacttccctggtcgaacagttttttctaatggctattcaaggtaagatcagtgtttttctgtttcttaagaatggtacatttaaggtagattaatagatgtaaatcttcattgatttatatgtgttctctaaagattcatgtgcttttttatatgaataagtttaagtggccttttgaaagtaggaaaggtagacaacctaagtgacatctgtacgtaaccatttcaggttttttccttaaatagtggttttcagtatcccattggccaacggtgaggattttatttaacatttttaaaataatgttgctcattaacagatatcttaacgaaaaattatataaattcaggagagtataatgtctcataatatcatattgtgttgtgcatggtcattcagctgttttagaatatgttcttatattacaataaatgatacccttacttacatagtcaaaagttgtgctgccttatttgtaaattcgttaagtgttagcttgagattaaagagttaaaagcagaagtactaacaaagagccctattcttcaaactgaatcttctgttaaagaatttgagttttgaagttgctaaagcaatgcagtgaacagtgtaccagaccatagtattagacacaggtcttgctcacagggttcttgccataaagtagacaagttatgtctgctgatcaatctctttaagagaggaattggtgtcaacatggtgcaaaacaaaattttacgttcaaatgttcctgcaagttctcaagtagataactgatggccaaaattgttaagcttcaattttcagctttcgtttgatttttctcttttttttactcagtcgtttataagcatactgatatttttgtctgacccaaaaaggtcagaaaatggaattatcagaaaaaagttctaaatgtagatatacgtgttggtaggggtgaatttctctaccccgtaacctcatccccaattcagataaatgctaggttttatatccattttagttgtgaaggaaaatataaaaatgtggattgtagtgacacaagattgattaatcagcgggtttttttaaaagaagacatggtagacagtgatttatttgtatgtaactattgaagttttttcttaaatgttagtgatattcatcgttcccattaactagttattcagatttttgaaaatcctttttctgtgaaagctatcctaacctggaggatgtctcttttctttcctctgtacttaagaagcttttcttgttagggaaataatttagaattagatttaggctatgttctgttcttctaaaaggcttagttgtcaaaaaaaaaaaaaaaaaacaccaaaaaaccttggttcttacatgtcttaatgtgaactacctcctaatctattgtttaaataattatcctttatttagaagaacactacttcaacctgagttgaaggtttaaaatcttttcagtaaggagatttgagatctttattattgcataagctgttgtgttttaaatgctaaaagacatgctgtgttttaaaattttcaattgcaaatttttggcaatagaattcgcatacttggttttcttaaaagagttaagtacggttgatttgactaagctatctgtaggaaactcttaaattgatttataaaacatgtaattatacaaagaaaaataaaacatcttaggaaactcttggggattattaatggattttgccctgataatcatcatggcatggttttcattttccttactataaagaaaaggcaagggacaaaacttattttccatttgctatgaacttttaaaccctataaaatctgggatatagagtataagtagatgaacatagttactcttaaatcactaaaggtgattttaatgctttaacttttatagtacttcatgacataaagtatctttacgtatttttaatttgggtcccataaccttatggaggtagtaggcaaggcaatgatgatgcggctctttagaagttctttaatatcaaatgaaattattatttttatgccaatctgtgattgggaaatataatcagtagtctgtgtcctaacaagaaggtataatactttatacagggtattttgttaatatttgaagattttataccttatggcattaacttagcactgggaactatgattacccaaaacaaagcttcatccaaataaattgaaacagtgtttcttttaaaccatcattgaattagtctattgtttccaaacaacagccctgatatagctaaaattagttgctttctcttctctatatgttacatgactgtagccaaacatttgctatgaccagtgaccctgagtgatcagcaaataatcaacacattgagaccacaacttgaatactgaccttctgactttacgaagaaaaatattaaatgccactaataacttgaattccttttaaattaaaaaaagttataaattgcaatttgactttttaaaatgccacctaaaattgtttttatcagaatacttaaaaaaaaatcctcactttattctctgggggtgggaagaggcaattccttccttccaccacracattgaattatcacataaaattgtaaaattatgaatattatgattgagcttagtaaagcattttctaagttcatttatagtaaaacaagagaaaccttattctcaaaatctattctttaagtaaaacaaactagtcattctaacttaatatgcttttaaaaatactgaagttcagtacatttagcataaacttattgacgaaggcacatttctgcattatttgattttcagccttgtttcatttaagcattaatgacagaggtagagaacagaaatggttttaggtggtattagagcttttattgggattatgttgaaattttagtgttaaaaaattgttcgtatcctgaagggagggattattggagagaatgaatgatgtaggatgaacttgtaaattcagttttcggcagagtctaaaattaagtgatgattggcacttaatgaagctactaaaatttatgtagattttaatgtctcattagtaatcgcatctgtatctggttttataaaagtaatgaaattgaagacctgtacaaatacagaatgaatgaagcaaattctgctaacatcatgttgaatgttttctcagaaaaagaggaaatacgaagagaagagatttgttttgactgtgatttaccctcacccccatggatactttctttacttcctaccttttttctttttcttttccttctaaagattctggcaatgggtgtttcagtgttttttaagcttaatatttctggtactcatttatgtaaagtgatttctgaatgttaaaggagatttctttttaaatatattttcacttatttttagctttatgatgagaatcttattttttaaatctgtaacttgttatggctacatgattagtaaaaaaagtttttaaaacacactgtgtattcaggtgtgtcattttagtgtgaaatgactaatgcagaaatatgtgactagcatgtggtcagattttattgaaattacttacgatgtttctatggctagtccccttgtatttttataattggtaacataattcatatgttattttggtcttgtctatttgtgttacatgtattttagtctgaccacttttgctacttatttaatgtttatacattttatgaaagacttattctgaaatataccttgcataaatgtaggttaaatgcaaattgtattaatagtgaaatggatatgtgggtagagatcactttaggggccttttgagatttagtgaaggaaagattggatcaaaagggtttactttaatgtgactgcctaatgtgaaagtcggaacatctgcattaattggttagttacataaatcttagtctactctggcctgcaggtgactgaaacagcccaggaaatcttaatttacattaagcttagacaaggtctgaggcttaggcttagttcttaaagcacattcttttttactttaatgattattcctaattttaatgagcagtgggttctcattgtgtactagtacttaggtgggcaaattaaataagcaaaataggtttgtgctgaatagcatttacccttctgaggacatcctggtaatattttcatcaagagtaattgtgtaatgcaatatttacaggtatttgccagattaatgggcacttgttttcatatttctgagtcatggaaaatatacattgatgattcctgttgcataaagagttttcaagaaaattttgttgaattaagctataactacaaaaaaaaatccattacatrttgacctttagaaaggatttttaaaagcccatgctgtccttatttctgcagcttcagagagccgactgctcttattttcttctggcatattctattaatacttgggttttgtatttttcaagtaaataaaatattcctattgagaatttcaattttaaaaaagaaaaggtctactaagtgytcctttccctgttgaattatgtgtgatcatttctatgctaaactagattagggtgtgacttgtgatggtgatttttgttcattttacatattaagaaagaaatagaattttattgcagttcaaaattatttgtagacagtggttttaacccccagacacctaattgtgacaggttgctttccttagtgctcaatactgttgtaaatgtctctaaatacagaatttccagtggagttcatgaattaattgggggtggagggtgaagagggaggagcaacagagatgtgggatgctatagataagtttaggaatatccagatcagttctgaaaactaacagtttggatcaactgtcatgaattagaggtttaagaaaagaaaaatttaggactataggtacaagggaatgcatcaatcagaattacaatttaatttcttttatttcaggtagaaatctaaaactgaccatggctatataatactaatttttgagttatgttgtttcttactatgctttattatcaaaaaaggataaaatgcacattttacttgaagattattttagctaagattaagttcatatttttctcatttttatttaagctgctgtttaataaatgaaaatctaatgacttgaatgtagtcgacctaatgtcttaatgttgatataatcatttcatatatcatagtgcccttttacagccattgtcaactgactggagagcaacccttttctttggtaatatatttctatgggttatgtatttttctgctggaatattgagaaaattaatttttcataatatgcagaataaattatggggttctgcaagtgctagacagtcacttaaaccatttatattgcaatacattccttaaattcagtattttgaatgaaagtgtgttatccccgaattttatcacttgtccaatttaaatattaattacatcccaatagagctgcatgcttaaacatgctttttcagagtaacccaagtattaatttcgagtgcttttaaatattttttctttttagcaagtttcaacaacattaatcctgtctataatgcagcaagttcagtgaaagtacctgttgttttataatttttttttcattctcactgtagggcaccaaaaatatatataaggggaaaaaagttttaatgatatgattagttgtaaatgtttacgcattatcttaccttgaatttttatttttgtaactaataatttgagagttcaataagtatgcagtgtttaagacatagtttgttgcaaaaagtgttaacttactatttctttttacaataaaattagcctttattctagttgatttcataactgtccataatatttagctgtggctattatgaaagtatatttgatagccaaattttgaaagctattatgaaatgatacaattcactacatgatttattatttcatgctggttggggcagtgctgtgacttatgaccttatgattgtcacatgctgaacactaaagctctaccagtttgttatggacactgttttactttatgttatcgttttaatgttttcttttataattattgaggataagagcttccttaattttaagactatttaaattgcagattttgcttttttatttttttaaccatcccttccaaagaatttgatttagatattcagtagtagaaacagaagaaaaatactcaactaaaagtccaaagacctagtttctaatgctaagggagacagtccatggcctccaactaggtactttggagtcaaaaatactttctttacaactgtgtttgaattgttttcaaaacacctgtgtgtgtgtttctaaaattccacaatccttttaacccgtcaatttgatgagggaagtaattagggtagggaatggtataacaaagttggttctttgacattttctttatagattatcgaatgtaagacaaatagatgtgaatgcagatttggtgtttttataagataaggatttaaaataatgtagttggtgatatataaaaataaactattgctgctgttagcacccgagaggtggggctcttgggttctcagagcttgttttctatgttcgttacagttattttagattagaacttaaaagaacttgagagtttccctaattctaccccctaattttttcgaatgagaaattgagatccatagaaagtgttgaggtaaagatcacaaaacacttaatgagcggtgttgccagtttgaatatctcaattcttagttatctaagttccctggtaggcttctttaattatctgggtctcttctagacatctggaacaaatagttgattgacataatacagactagccacatattttataagagttacttttgactcatttagatttttaaaatatacagtgtctgtattcttctctattcattttgttaatttttttttacctaataatgattaagcaccaattatgtgacagcactatgctaagcactttgcatgcattcatctcatttaaatctcaactctgtgaaagtttttattctagttactgtattaagtctcaattctgtcaatatccatgaagcacagaaggcagctgttatttaccttaattttacagatgtgaaaactaaaggcatttaaagagaaaaagaaaaaaaaaaccaggaaaccttaacacttatctgaagggaaatatttaatattgggtatgttagttcctcatgtatctttaataatttttgtcaacagcgaatctttaaataaaatataaaggatcaggcctctgctctcctgcatatatttgtaaagtcacttactgctttttgtcacagtttcaatttctgtaaaatagtgagagggtttttacctgacaggatttgtgcatgtacgtttactttgaaaattaaaaagcattaggccaggcgcggtggctcacgcctgtaatcccagcactttgggaggccgaggcgggcagatcatgaggtcaggagattgagaccatcctggctaacacggtgaaaccctgtctctactaaaaatacagaaaattagccgggcatggtggctggtgcctgtagtcccagctactcgggagcctgaggcaggagaatggtgtgaacctgggaggcggagcttgcagtgagccgaggttgcaccactgcactccagcctgggcgacagagcgagtctccgtctcaaaaaaaagaaaaaaaaaagaaaagaaaattaaaaagcattataaaaatgcaaggtggaatttttaaagctctgccaagtccacttagcttaaaccagcatgactctcattggctaagtacgttatgacatctgtgactgtggtgtaggtattgcctataatcaagaatcttttagggtctgctatgtgcaatccctgaagggtcatggatcgcagtttcataaagactgctgtattttaaagccttcaaatgccaacgtagtatcttcacaatgattttttttttcagttttattattttttgaaagcgccttcgacaaagttttcagtggattttgttgagggatattaagtatgccatctacataatagccatagtgataactccaaccacattgttatatttttattaataaatgctagagtattctctttctggtatttcctattctgatatttttatataatcaagtatgcaaagattctttgtcattggaaaccttaatttgcctgaaaatgggaatgaaattttcaggtttaaaatttttttacatttattacatttattgaagctgtctgaaaaagctcttgagtatattgaataccaaaatttatcctaactgcataaagttgggaggattgtgaaacttgactgcactgacttgttttctttattgatcaaatggttgaaaaaaacttcagttaaacaaatttgatctattaaaccaaagttataaaagcagaggaaagcatagaattattaaacggcagtttaaattggtaaacataccgatgtagaacctaagtttgtaggcagctttcttagatggaaacttaaaaaaattttaatcagaacattatgtgaaatttgtcatctggaattcagctgggtttattaaggacaaagtgtatggctataaaatagattgagttttttttttaaaacagaaaacccaaaataaatgttctaagtttccaccttaggaggctatgtatattgctcctctttgaaactgccttcagaaccaccttgtaagccataaaagaaaatcggactcattgcactatagtaacacctaactgttcttgctcaaagaaaatgtatttatcccttagctttatttgtgtgactccaaatcatatgagtattgccagatatttagaaatttaatcctctctcgaatgataacatttattttctttgagggtttttaaaagagcccacatagatatttctacagaaaatgtttaattctgttttgaatatgcctggaataagtgaatagcttcccagggtgactattctgaaatgggtgatgcttagtggttaagttctgatttgtgttttcttgaagttattaaggaactttatgataacagtttatatattccctcttcttggcatagtaatgargtaatagagactattcacctctaagcctgattttttaaataagtgtttattttatgtttaagtaaggtaggtctgcttttggcttggacttgaatttggcaatagcagatataaagtaaacataatgtgaattcctacaacagtctcccaaacagtttaatttctcattcatacacatttcccttagtgtatcagggaattaagtatctgattatcagtatagcaagaacaactcaagtatactgaagttatttatactcataaaatagtttgagttatagctacaatataaaattaatatatttttgacttttattcctcacaacctgaaaaaaacctctgcgattactgatagtacttttaaaaactaaatgaattttgttactactatttgctaaatttagtcatgtttactgttcaaaaaatgctaggttaaaatggatcctaatctttgaaatgatgaagacatgtgtagtggtgtcaaaaataggatattcattttgtaactattctgttagtgccgaagttcttagaatttctttgtgacaacagcctgcttaagaactttagattttttagaattgtactaaaagcaaactgttttcttggatatttgttctttctccccaaaagatgatttataagttttcagagctaagaaatgggaaggaagagccatcctagcatggcaggtaatgttttactgctaacaggttttctctgcactgctttatttgccttgaacctcttactttgttctgtcagctgggaggctggtagattttctattaggtagcaaatgcttctcatcactaaacacatatcatgggctggtgttagtgcagtctgtggatgggcactacatttttaatcaagaaatgtttttaaaggaaagacaaattggtgaagtaatttctaattcagtattttagggatgagtgaccttttaattgataatgatatttaacagagctgtacagtgctttgggggtcccacagacatgtttaaacaagaaaacagtaaataaggaagccagaaggaaaagttataaaactattaagaaagaaaatgaaaattctaaacttcaattctggtgcctggctaaatttgatttttgtatgcctcagtgtttctctatggacactgggaaatcaataagcaacctagctacgttattatgttcgtaagtggaagaactaaagaactacaaagacatgttctaggccaagaattctggtggtaggtagagtgggaggttaactagatgatctccaaggtccttctaattgcacttggcagcagcaagcatttatcaagctagacactgggcatatggagatgaagaagatgaatatccccagcagcatggagagcactctgatgatagtcatccctgcctccccctccctcagtttgctttttgaaatgtgagcttgaaagatctcaaactccttcctgggaagacataactgaaacttcatggaggaaagtgcatgaatgaatgggaaacaagatttgattcaactatttggaataagaaaaggggcaacaaggagtctgaaacaaatgaaagaaaagatggaaagaattagttgactagatgaggactgagtacataggaatgagccaacaggagacttcagcaactaatggatgaaagtattatgtgcatgcatgttgtcatcaaatatcacatgatacaagacaaggagaaaacatgactttcaccataacctcagtttgtgtaccctagttgcaagatatttttttcttctagtcacttaagaatatccttattgtctaggagaaataatcctctttctgggctccccagtgtataagcccaaatctgaggaaaatttacctgaaatgttctttccccagatacccacatggtttactctctcatttaaatgtcagctctgtaaaagagatctctgactgctctatctgaaatagtagaatctttcacagtctttccttcttcttgacatcatctatttgtgtcttatctgctcacctgctacaatgtaagctccatgagagcagtgatactgtctgccttgcttactcctgtatgccagcgtctagaatagtgtctagcacatagtaagacctctacaaatacatgttgaatacctaaataaacaaaatttaacatataaaccaaaaagatatataggaatggattatatttctaatctttctcgagtgaggaaaatgtcagcagatagtgaatatcactgagagagagatgatagcccaggttatcttccccagatagaaataagccttragactgacaggtgtatatgaatacagagagtatacataaagaagatgtattttcaattgtcagtctctaaatttgctttaagacttcgaaatggattgcttttcataatttcttagaataactctggtctgtttaccattgaaaaattagagtagccaatgtttgtaaatgaagggttagagggttttttcctttggtggtttgttaaaagcttgctcaaggcagtaacatagtaaattgtcaatataggaacttttgtagcagaagctttatgcttttcacttttataagaattgagattatttaagcagatgagtctaatgtatatgtttgtactgacttacctagaaggtcaggcaagaaatcggtttcctcatttttcagataagtgtgtgtgtaatcactgagtaccttaagagaggaggggtgttttatttttgcctgaattttcaaaatatctttcttcagcttatttatattttagatttgacttattctgtctatagtatataacagtcaggaggttggtaggataagttcatctcttctactaagagttataggagagttcaacctaatatggcaatgacagtcgcagaaaagagaaaatgcaagttaagtaggtgttagccatagcaagaaaatcagatgaggtcatttaagaatgaactgctctaatgttcaggaaaaaagaggggagggacaaggacagggctctagaaggcaaccaaagagagcagccacaaaataaatgaatagctgaagaattaggagacaacaatcttaaaatgtggcagggagagggtagttgtcacattaactagcatagaagagacagaatagaataacataaatatatgagtgattattgttcttgaaaccagtctttaaaacatgggaacattcccaaaaatcaaagccagataaattagggaaatcttaaatggcacaatataactagtgatttcgtttataatttttttaaaaaggagacttaaatttgaaatttagatgtaattaaagcagataataagaaacatacttctgagaccacaaagaccctgagattcagttaagagtaaggtagaaaggctggaagccagaagggaattaagtttctgttccctgagaagccaacacaacaggaaaaaactggccacaccctagttcaaactcttattactcttatcaatagtctcctaattgtttctctagttttctcctctcccttcttaattcattctgcagtctactgccagattaatcttcctagaacaccactttcagtattattcccctgatcaaaaaatgtctgtggttttgttgctcatagcatagtggttctccttctttgtaccacagcccatatgcacgatgatagatggtgggtagccacatgaactctccataacctttggaggatttgggttatacacagtctgttatccaagaaagcatatctgagtgtaagtgagcattatagggatagtcttataattgactccttttaaaatttgttcttctttttgcaaatgccccttcagaatttacagaaatagtgtgttcattccatcagtaaaattataccccaaaatgttaataagcttatttccatcacgtctcctttcctatttctttctttcctctttcttcctgcacatctccccttatcctccacatttctctgtaattacataagcataaacagacacatatgagattttctgggttgcttgcctttaaataaaagaatgggattatcttatacccctttgtctgcagcttgcttttctcacctaacaagtacaccctgaacatccttccaggttaacagatgcggatcccattcttttaaatagacaatattctattcatgtggtttcgtgatttttgccactacaagcaagtttctaataaacacccttttctatgtaccctttacaaatagcaactttttttctaaatataaatgctatggtttggctctgtatccccacccaaatctcatcttgaattgtaatcctcacatatcaggggaggggcctggtgaaaggtgattgaatcctggaggcagacttctcctctgctgttctcatgatagtgagttctcatgagatctggttgcttgaaaatgtatggcacttccctcttcactcactgtctctcctgctctgccatgtgaaaacatggtttctttgccttccactgtgagtgtaagtttcctgaggcctcccagtaatgcttcctgttaagcctgtggaactatgagtcagttgaacctcttttctttgtaagttacccagtctcagttagttctttatagcactgtgaaaatggactagtacagaaacttggtaccaggacagtggggcattgctataaagatacatgaaaatgcggaagcaactttgtaactggataatgggcagaggttgcaacagtttggaggactcagaagaagacaggaagatgagggaatgtttggaacttcctagagacatgttgaatggttttgaccaaaatgctgatagttatatggacaataaagtccaggctgaggtggtctcaggtggagatgaggcacttattgggaactggagcaaagttcacttttgctttgctttagcaaatagactgacagcattttgcccctgccctagagatctgtggatctttgaacttgagagagatgatttagagttcgtggcagaagaaatttctaagtagcaaagcattcaatatgtggcctggctgctcctaacaacatacagtcatatgtgttcacaaagagatggtctgaagttggaacttaggtttaaaagagaagcagagcataaaagtttggaaaatttgcagcctgaccttgtggtagaaaagaaaaacctattttctggggagcaattcaagtgagctgcagaaatatgcatagatgaagagtagcctaatgttaatagccagtagaatagggaaaatgtttccagggcatgtcagagaccttcatggcagcccttcctatcacaggcctggaggtctaggaggaaaaaatggtttcgtgggccaggcccagggttgcgctgctctctgcagcctcaggacrtggtgccctgcatcccagctgctctagctccagctgtggctaaaaggggccaggagataatcttgggctgttgcttcagagggggtaagcctcaaaccttggcagccttcatgtggtgttgggcctatgggtgtgcagaaggcaagagttgaggcttgaaagcctctgccttgatttcaggatgtatggaaatgcctggatgtccatgcattctgcaggggcagagccctcatggagatcctctgctagggcagtgcagaggagatacatggggttagagcccccacacagagaccccactggggcactgcctagtggagccgtgagaagagggataccatcctccagactccagagtggtagatccactgacagctttcaccatgtgcctggaaaagctgtaggcactcaatgctagcctgtgaaagcagctgcagggtctgtacccagcagagccaccagggcagagctgtccaaggccttgggagctcaccccttgtgtcagcgtggcttggacatgagacgtggagtcaaaggagatcattttggatttttaagatttaatgactgtcctgcaggtttttggacatgcatggggcctgtagcctctttgtcttaaccaatttctctagtttggaatgggggaatttacccaatgcctgtatcccaattttttcttggaagtaactagtttttgattttacagtctcataagcagagtggacttgccttgacccaagaagactttgtacttggacttttgagttaatgctggaaggagttaagacttccggggactattgagaatgcaagattgtgttttgaaatgtaagaacatgagatttaggaggggccgggggyagaataatatggcttggctgtgtgtccccacccaaatctcaatcacttgtaatccccacatgtcaggggaggggcctagtgggaggtgactgaatcacaagggtggacttccctcttgttgttctcatgatcgtgagttctcatgagacctggttgtttgaaagtgtgtggcacttcccccttctctctctgtctcctcctctgccatgtgaacatgtgcttgcttctccttcaacttccaccaggattctaagtttcctgaggcctctcagtcatgcttcctttgaagcctgtggaactgtaagtcaattaagtctctgttcttcataaattatccagacacaggtagttctttattgcagtgtgaaaacggaataatacaatagatttccccaaagttgggttcctgagtcaggggtatgtgtatttaaaattttaacagatatttccaaattacttttttcgaggattatggcaagtcacagttccccctggcagtgtttatacttttctttataataaaaatacataaatcattattactaacaaattccttgccatgagtcctaaattgataacaacataccagtgtgccatataacatagctgaggactgttgcagtctagaattcaggctccttctctctgcttttaacaatatgtgtaatgttcaagaccaatttagtgccacttattttgtatgctttcctttatgtagtccaggccatagccccccacctcatctgatggtatcctctggcagccacagaccacacagttctttctacctaaattagtcattagcacatagtaggtacccagwaaatgtttgttgaattaatactgtttatatatttctaatttatctccaagtaaatccagtctccttaaggacaaggaacgttttcactataacacctagcacttaaggtactcaatttaggtagggctgtttgaacaaagaaccacagaggaagcaaatagcatggccttgcctttaatacatatattttactttctcttagggaaaactggaactgtaagaatctagtaacaataataagaacagcacttttattgagcagttactatatgtgaggcacagttcaaactgcagaggatacaacagtggacaaagctttagttgtttctgcctttctgaagcttatggtttatgggtgttacattcaagacatttgtaggacacattctaaaatgccatccaatttcaggctctttccagcagaaactgtggaatatttttccgttcattcagcatttacttagtgcctgctctgccaggaattgaagagaaagcccaaagacaggcagaccttacctgagaggtagtgaactgaccaggatgactgtgggcagtagacttgtttcccaaactagcctcaccatttctgtatttgcatatacgaggaaaggattagatatagggattcatgtcagcatacaccccagggacatttgtttttagtgaaaggtgccagtcttcatccctgtacccagtacacaaaccacgaagaagtatgctcccgtcattgtcaaagaatcatagaattccaaatggagctagttttgatatccagatctcacttcatatgaggaaactaggtccagtattgtgagtaagaattaggactcttcagattccctgggtatgaatctgactaacaactgtgtgaacttgaccaaattcataaccctgtaaactctgtttcctcacttttaaaatgggcacaacaaagtgatgcatgtaaactgcatagcacagtgtctggcacttaaaaagcactcctgaagttatttttagtgatgtgttttaagattagacaactccttaatgccaaaggtttttacttgagaactctgtctgttgtgccatactacacgctgttcataagataagcctttttcattaattgatctcaaactggcttcattatgatcttaactttatttcagttttatttttaaaatttatttttaatttttatgggtatatagtaggcatatatatttatggggtacaggtcatgttttaatgcaagcatgcaattgtgggggtgatatataattgactggggtgagatatctcattgtagttttgatttgcatttctctgatgattaaggatgttgaacatttcttcatacacctgttggccatttgtatgtcttttgagaaatgtctattcagatcttttgtccattttttaagttggattgtttgattttttcctgttgtctgaactctttatatattctagttattaatcccttctcagatgggtagcttgcaaatattttcttccattttgtgggttgcttctttgttgtttcctttgctgtgcagaagttttttagcttgatgtgatcccatttgtccatttttgcattggttgcctgtgcatttgaggtattactaaagaaatctttgcccataccagtgtcctggagagcttcccaaatgttttcttttagtatcctagtttcaggtcttagatttagggctttagtccatttttatttgatttttatatgtggtgagagataggggtctagtttcattctgcctatggatatccagttttcccagcaccatttattgaagagactgtcctttccctagtgtatgttcttggcacctttgctgaaaatgagttcactgtaggtgtatgaatttgtttctgggttctctaggtctgtgtatctgtttttatgctagaactatgttgtttgggttattatagttttgtagcataatttgaagtcagataatgtaattcctccagttttattttttttgttcaggatggctttggctattccggggcttttgtggttccatataaatcctatgattttttttttctatttctgtgaagaatgtcattgatatttattaataaagattgcattgaatctgtagattgctttgggtagtatggacattttaacaatattgattcttccaatccatgagcatggactatctttctttttttgtgtgtcctcttcaatatttttcctcagtgttttattgttttcattgtagagctctttcacttctttcgttgagtttattcctaggtgttttattttatctgtagctattgtaaatgagattactttctgatttcttttttagattgtcctctgttggcatctagaaatgccacagatttttgtatgttgattttgtatcctgtaactgtactgaatttatctgttctaatatttttttggtggagtctttaggcttttccaataagatcatacagtctgcaaacaagaataatttgacttcttccattccattttggattccctttatatctttctcttgtctgattactctaggtaggtcttccagtacttccagttgaataacagtgggcactcttgtcttgttgtagatcttagaagaaaggctttcagtttttccccattcagtatgatactagctgtcagtttgttgcagatggcataactttcaaactaattgattatagttaggaagtggatactttaacttgtggtaccattatcagatttatatttcggccataagcttgaagaggagctgaaaaatgcatatgtgatgcatatgcttcctatttggctctcttctcccacccccctgccctataatccacacaagttcctctctcagtcactcatcaactacttgaacctctgaggaacttggggttaaggtaaattagaataaaactgtctgaagaagagcaagcctttcatgtcttgagaaattcttggggttttagaaataacttcattgctttttttctccagttactttggcttcttcttaaagagaatactaacactttgaacgtcataatactaaggttctgcctcttcaaataaagactttaaaaaaaaatggtttttgtatgattcagtgtgaattaaatcccacagtgtaaaggactttactttcttaatgtagattttcaaatacacaattactgatgtttataagtagatttattacaccaaagcacctagcaaattcttgaatggatcaggtcttatttttcagtcttactttgcaaatttaagycaaataattaaggatttgttaaatatttgtcttaatatcaagcttttgcatatcggggccctcttttataagctttataagcaatcttttgttttctctgcttgctcaaagtagctrtgtttgttgtatctgttagtatttgctctataacaaacatactgggtgccttcccacttagatttggcaattatcactcctgtaaatgagatattacataagataggaaaaagaacagtatctttccaagaagaatagtatccttccatattaacagtttagagctgactgcttttaaaatttagtggctttaaaataacaaccatttattattcttcatgagtctacaaatgaggtgggcagttctgctgatctggccaagctgaacttatctcagctgggcacattcagcgtatctgctgtcagttggctggttggctgtagcaatgaatggtgaaagtaggctgcccttaactttttcacacagtagcattagagttacaaaagaaccagcagaaccatgcaaaactctttaagacctaggcttggaacaactatatttctaccacattctattggtcaaagcaaatcacggggctagtctagattcaagtgggtggaggagctgcaattacactgcaaaggagtgtgactgtagggagaggtgtttttttatttttatttttttgcgatttgtcacagtagttgtaggaatcaggtgtatttaaaattctgatccttctgtgatatccgaattgttcatgaaccttgcctctggtggaaaggcagaatcattgtgacagaaggataaaatcttggaatttagagactaacaaaggttcagattccagctccatcacttatttctgcaatcctgcagaagttaatcttcctgataggcattcagtaatgattgattcacctgaacctcagattctttatgtattttaaagaaagggctaggtaaatgcaaagcacttatgtaactgcttttattattgcaaacctggctcccacactccattcaaggtgtaagactcagtgtcttccttgaattaaaaaggaagagaaagtgtgttagggaaaggaagagaaatatttgactaattgtggccccaataaagtgaccactcactgggggtattttcctgtaagaaaagaatggttgaggctcagagttaagagatacaaatccaaaagtctccttggggtaggattccctgtgattcatgggttgagaggtgtaacattagacacagtcccagtctagattttttttttaaagaattgtggtccatcctatacacactgggtgccttaatactatatgtggcaattatcactcctataaatcaggttttacataagataggaaaaagaacagtatcattccacattaacaattgaaagatgactgcttttaaaaaattaaaagggccatatagaaataaaatcacataaatttcttgtgttaaacatagttgtcatattggatgaggactaaacacctaaattcatccaactagtagtaatagaaaagatgaaacacacacacagtaaaactagattaatttaatttatacaaagggccagatatctcagaattcagacagtcagagatgttgactagagttaatgcctcttttaggagaggtaccaggtaagtgttctcaaagaactggaaactgagaccaccacctctggcattatctrtttgtgaacacaagcaagtctgaatttttccgcaccatagctacctttcatgtaagcttcttttcttagaagaaaagaaggtaacatttgggtgtaattttttattaagggtgaaatttagtgtagagagtaaaggcatttggcatagaagcccttagttttttttgtttttaagttgaactgccagcctttatggattgcagtcttcgctgttttgattgacatttcccaattcattttgtattatttatttttttaagagacagggtctcactctgttacccaggctggagtgcaatggggcaaacttggatcactgcagccttgaactcctgggctcaagcaatcctcccacctcagcctcccaagtagcttggactataggtgtgcaccaccatccttggctaattttttaaatcttttgtagagacagggtagtgctctgttgcccaggctggtctcacattcctggcctcagttgatgctctggtctcagccttccaaaatgctgggattacaagtgtgagccactgcacctggcccccaatttcatcctttacaaagactactttcaaccataaatcaacggaaacttcagctccctcagacatatttgggatccaaggatattttcccaaatgattaatgctaatttcatatcaatacatttttgcaaaacctacaaaaatggactagtaaagaaagactcttaatttgggaaagacagttacttggagagaagagaaacttaagaggcaggtcgagttcagtgttcagaaatgagaggatcataaagagatagccataaaaatgtttctccctatattgcctgctgatagggtgtatcagtgaaggtcttactaaggaccttgtaccttttcagcgctgcactgcgtgctcatagggaggaaagataaatcatgtgttttttctgacctcaaaggagcctgtatctggctagagagacatgatgcagacacatgaaataattaagaaacaattaactgtagcaggtgctgaagaatataccaggaggtcagagaatggtagagctagtgtgggcgaaggtatagcccagagcatcatcagatgattcttccttatgcaaattcacatctcctctgggtcaagtatcatcctggcatgcagcagctccataggtaatgccctaaggctagcctgaggcaagttgcaaaagccatcatattgagtcatggcctttttttgtgtggggggaggggaatggcatccccttcctgtctgccaaatcaaggaatacagtgccctcctaaacctgctttgttttagtggattgttaaaaagaagtgaatgaatttatgcttcattagggaaaggttacagtggaatactgaggagtaaggggtatttctatttaacaaatgacataacttgaaggaatgaaatcataaggatggaatttcaggcattaataaaaagctgatgagagatactttgagacaaaagagccttcccagtgtaaccgagatcacagcacctacttcacatacacaggaaaccagtcctatctgtctctcccatagagcagtagctgccttgtttttcctccctcctccatcattcattctaaatctccagtcctccaccgcaccttatccaaaccctgatacccttaagtcacagatggtgaatcagtcaaaagtagtattaaaaactagtggtacacagctacacctggaatgcagtaagaaaaatacggatttctgtacatcatcttccctccctgctcttacccccatttaagagttacagggtcagaacccaagagtctgagtttttgaaagtccctaaaaattttggatgatcacctacatttagaaccactgcactaagaaggacaacaaatatgccaataaattctgttgccaaggaggtgattatgcaagctggaaccctgataacatgaggagaatcccacaatagccaaatagtccatgtactagttacattataataaagccaaaagcagcaggcctacctgactttctcctgaggtctatcatgagcttagagagaaggaacgtggacatatagaggtagctctagatggagaagggcactaggtgtcatggaaagaatcatgtgcaagaagtaaagaggtgctctgaatgtcctagccctgcttaggtgtctgtgtcctcacatgagaatttatccacagttctttcccgctgtaacaatctttggttccaactgcatttgtgagacagcaaaaagctatggtccagtctccttccattgtatcatctcatcaatgtatttctcccactacccttgtgtgaaatacaaacttttttggcttattgtgattatgcaaggtgtatgccaactttttttttttctccacatctttcagctttctgatgggtaaaaattttccttattttgctttagaaaaattctcattggcatagatctaatttcagggagcctcccttgaaagctaaataacattgagaattcatgaaaatataatgtagagcattatgcctgttagcatattagtttaaatagaagtggttcatgaaaatttttgaaatgccagaccctgtcctgtgttttgtattctcccaaatactcatccagatactgttcagaatgtaacatgattattttgaaataaagattttcccctagtttttaaaaaagttactttatacattaacccttatgttcctctttgatcaatttttccagtagtgtaaacagtcttcagggaagtagatttcttacagaaattgtcaagtggctctctgctgttagcatggttactaatcttttggttacttttcatattttttatactttctggaagtggacaacttacttgtaaataaaagtgcataatttgtattaaaaatttttagtaacaatctaatttgtaaaatagatgtgagcagcatgaatgtgtgtgatatgcgtacatacgaattatgtctcttaaaaatgtatcacagacatctttccgtgtccaaacaaatctacctcattctttctaatagccatatgggtataccataatatatttaactaggcccctattaaaagaattttgactcttttgtagctactatagtgttgcagtgtgtatctgtgtatgtatctttgtgtgtgtatctttgtacgagtgtacatatattttccccttggctatttcagatttttttttaggtttaaatcttaggaaaggttttgaaattgtcttaagtattttcagaagcattaaatcatggtttttttacatttttcttttagaagttttatgtcatctctatgagtagctttcagtaatttgttctgcataaaattcccgaaaacttccatttaaaaataggtggcatgactagactttctcagccgaaagagtgaggtcccaggaaggattttggagaagctgtgttcaaatatagctgctgacctgatgtctgcctagagtctggcaaggtgatgtgttgaatctagtgtctgcctgcatgccagcatccctttactgatgagatttgtggttttcatcacttcatggtaatyatcccaagttataagatggagtctctagaaaatcagtagagtatgaaggcccaagtaaaatacatgtgagtgcatgtatgtgtgcatacaaattacttctcttaaaaacgtatcctgggcatttaaagaatgaggacctccgaaggattttgtggaagctgtgttcaagtacagctgctgagcgtatgtcagcctggagcctggcaaggtgaagtgttgaatctagtgtctttttgactcactgttttttttgactcactgtgctttgaagcccttgtcatttgggctcataaaatagatttctgtatactgtctctcctccctgccctcgcccccatttaaaagtatagtggcagaacccaagaatcagagttactaaaaactctctagaaaatttggatgatcacccacctgatcatgtcttttttactcactatgttttttttttttttgagacagagtctcgctctgtcgcccaggctggagtgcagtggcatgatcttggctcactgcaagctccgcctccctggttcacgccattctcctgcctcagcctcccatgtagctgggactacagggcctgccaccgcgcccggctaattttttgtatttttagtagagtcggggtttcactgtgttagccaggatggtcccgatctcctgacctcgtgatccacccgcctcggcctcccaaagtgctgggattacaggcgtgagccaccacacccggccctttactcactatgtttttaagcccttgttttcatttgctccactgtaaaacattccccaagccaatctggagctgaggcaaatttttaacaatttaaaatctggggaatataaatattggataatgatcatcctgaaaaaacaatgaaggtagtagcataatactttatatatcaataaaatggcaaaataagacagttgttgaaggacagaaagagtaactgaagttaggagcttatcttaacacattttttgtgtcataccataggcatcatattttttaaattttttttatttcatacacataggaaaatatatgtgtgtaagaaataataaacacctctttgtacctaccacccaacttaaggaacagctcattgctattccctttggtgctcgctggatgccctttcccagtcacatccccctcccttcccatctgcaggactatactagtaaattttgtattttttgcattattttgctttgttttatgattttactacctatctacatatccctaaataatacattatttagtttcatatgttttaactttatgttgtggaatcacattaaatgtagtcttttttttttatattatactttaagttctagggtacatgtgcacaacgtgcaggtttgttacgtaggtatacatgcgccatgttggtttgctgcacccatcaactcgtcatttacactgggtatttctcctaatgctatccctcccctagccccccaccccccgataaatgtagtctttataacttgtttttttaactcaacattgtttgtaagattcatccatgtaagctgaagcttttttatagagatctttgttaagccttttaatgaatacagtacatacatttctctgttcccctgttagtggacacttggattgtttccagagttttgctgttttgaacaacgctgctgtgaaaatgtctcctgaaacacatttataagagtttttttttccccaagggaattatacctagaaattgaataactagatcacaaggcatacacatctacaacttctgctaggtaatgccaaattgtttccaaggagcgttagaagtgttctcatcaacttttactagtgctagtcttttacatttgtggcagtatggtgggtgtgaaatatttatgtttagtttttcttggtgccatttaataatttttataaaaaatatttagaagtcaaggcagttttttgtttttgtttttattttttgcttgttttgttttaatgcagacattgagattacgacttggaataaacattggttgcaaagttcctaaaaggaaaactttttttggtattctggagcttttctggtactgaataaaataagtatgttaaattatgcatgtgtagtttagaagtcagagcaataattgtgattgttgaacagaatggcagtaaaaagtttctaaacgattgtactgtacaagggacacttgttgtgggtcagttttagcctccccaacttttatgttaaaagttgcaacaaggtttaagggcttatgtttgataggccagatggtgaccagctgtgataaaacacagggaacccttgcaaargatttcaaaatttatgcagtagtccgccttatctgcagttttgctttccaaggtttcagttacccgcagtcaactgtgttctgaaaatattaagtgaaaaattacagaaataaagaatcgaagagttttaaattttatgcttcccacccatcccacctgggatgtgaatcattcctttgttcagcatctccatgctgtaggtgctgcctgccccttagtcacttggtagccatccaggttatcagattgactcttctagtattacaacacttggcttcaagtaatccttattttacttcatagtggccccaaagtgcaggagtggtgatcctggcaattcagatatgtcaaagagaagctgtaaattgcttcccttaagtgaaagatgaaaattctagacttatatataaagaaaagaaatcatatgctgagactgctaagatctatgataagaatgaatcttttatacatgaaattgtgaagaatgaaaaagaaatgcgtgctggttttgctgtcatatctcagactgcaaaagtttgcagccaatgtgtatgataagtgcttagttaaaaggaaaaaggcatttaaggtaagtatatatagtgtttggtactacctgtgatttcaggcatccattgggggtctcctgagtataaggggagactactcttttagtgttaaatgaacactaaggaacagagatggggaagaggttggagaagattagttcagcagtttgagtataggtaaacagttgtttgagaaagaagaaaaatgtgattagtattttaccttagcaatagtggcatagataatgataaattatagtcacacagaactcttagtatttacagaacgttcacatttgtgatcccatttaacaataactctgaaagaaaggtatcatctaccactgctttattgataaagatataaaaggtaagagagatgaaacatattggccaatgatacccatctggtaagagacagggatggggtgggaccccaaggctcttctcgccaagcccacggtttttttgctttatacttttttgcctcctgatcaccatggctgcagtttctactgtggacaatgtctgtcagcaagcattgatcccctgccttcagcactcttacgtcttagcaaggactggaaagaaaaagccaggagtttacagtctgctggagcaacagaaaagaatgatatgaaatatgaagagaccaaaatgatttataataaggtgctagactatgtagtaaaaatctgctttagctgtaagtcaaaagcaagagcagtcttttcagaatggaatagaaatgttggaattaaaggaattttcaaagttgtgaatttttttcaagataaacatgttttattttggtaattatggtattactaatttgataaccttcagggagccacctaatattatagaagatgtacatataatgacaaaagcaaacattttatttttaaggaccacaatctaatctaaaacaaaatttcccccttttctggtctttggttaattaaggacttatttaaatatcaaagaaagacacatagaaaacatttagtatatttctatacttttattaatgtcctccataccttacacagatacttgacttggctatggtctagataatccatgaaaatttaaaggacagattttaacaactttatgctaaattgatagatctctaggatcagattgccatcactctcagatgcgaagcttccaaccacttataggttcctgatatcttgcttttatacagacctaatttctcttcctttaaactttcttttcctcagttgctatttgattgaaatattgagtcattaaaaatttccaagtgggaatttttgtgtttctgcatctatcatgaagctgctcaaataagtaggtgtttgaataggagtagaaacagtaataggctgaagccagaccaatacagcttcagctaaatgccgaccttgctaaagtctgggaggaccggtgtggtattctacaatgtacaagtctgtagccggtgcccttaatatgttggcttcatgtctcatgactctcttctgtaaatatgcagtttaaaaaatacaagttattctgctgtagaagatacatttgcaaaattgatgtatcccctctaagtaaagttggctaaacaataaggacatatttataattaatgaatttgagaagaatgctgacgatatgcattattctttgaagttaacatttttcaggtcctaaataaacaaaaagtaggttacttctgtctggagtgtatgcaaggggtaccatcttgtccttggttcctggctgctattccaaggtgctataaagtcagctaaagagagcaatcataatacattgatagcatccctcaatgtgtttctgagctacttgagaatcttatttttgaataggtagcaggaaaccatctttgcagggcagcatgggcaaagggattggagggactattattataaagatccactgaactgcttcagtatcataatatcttaaactaaaggactggaaagagccagattccaatttaatctgctcttctatgaattcttagctgggttcatttaaaaagaaaaaacttgaagattgcaagattttgaagacatcttaaaataggtgaactccaaggtgcactttaaacttgagactgataactgaatactccttcaccttttgatctgatattgtcaaaatgaatgaggacttagtgctctagtaagtttggaacagaatgatattaatttattttctcatgattgattcttttttgctttttaatagattaaacttcaccgtagaacagtttctcaacctctggactattgacatttttgattggataattctttgctgtcagggctgttctgtgtgttgcaggatagttagcaacatccctgacaatcacaaatgttactttctgtctctatggatttgcctattctggacatttcgtataaatagaatcatatatatgtggcttcttgtacctggcttatttcacttaacatgttttcaaggttcatccatattgtagcatgtaacagcacttcattttctttttatggctgagtaatattctgttatgtggatatactaccatattttgtctatccactccttagctgatggtcttttaggttgtgtccattctttggctattataaataatgctgttaagaacattcatatacaagtttctgtgtagacatatatctttatttctcttgtgtggatacctaggagtagaattactggatcatatgataactctatgtgttaccttttgaggaactgccaaacatttttctacagtggctgtatcattttacactcccatcagcaatgtataagaattccaatttctctgtccttgcctatatttattaactgtcttttcttattagccaactgctgtggttcgaatgtttgtcccctccaaaactcatgttggaacataatccccaatgtggcagtattgagatgtgaggcctttaagaagtgcttgggtcatcagaggtctgccctcatgaataggctaatccattcatgagttaatgtactaatgggttatcactggattgggactagtggctttataagaagaggaagagaactaatctagtaagctcagccttctcactatgtgattgctgccctgtgtcaccttgggactctgcagagagtcctccagcagcaagaagttcttcatcagctgtggccccttgaccttggacttcccagcctccagaaatgtaagaaatccatttcttttttttaataaattacacagtctcacgtattcagttataccaacagaacacagactaagacaccatcctattgggtatgggtatctcattgtgttttttatttgtgtctcccaaatgactaacgatgttgaacatcttttcatctgctttttggacatttgtgtattttctttgaagaaatgtctttaacattctttgcccattttaaaattaggttgtctttttattgttgagttgtcggtktgtgtgtgtgtgtgtgtgtgtgtgtgtgtgtatctagaatatatgtgtatgtatatatgcagatatattctaaacactagacccttatgaaatatataatttgaggacaatttctcccatttaaaaggccatcttttcacttcttgatagtgtcatttgactcacaagtttttaatttttatgaagtccaatttattttttaattctttgtttttggcactgtatctttaaaaagttgcctgatctaaggtcaaactgattttcacctatgttttcatctaagaattatagttttagctcttacatttaggcctttgatccattttgaattaatttgtgtatatggtgtgaagtagggctctaacttattcttttgtgtaatgatacctagttgtcccagcaccatttgttgaaaagattattctttccccattgaatggtcttgataccttgttgaaatcaactgaccataaatatataggcttattcctggactcacaattctatgagtctgtatgtctaatcttatgccagtaccacactgttttgattattacatctttgtacaaagttttgaaattgggaaatgtgagtcttccaactttgttcttttttaagattactttgcctatattccgtgttcgttgcaaactcatatgaattttaaatcaactctccatttctggaagaaaaaaagaggcaattgaagttcagatagggattgcattgaacctgtagatcagtttggggaatattgccatcataacaattagtaggtcttccaacccatgaatacaagacttctttccayttctgtagatatttagtttctttcattaatattttgtagttttcaatataaaagtcttgtacttcgattaaatttattcttgaatattttgggttttgatgcttttatgaatttgttttcttaatttcactttaagattgttcattgctactgattagtaatgcaactgatttttgtgtgttgatttttgtatcctgcaacctagctgaaatcattgattagcataatagagtatttaatagatttaggatttctatatataagatcatgtcatctgcaattagagataattttacttcttccctttcaatctggacattttttacttctttttcttgcctagttgccctagctagaacctccagtgcagtgttgaatagcagtggtgagaatgagcatctttgtgttggtcttcatcttgtggggaaacctttcagtttaagtgtgttgttgtggggttttcatagttgtcctttatcagattgagaatgttcctttctgttcctagtttgttgagtgttttctttttgattgttttaatcaggaaagggcattagattttgtcaaatgctttttctgcagctattgagatttttgtgtgtttttctggtcttttatggtttatcacattaattgattttcatatgtcaaacaaaccctgtgttcttgggtttcatctcacttggttatggtttataatcctttttatatacttgtagattcagtttgccagtattttgttgaggatgcttgcatttatatttataagggatattggtctgttgtagctgaccagtaagtatagtaagctgtatagtttactaagtgttccctctgttttgggggagactttgagaagaaggattgttggtaattgttctttaaacatttggtaaaattcactagtgaagccatctggggtcttctttggaagttttttgattactaacttaatgtctttacttgtttgttataagtccattcagatttttttctccttgagtcatttttgacagttggttgaggaatttgttcatttcatgtagttatctaattggttagtgtataattattcatagtattcctttataatcttatttttttgctgtaaggtcagtcataatgttcactctttcatttcggattctggtaatttaagagtcttctctccttttttttcttggtcagtctagctaaagtaaagttttgtccgttttcaggggaacagctttttttttttttttgaggcagaatttccatcttgtcacccagtctagagtgcagtggtgcaatctcggctcattgcagcctccgcttcccgggttcaagagattctcctgcctcagcttgccaagtagctgggattacaagcgcccaccaccacgcctggctaattttttatatttttagtagagacggggtttcaccatgttgggcaggctggtctcgaactcctgacctcaggtgatctgcctgccttggcctcccaaagtgctgggattacaggtgtgagctaccgtgcccaacccagctttggttatttttgttgacctactctattgtttttctcttctctatttcacttatttctacactggtctttattattttcttccttatgcttgctttggacttagttcttctttttctagtctcttaaggtggataattaagttcctgatttgaattcttacttctttgtaaggtggtcatgtactgctatgaatttccttctcagaaatgtatatgctttcactgcatcccttaagatttggtatgttgtatttttgttttcatttgtctcaaggtatagtcttctgatttccattgtgatttcttccccctctaacccgtttattatttaggaacttgttgatttccacatacctgtgaactttccagatttccttctttgttaattctcagtgtcattccattctggtccgagaacatactttgtatgatttctatcttttaaaatttatttggcttgtcttatgacctaatacattgtctatcctggaggatgtttcatgtacacttgagaagaatgtgtattctgcttttgttgggtagagtgtttgacaggtgtgttggtacatagttctgttcaaatctgtttccttgcagatttctatctagttgttctgtctattggaagtaggatattgaaatctccaactaatattgctgaattgtttattgttttcttcagttctgtcactttttgctttatatattttgaaattctattgttaggtacaagtaagtttatgattattatatcttcttgatagattgattcttttatcattatacagtgccctataagaacaatttttatcttaagtctatttgtctatattagtatagccacttcagctttcttttgtttactgtttgcatggaatattttcttcttttactttctatttgtgttcttgagtctaaggtgaatctctgtagatagcaattggatctgccaatctttgctttttatttggggagtttaaaccattgacatttaatgtaattattgatgaggaagattacttctgatattttgccatttgtttcctttattttgtgtctcttgttcttaaattcttccattactaccttctttcttttgtattacatattttctagtgtaacgattttaatttctttgtcatttcttttgttgtatgtttttagttattttcttagtggttgccacggagattttattgtcattttaacagcctaggttgggcacagtggctcatgcctgtaatcccagcactttgggagactgaggcaggaggatagcttgagtccaggagttcaagaccagcctgggcaacttactgagatactgtctctacaaaaaaatacaaaaattagccaggcatggtggtgtgtgcctgtagtcccagatgcttgagaggctgagttgggaggatagcttgagcccaggaggttgaggctgcagtgaactttgatcacaccactgcactccagcctgggtaccagggcaaaactagcccaaagaaatgaaggaaaaaaaaaatctaatttagattaatatcaactcaacttcaacagtgtataaaaactttgcctctgtatacctcttctgcttccactctgtgctgttattgtcatagattttcatctttctacactgtgtgtttatcaatgtagatttaaaaatattgcttagtagttgtctttagaatccgatacggagaaaaggagatataaacaaaagatgcatttttactgtcttgtatgtttacttatgtaattccctttcctgatgttgtatttctaaaggcaaagtagggttattgtgagtgtccttttgtttcaacctgaaagactccttttagcatgtgttggagatatgctaatgatggactctcacagtttttgttatctgggaatgtgttaatttatccttcatttttgaaggatagtgttggcaggatacagaattcttggttgacatgtaattctttcagcattatgaatatgtcatcgtactgtcttctgacctccatggtttctgataaggaatcaactgttaatcttattgaggatcacttgtttgtaatgacttgcttgtcgtgctgctttcaagattcattctttgcctttagcttttggtagtttgattgtgatgcatttaggtgtgtactttattagtctgttctacttggagtttgttgagctttgtagatgtatttcatcagatgtgtcaagttcttttgccactattttttttttaaataatctttttgcccctttccgctccttctgtcactctgattatttgtgtgttgctttgtttggtggtgtcccagaagtctctgagactctgtccagttttttcctccccattcttttttctttcacttcctcagactggatgatctcaatttgacctatcttcgagttcatggattttctcttctccaagtgacatctgtgagatgaatttttttctagagaatttttcatttcagttattctacttcaaaatttctctttggttcagttttatcattgctatctttatattattctcagtttaatgagatactgttttatactttcctttagttctttagacatagtttatgtcactgaatatatttaaaatagctgattttaagtcttttttttttatttttttggagatggagtctcgctctgtcacccaggctggagtgcagtggcacgatctcagctcactgcaagctccacctcctgggttcacgcaatgattttaagtctttgtctatgaagtctagtatctgggcttcctcaggcatagtttctgttttctttctttcttttcctgtgtacttcgtttctttgtataccttgtaattgttgttgttaactggacattttgaatattatagtgtaacaactctggcagtcagactgtctcccctccccagtatttgttgttggtgagtattgtagatgtttgtttagtgacttttcatggctaattctgtaaattttatattctttgaagattgtgggcaccctgaagtctctgtttgttagtttagtggtcacctaataattaacagagatttcattaaatgcctagaagcaaaataycttccagtctttgcccatggcctctgtgtatgcattagggcaggccttgaactcttacccagggagtttacaaccctgccttagcctttactaccagcttctgcagagcattaaggtcaacaggtggtgagagtttggagcctactccatctttcctgagcatatacacagccctactcatgcatgtggccctctagatttccaggagtatgttggaccctttcaaagcccttacagactccccagcttttcctctcaatctttagactagtgtgttgttttcttcaacagttatctgtcaggcagcagcaaattaagagattagcataaatgttttcaactcctccacccgtcatgtgccccagggaagcactaagccagttctaagttaggcaaaataaagacaatccttttgaggtggtcttccatggagtcaccagacaggtaaaccaaataattaattacaagtctttggctggatacagtggctcacacctgtaatcccggcactttgggaggctgaggcaggtggatcacaaggtcaggagattgagaccatcctggctaacacggtgaaaccctgtctctactaaaaaatacgaaaaaataggtggctgtggtggcgggcgcctgtagtcccagctactcgggaggctgaggcaggagaatggaatgaacccaggaggtggagcttgccgtgagccgagatcacactactgcactccagcctgggtgacagagcaagactccgtctcaacaaaaaaaaaaaaaaacaagtcttcatgaaagaggtccattctgctgtctttcataccaggaatgtggaatgtggactgttattttcatggctactgctaagctaggaatcaagggatagatggggactgggtaaaacaccacagagtttgctgttcttaccaagaataagctggggaagagggttgtttttgtttttcagtaaaaattccctgggctgcttcaagccgttgattaattttcaggttccgaaaaagttcagtttgacagtttttgccctttttatttgcttttatggatatgtagaacttgagttcttttttccaccagttttgctgacattgttttaaaagcactttttgtaaaacccaaatgttgtctctctcaaggctagccaataattaaaaatactgttactcccctttgattttggaaatgaattcgtattgaccaaaattcaatactagaggtctttcaagctgttttaccatttatctaaactttagaatctaatgattcctgtacattgtctagcatactggtggtcctcaattgtcataagttcaactttggaacaaatgaactttttgtgtgcaagtttccaattgtttggaaattacattgatgccccctccatcaaactgttattcgtgggacatctaggaatttcttacagcagctgacaaatatttcaagtcagtgcctggtagtactgtccaccaggcaacagcttcagtagtagagcgatctttatctataaggcagtgtttgagcaattgtttattagtgttttcctaactactcagaagaactatcaggggttatagaggtagctcagagagttgggtgcaagtagagaaatccacccggcttgcattacacatcttatttctagagaagctttcctttgaagaargagttctaaggtttaaaaaattaccttgaatgccacttatattgcattttaattttattttagagaaatcaatggaaagtagaaaaattaaggcactgatactagtgttaagaatgttggttaaagcttctggcaattaattttttatttccttttttaattttattaaaatttaacaattttcagtttatgctgtaatccagaccaaggtttcaatctaatgaagttaatgccagtgttgctgctacctattttgtctttagtcattcagccatgcttcctacttatactgaataagctagcttaatctaacaatcaaaaaagaaagctgttgcctaagttaagaaaaacagtttgaactgttttcaaactaaatacccagtagactctctagttgttgacaggagaatgcttaattcagaattgtcctgcagtagatcattttatctcattcctgttcttctataggatagcttatttgtttgaaattgtatttaatatgttgtgatttttgtgtgcttgtttctatttttcactggatagactcaagataaaacctggtaccctgcagtgtagctatcagtttatagcagaggaaatttacattagaacttggctgtgtatttacatgtatctaacttggaggtcactctgcttactgttgatatatcagtcatattagatgagtccctaatgagataccagaaaccccggaaacatcattaggtggaacagtgtccttaatgctttattaagtgttataggtaagacaaagcctagtactatttgtggcatcaaggttaggtgtttaaagacctgtattcttctattgtcatgttgaaattgttcccttgatgtagcaatagaaaattttagattaggcttaagttaatcagcaaacaaagataaaagtctgatactatcctaaatattttgtgtttctaaataatttaacagtgatccaattagctactcctgtagaaatgtaattgataaacttttcactctcttttaaattgccatcttgaattttacctgttttttaaagctgtctcaagtcctctctaaaaaaaggcagtcatttataaatttagaaaagcttgatagcacagaaagtcacagaaaaatgtaaacatagtttaaaactgaattgtatacaagccactagaagtacttttattaagtttacaaatattagtagagtggaactcatgcatttaatatgtttgaaacttttgatcaaatactgtgctatgaaaaacattttagataattattctttaatcatgtgtgtgtaaaatgtggctttttttgacaaccaagtagcttttctgtgtgccaaactgtgactttaaaattttaaagtactcaacagagtaaacaaaccacaaataccacttaaactgtacacatttgcacatgcatttcctataaatagtacatgggtttcaagtcttcacttttgaaattcagaaatgggttttttctccttccagtagaaataaaaacttgatttattttatttatttatttattttatttttgagacggagtctcgttctgtggcccaggctatggtgcaggagggtgatctcagctcactgcaacctctgcctcctgggttcaagtgattctcctgcctcagcctgccgagtagctgggattacaggtgcctgccaccatgcccagctaatttttgtatttttagtagagatggggtttctccatgttgggcaggctggtctcgaactcctggcctcaggtgatctgtctgtctcagccttccaaagtgctggggattacaggtgtgagccaccgcatccagctaaaaacttgatttttaaaaatccaaatcgaagacagaattgtgtattttagtacatttattagcagccttgacgctataccatatggctgtttatcatttaaacagcttgtaaaagcaaacacttcaggattcatgagtggcagaaggactgagtactttgggaaataagagagaacttttgttgaggatggttgaggaagagtccaagacaataataggcagaataagcaaaaatctagagactcattgtaggcactcaagtatgtatttgttagaatgaatggctgaacttggtatattgaggaacactgagaaagccatactgactggaagatagttcctacaagaaactggtgagacatatgttacagtctagattttggtgagccttgttaaagtttgggctttatttttatacggggagaaagtttcacaggggtttggaaatgaggcttggagctgttaatggggacacagtgaggttttagggtagtggctttcaaactgtttaaatccaaactttgatgataaccctgacataactattgtttataacttccatttcagttgtattggttttatcaaaacatcttcattgatcttactgattgcttcctatgcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtgattctcctggctcagcctcccaagtagctgggattacaggcatgtgccaccatgcccggctaattttgaattttagtagagacggggtttctccatgttggtcaggctggtctcgaactcctgacctcaggtgatccgcctgcctcagcctcccaaagtgctgggattacaggcgtgagccaccgcgcccggccaagatttaattttttaaaagaaaatattttgctaagggtttggaaactcttgttttagcaagaatggattaagactgattaaaactaaaggcaaagaggaggctcttatgtttggaattctttgctaatatttacacaatataattctctccacaaatatttaatggtaccagatattagatggttataatggcaaaagtgttcaaaggatgctatcatattcatgattcatgatcaaaatgaacattataaggctatccctcttcagaattaaatacgttactcctgtggaaaacttgcttttaatgtagaagttgtcccagagcctttcttcctttctcatgtcctcttatgtccactgctgagctaacatgggtctcactgaatgattaagaaaaaacatcttaggtggggagttctgtatatagtaaatgtttaatttattggggtggtgaacgggaagtgctgctggcaagagaggatgggaagagaaatctacccaaatccttacccgctttacagaacataaacttcctattcagtagtacacaataacttaacgatcaaggcatcttaacttttctgttttcagatgaaagaactatcgtttggcttgatcaagtatttagtatttattcgttcactcaagtgcttacgtttttttgttatctcagggttttacgttagttattaaccaaaagaactagttttagttctggaagtctaaaatatataagagaaggtgaggagtaataagagaagatgaagggagactttcggaatggcctatgaacttctagtaactataccaccttaaaatagacaaattacaatgcagttatgaagatatgtatttttcagtgaagacaactaaaatgtttgcacagaattttcttttttattgagtgttagaaattctattttggagatactaccttgcacaacataaaaagaaaaagtgagtgtggaatctaggaatctacgtggctctaggaaattttttaagtgtggaaactgaaggagagcaagagaaagggagcatggcattcccctgtttgtagttcatgaggtgggtttaaattgccttttgccaatgcagctgcacactgaggattacagaattctttttaaatgtttgtagaattatttttcacttattaggtaaaacgtgtattttttgattttctccaatttcagctttctcatgttgctatgctcmattttgtataccatatatagttttgttaaattgacaaagtggtgttttttgttcttctttttcccattggttaaaatttaaagagaaagtggaagctagaaatttatctaaaaaatgtaactttccctgtaattattaaagtatcaatctaaatttgaattttctttgtgcataatcttttttcaagctatttaccatgttgacaaacttgctttcctgtggcaaatacactagcaatacgttataaatatgtaactttcaacctatttacagttgatgcttttttagccctttggatttaaaatacaagcactgaagaggtgaggaagtaccactgctgcctcagcattatttcgaaattctgtttataaactatacaatttccaaggtcatgaatccagcacctttccaggtactaactattgggacaaagatagaatttgattttatttatttacctattgactgaagtctaacttaaatcttgcacctagtaagatcttagaaataacgtgtgtactctgacctgtaaactaatcctagtattctgtgtgtatattctttctcatttgggctcttaaaaggaaaagtaacgtacatctgatgatcattagcactgagctttttcagcaaaaagtatatgtttataaagaagtataggataatttagtaatttaataatgtgacaacatttgcgtgtgttttttttttttgagaaatacaaattgtgagaaacagaaaagtaaaagaagcagcagcagaaatatcactataggatcaaaagattgcaggaaccaaaactccaaaattattgggcataatgtactaaaaacagggcagtggaggaaagggacagtccagactagctctgagggtccaaagaaagtattaaatattgttactggagtgatttgctctgctatttgggcttgggaattaagtgaaattgttgatatactagacagatacttcccacccatttttctcttgataatcagggttcattttttctattttctatttctctggatgctccatttcttaatattaatattaatattaagctctcagtctttatgctaaaaattggttatttaaaacaatttaaatcaacttcagtctaattggcttaagttcaaatccattttaagatcgatattgtgtcctttaaaaattttatttaaaagatatttaaactgatgagaggatactacccattccactgataaactattactgtaagtttgtctattgagggctagttatttggtttaaaaatgctgagattatggaaagtggattggaatattttggagcaatattaaaaacagtatctgtaacaatttaataaacttataaattcctctttctctgttgatctatcttgaaaagacactctatgtctctaggcattccttctctgtggtgtgattggtagacagggagtaaacaacttactgtaaatgggcaccatgccagttggcttcaggcagcatcaagcttgtgactcacagtcagggttaggaaaatgccttttaacttgtttgtctctgcctcttttaaacattaaaggcacaactgtactaattattaagtatttcataaggtcttttagggcttataagatcttttaggaatggcctggaagttattagtactgtttcattgaatctgaatacctttaacatgataatgagaagtttttaaagggtggttttatagttaaacggaatttctcaaattggcttgctccttatgttgatttatttaggatcacatttgggagtttctctgccctactttcaatgtatttaatttactgaccatcactatttggggggaaaatgttatatgatatttagaaaccaagagttttggagtttttcccccattagatgtatttatttatttatttattattttttaaagacagggtcttgctctgtcacccaggctggagcacagtggcatgatcctagctcactgtattcttgaactcctgggctcagactgtcctcccacctcagcccaagtggctaagtatcaagtaagaatcacctggcaaattccaaggctgtataccagatttcctaaattagaattttggggttgggtatctgaattttagtaaagccctccaaatgtttctggtattgcttctaagaacaattgataacataatagctgtggccattataggggtattctgtcatatttagatataggcataccttgttttattgtacttcccaaatattgcgtgtttattttgttttgtttcacttacaaattgaaggtttgtggcaaccctatattaagcgagtctgtcagtgccatttttccaacagcttgtgctcattttgtgtctctgtgtcacattttggtaattctctcaatatatcaaactttttcatcatttttgtatctgttacgaccagtgatcagtgatctttgattttttctttttttttttttttttgagacggacttttgctctgtcacccaggctggagtgcagtggttcaatcttggctcacagcaacctctgcctcccaggttcaagcaatcctcctgcctcagcctccccagtagccgggcctacaggcgtgtgccaccacgcctggctaatttttgtatttttagtagagatggggattccccatgttggccaggctggtctcgaactcctgacctcaggtgatccgctcaccttggcctcccaaagtgctgggattaccgtgccagcctgatgttactattttaattgttttcaggcaccataaacctcacctgtataaggcaccgtacttaattgataaatattgcgcatgatctgactgctcttccaactggccattccctgtctgtctccctcttcctgggactctcaaatccctgagagacaataatattaaaattaagctaattaataaccctacagtggcctctaagtgttgaagtgaaagagttgcatgtctctcactttaaataaaaagctagaagtggctaaacttagtgaggaaggcacatcaaaagccaagacaggccaaaagcaaggactcttgtactaaacagctaaattgtgaatgcaaaggaaaagctcttgaaggaaataactagtgctactccagcaaacatgtgaatgatcagaaagtgaaacagccttcttgctgatacgaagaaagttttagtggtctggacagaagatcaaaccattcacaacattcctttaagccaaagcttaactctcttcaattctatgaaggctgtgagaggtgagaaagctgcagaagaaaaattggaagctagcagaggtcggttgatgaggtttagggaaagaagccagcgctgtaacataaaagtgtaaggtgaagcagcaagtgctgatacagaaactgcagcaagttatgtagaagatctagctaagattactaaataatagattttccatgtagatgaaaaagccttttgttggaagaagatgccatctaggactttcatagctagaaaggagtcaatgtctggcttcagaggacaggctgacattcttgttaggggctaatgtagttggtgactttaagttgaagccaggtctcatttaccactccaaaaatccgaagacccttaagacttatgcttaatctactctgcttgtactctagaaatgaaacaacaaagcctggatgacagcacatctgtttatagtatgcttcactgaatattttaaggccactgtaaagacctgttcaactgctcagaaaaaaatgattactttcaaaatattgctgttcattgacagtgcacctgggctcacccaagagctctaatggaattgtacaacaagatggatgttgttctcatgcctgccaacacatcatccatttgtagcccatgaatcagggagtgatttcaagtttcaaatcagtacattttgtaaggctatagctgctatagacagtgattgctctggtggacctgggcaaagtaaatcaaaaaccttctgaaaaggattggccattctagatgctattaagaatttgtgattcgcaggaggaggtcaaaggatcaacattagtagcagtttgaaagaagttgattccaacagttatagatgaatttgaggggttcaacacttcagtttaggaagtcactgcagatgtggtagaaacagcaagagaactagaattagaagtggagcccgaaaatgtgacggaattgctgcaatctcatgagaaaacgtgaatggatgaggagttgcttcttatggacaaatgagcaaataaatttttttcttgagatggaatctactcctggtgaagattctgtgaaccttgttgaaataacaacaaaggatttagagtattacataaacttaattggtaaagcagcagcatggtttgagtggattcattccagttttgaaagagtttctactgtgggtaaaatgctatcaaacagcatctcgtgctacaaagaaatcttttatgaaaagaaaagtgaaacttcattgttgtctactttaagaaattgccacagccaccccaccttcagcaaccacctctctgatcagtcagcaggcatcaacactgaagcaagaccctccacaaggaaaaagattacaactcactgaaagttcaaatgattgttagcatttttaagcaatattttaagattaaggtaaatacatttttaaagacacaatgctattgcacacttaatagactacagtatagtataaatataacttttatatgtagtgggaaaccaaaaaattcgtctgacttgctttgttgcaatattcactttattgtggtctagaaccgaacctgaaatatctcagaggtatgcctgtattaatattattttgcaagtaaaaaacccagcatataaaaaaaacgtagaatatgttgagagttcagtaatatggatgaaaatgtttttctctaactgaagaacatgataaattataattagggaaggatataaaccaagaaaatatgtctgagatagccaattcttgcagttcataatatgaaaactcattataccaatctcagtaagaatacttttaatagctgttatttctttgggatatagaatttataaagtacacagtaatcttcttatgatcaatcctaggatcactttacaaccacttaccccatattacaatgtagtaccaagacaagcagaccaaattatagaaggacaaagtttttgctaagcatattttgtcatcagcataccgcattgtgtgtgcatgcatgtgtgtgtttgtgcatgtgtgtgattgtataaaatattagaaagccaccccagaaaagttaaatgactaggaatgttgtgaagggattaagctacccctaaaattatataacaaaactctcttcatctattattaggtcatctttagaacatcttctcttaaatttgttataggtctctctcatctgtttggattaaaattggtctgaaagcctaaaatggctttttacctatataattatttcccaactagcttgtagtataggtgcaaagctatcacacttgctaggttagtgaagtatgtaaaaactaccatctttcaattaggaaccatcggatagcttctacaggattgctggggagaacctttataaagaaagttatatctttataaattttttgtcattttacttagctgagaatataaaataagttagctaataatagagtagaaatgttttctgtaacagattaatattgatcaaatgtgttattaaatgctaaaacaccattttttttctctgtaagccatgtgtttcatgccacaacacaaaagggacaattgtctgtgttttatgacagttctgttctgtcagatgctgtttgttcattttggtgaataaatgaagagagccctggacacatctttttttcctcaacaaaagaggaaaattattcttgtctgtatgtctataatcctgactctttgaatggctttaatttttttaaagtcagcatttttttataaagataggtgtttggaatgtgggcgatatggctggacagttagattgggaccaaataatggaaggctttgaacatcatgctaagaggtttgggttttactctgaaggcagtagagaaccattatgtttttaagccaggattgacttgttctaagctgtaccttagaaatattactctggcagttgtacataggatgagctgtatgttgctttgttttgtttggggagacagttctcgaagagagactacatacgaaggcagttatatgagtcattactaaaggtctggcaagaagtagtaaaagcattaactggagtggtagcagtagggaaggaaataaaaggatagatgtgggagtcatttggaaagtatgaggcaattcattgaccttacagaatcactggttttctgcttccactccattcacattgacctttccaaggttatcagtgacctgcttgtccttaaattcagtgggcactttccagtaacctactgttggcaccagccctgtgctagacamcaggatcctgtttgtaaaggcatctgccagtggtttctgtgacacaattctgtttctagttttcctccttctacttctctagcctcttggcaagttcttctttcagagtttctcagagctttgtgctaggccctcttctcattttctccttctctaagtgatcccatccttttctgttgcttcagttaccatttgtccttatgcaaaggacagccatatctactgtatctccagctcagatgtatctctttgcctcctgacccatatttccaactatctaactgggtatcttttcttggatgagttataggtctctcaaacacaacatgtccagaataattcattgacttattctaaggcctgcttcctctttctcctgtagtccctatctcaggaaatatatggtgctatcaaccccaaagcagaaatctggacataatccctaactacccttttcccctctctgtgcacataatttcagtcattaggcctcatagattggactaaataaatacctcgcaaacccttctacttatattcttaactgctcctaccttaagccaggctaccataattttgtagctggatgactgcatcatcatcttgactggctcccttgtcatcttcaatctatattctatactgcagctagagctttcaaacataaacatgtgatcagattagtcccctctttagaacaccctagggttctcactgtcctgagtacagtctaagggtttaccatggcttacagggtcttttatgatttggtgagctttttattgtataacctttctaaactgcctttacttccctctttcttggctctgtgtctttgcataatgctgttccctatacttcacctcacgtctaaccttcatctccttttcacttctcctcttcctccaaaatccagctgaatatcacattgtcatgcaggcccattcttgatctcccacgtttgggttagatatccctcttcagtaccatcaccgcaccaggtgtgtcccctatcctagcatttgcctcattgtattacaactactgtgtactcgtctctacagctcctgctagtctaaaagttttgggagagcaaaggttcatgtttgtgtttttcactgtggtataccccagtgcctagtatatgataagctctcaaaatatttgttagatgtatgaagaaatgagaaagagaacaggaagagggtaagtttcaagactaggaaacaaggctatgaaagctgcaggaaagcagcaggttaaaacctagaagaagagtttgttttaggaaatactgtgttttaaaccactataactgaagcaaaaacccaaggcctgggtgtggatagagtccactatctgataacagtggatactgatgcatggcagagttggagaggaagagagccagattccaaaacagaaggggtaaagtcttctaagaagatagattatagtaagaaggattaggggatagaaatatgagcctgttccactcatagatctcaaacatgaaatgatgagtcatcatgaagagagtaggcaattgtccagtgaagaaggggatgctaacccttcttaaccttgaatctctcaggtagaagcagttagagaaggaacagccatcatcagatagtgttgtaaggaaaatgatatccttggggaaacctgcattttggtaaagcaaagcaactaagaaagaatatactaccactgtttaacaatcgccacaaaaagacagtaggatcatctttgacccccctcatcctttctcaggaacttggaggactaagaagagagaaatctgtagaagaggcttctctctctgatcctccctccacttcagttttaccacatgtaatgcaacaataattaagaatttgtgtaaaatttcaccaggttggcatgcatggagagaaaaattattcagatgttttcctttgtcaataatacaaggagcatttgtagggaaaaatatttacaaatacagtaagacctattctctttctatayttatgggaaaattttaagttgtgcccttgtttcatgtgtgtttctatttaaagataccatacttaatatataytgttgattcattaacaytgaactcatggctaacagcactataaatcatgtctgatcaaaacttatgatacatgtactttcttcgtaaggtacatcatagtcttctcgtacatgggaactctaggtagtacttcaggactatgcatagaggccattttaaacagcaaaattcccaacaaaaagcacaaaactcaaaaaatgtgccactaaatttaccatgaaaaggacacttgtttacagtttgagagctaaaacaagaaggtggcgtgtcacttcgtttgacttcagctgggaacatgcatatcagtcgactcaaattttttgctattctgtgcttatccacgaatcgataggaaagcaagtgtggatttgggggttacaaataaaatgtagcaaatgtgtaaacttgcagatgtggaatctacaagtagttagaatcaactatgttagtctgatcattaaatcagttttttaaagtactattgtaacaccttataacctgccccattcactgagtgttgtagtttatagtttcattgggcattttcagtagttttatctgaagtcacatttcaaattttgtaattgaagctccaaagtatgctaccggaaacacragctgatgctgtgagacaaaatcaacaggtaatccaccatcacaactgtgggctagaatgctcaagaaaccttggaggcccagagagctgagatgaatactgaagaatcataggcaggtttactctgtcaagctgcctgtattttgagggtgtagtcctcaaaccaaaaagacaccaaatgaacaaactcagatggcctcactggggaacagagattgaaagctgacactggaatgtgtacttaaaaaaatgagagcccgttttggaaaggcagactgggcacagaatgtggagagctatatttgctaactgaagaaatttagactttatcctctacaaaacaaagctattggtttttgaaggttgcataaaagctgcattttagcagcatatattttggtagagctgttacctgcctgaaaacatcaatgtcatttcacacaaatgatacttatcccttggtgtttgatctaaatttctacaatgagaatgtgattttatagtctttactggggaaggaagtaggtttttcaggcygaaattcttgtgtagcaaaaattaacacttaagttagcccttggcaatctccagttctataatggtaaaatggatttcccagaaagtcactctctatccctttgaatagacattagaaataacatgtactttaagtgggatttacagaggaagggggcctttaattctttactagtgtgatgccctgtaaaaaaataactaacattagagttgaggcctagaaatagcagcactgggttaaagtctgttttcaagtgcaagtttttctttttattcgtgtgtgtgtgtgtctgtgtgtgtttcacatagaaggaggaaatgccaatttcagttcttacaaatattaatgactgcaacttataaaaatgttacagactatattcttcccttttgtaacagatgagaagattttgaaatttagtctctactttttagtttggtaagacaatttgaataaactgcaataattgcaaaagaattctgaatatttgaacatttgacattttctatgtcaaatatacatttcttgtactatataaacattctagaaaagagagacaggcagggaggaaagtgctcattaaaaagagcttcaccctctctgaaaagggatttcctttacagtgctgtgtactaaagcctgtgttgtaaatcagaaagcactgagcacacatgttgctgctttggtagcatcagaagtcgattttcattagccttataccattcactatttctgccaagcaatcttaaattataaaagaatcttatttgattttgtgattctcttgttttctgctcataaagaaaatatcctaaattgaacaatggcatgctacgtttttagtttttaagacagctaatgtgtaaaaagacatttaaagtatagttgtgttaagtttttgaagtttacagttgtttcaattttgctgctatactttgttaacatattttaggaatatttcattttagtcacaactaggatataaacattattttggtggcgatctccttgtaatcacgacgtcaaccaaatttgggaaattttgatttgttagatttataaattttacagtaacacaaaagtctaatttcctatatattttcaaggcccctatacctttgtcaaaataaagtatcaatgaaaaatgaaaaaatcataaactatgttcaggccaaactgatactgactttgttaaaaggctagatagaaatctgttttcctcttctgttacatctcctcttctggagaccactctgtgtggactgaaggtttgagatcctaggacctaggctagaacagattaggagattgtgctgtatgttaagtggcagataccatggaattctaagcctgttacgaaggaggagaagaagaggcacaatgaccctgacacagcccctgggttgaccacagcagatatctcacttgagcaagtagatatcatctcaattgcttgctgattatctctaacttgtcagtaacttactttgataacctagatttaggagtctgacagcatgcagtgtatgcctcataataatctgctgtttatgaaagtcataacattgtatgtttagcataatggtgaagagcctgccatctggaatggtctacttatttgggatccacatacagtaagctctcacttaacatcatcagtaggttcttggaaactgtgaccttaagcaaaacaacctctaatgaaaccaattttaccacaggctaattgatataaacaagagttaagttcctgtggcatatttctggtcacaaaaacatcactaaacttctaaataaagacccaaaacacttataatattaaccactgaaataaatgtgagctatatatatacatttaagaataataaaaacaaaaaataattatttacccaatttttggtgaaccagtgagtgatagtgatcatagtgatggtggatgaaatcaaggaataaatatttgcaaagtgaaaattgtaagaagcaccccctgtcaccacatagctcagaaataataattagggcaggcttgctgagcatttttaaactgcactgtttattgtcatgcatttgaatgattatcgcagactttatgaattttcattttatawtaatttgtaggccaggcacagtggctcacgtctgtaatcccggcactttgggaggccaaggcaggcgggtcactggaggtcaggagttcaacaccagcctgaccaacatggggaatccccatctctactaaaaatacaaaaattagccaggtgtggtggtacacacctgtaatcccagctatttgggaggctgaggcaggagaattgcttgaacctgggaggtggaggttgcagtaagccgagattgtgcccctgcactccggcctggtgacagagctagactctgtctcaaaaaacaataataataatttgtattcattcattttccaatgtgttcattccagttcagggtccagggggcctgcagcttatactcatagctcagagcaactgaccctatagacaggacgccaccccattgtagggtgcactcaaatgcacactcacactcaaactgggacccttcagacatgccagttaccgtatcacacacagcttcgggatgtgggaggaaagcgaagtatctggagaaaaactacacagacatgggaagaacgagccaactctacacagacagtggccctggacagagctgggcaggcatcagttttttttcttttttttgtggggggtgagggtggggcatggagtctcactctgtcacccaggctggattgcagtgcagtggtgtgatctcagctcactacaacctccacctcccgggttcaagagtttctcctgcctcagcctcccaagtagctgggattacaggcgcccgccaccacacctggctaatttttgtatttttagtagagacaaggtttcaccatgttggccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagttagcaaccctttctgagcttaaatgtcctcattcataaaatggggctagtaataatgcataaggtttttgtaagaattagaattaataaagtacttagaccataataactmattagtattagttgttgtctttgctattattttgatgtggtggttgtttggtttcacctgtgtactatcaggacatgctgaaataaaatttaagaattggctttataatattagaaaagcaaacttttgtacgatatgggtatgaaaaattgttgggagtctactttttctctcttacctaatttgtcttagtctttttaaagcttagattttccaaatgagccatagcaaaatataatgtttaaaaatgtttaaattctaagcactatgtcatagttaaataacttaaaggtgctacatcttatacagtccaaaaggaacataattagtaaaattctacaatttagaaaaaaaaatagctgacagtgactgatttataaaagtaaaatatcttttgttaatactaatattctttttataaattaattgatgacaaaaaattgagtgaatgagatttgcagttcatttatctatgatgctggtttatttaatctctataatttgctgtatttgaaagagcatagtgatagaggtcatgataaaatctaggcccagtgccacaactaaatccctgtaggaactctcaaggttttgatttcatctctgaatgggaataacaccttccaagaatattatgaagattaaaaagttacgtatcataaatacacacagagtaacaatactgggaatattgcaacttgtaagaaagaggaagcatatggcatattctgatggttagggatatggactctgtagctgggatgcctgaaagagaactctgactccactaatggctagttatatgaaattgtgcagataatttaacttctctgagtttgcatttttctttgtctatataatggggataataatagtacctacctcacacatagtgttaatttctattagtggttctcattaagatagtattgttgttcatccctggttgttagccatcatgtatctgagttagagagtcattgattttagaaagtcccgaggagactatcaggtcaagcaacctgcctcctgctagacaattagctttatccatgagttaccaaagagggagccgaaacccagggaagctgaaagagctgttgattgtcaccctgtgagttggtgatagaaagatatctggaatcccagtagttgcccatttcctagttctgggctctgcattgcactagaatactgtgccattctaaatatgaaaaggcagtatgaccattgtgcttgtcactttccattccctagatgctatcttatatttgtccttatgaaatttaacctgtgactttcagatcacttagaaccttggttggacagtgttttctagtgttatttagtatatttttttgtcatcttctgttgtctttgggttcccctaaaagagctatactctgggtgccaggaaacttcacacatgactgtcttctcttcctcgacttccctctctacttacctttccagctcgtagcaaatcagaagacttctctgacacctctctatgtctaaaggtcctttgatattctcacatggcggcatgaatcacagtgtattttaactggccttttccttgtrtgtctcctacaatgagctgttgaagcttcatgaaaacacaatctgttttactcagggcagttataattccaattacaaagcacatttcctggctcctggctaggaactcgatcatttttcgatgcttccttgctcaggactttctgattccttcttaaaacattttggggcatctccttctcctggtttttggaaacatattctcatactgctatgaaggtttttactgacatttccaacttctcttaaattgattcagcaaatgtttttccataataaatgtcattgatatgtcatcaatatggagagcaacaacagaatgcattgagtaaactcctcccctggaggtctgagaatctagattccagttctcacagagccaccaccttggtgaccttggacagtagaccttctaagcctcagtttccttatcccttaagtggggatattaatagaacccattctcagagatgttgccaagattaaaataaccaagataattcctgtagatgatttggcatagtgcctgccacgtactaagcaagagttagcctccgtcattatagtatgatcataaaaaatgaacagactaaacgaagtaaccagaaggaaagaaattttaattcttaaaatgtaatagtttcttggtttttttttttctgtgaaacacctgcatggcacctttttgttattcatmctgttttgactgtggctgtcgtagattcttgttgaaagtctgagagactgagacttgtcattttgaacatggcatcagtggaacagcttatgattcaataattgcatcatcctggacaagcaccagtagaagtgagtcaggacatgtgataaaaagacattcattttgcccctcctccctctctgtattttctttgctataaaattattgatgttaagcccatagtactaatatttcagttcaattcataataaaatttgagggcatttgaatatattatctgttgtaaattataattttatatttgaccacagagtatttgaagtgggtcttttctttccccaaaattctattttaataactaaaaaatattcttaggagaagtattatttaagaacaggtttatattaaataacatcatttcactttcaactttctggtggtcaaaaaatatgctaatactaattaggatatgatacacatgttctgttagaacagttttggcagttagaagacttctcttcttgtgtttgaaagggatgttacttggggtagttatgagccatgtatccagatgtcctgaaaggaccagtggtagatgtatttctatttttgtcttttcttttttctttctggcattctagttgctgagtgactgacttttgttttcagctcttctcacaatcaccattgttctaataactttgcttaaatagaatgtctccttttgctataagccatggggccatttaccgttaattttttaaagtactgaaatgagaacctcataaattaaagaacactcctgattctgagttagcagatcctactaagccttttgcagatggaaatttcctttaaattggtttgttttcctttaacattccattatcctattgttcattctttggagctgtgatttgtttaatatatttcaggcttcttaataaatcaagtcatgtaagttattatttggatcatttcgaaactacaacagcttatcaaacctctgaaagaagaattttgtgtttgcccacagactgaagaactgattcagttttattggctgagctaccttcattattcatatttaattcctggtactgagggtgggaggagggagaggagcagaaaagatacaactattgggtactgggcctaatatctgggtgatgaaataatatgtacaacaagcccccgtgacatgtgtttacctatttaacgaaccctcacatgtatccccaagcctaaaagtttaaaaatatatatttggtaaatcaattgatgtgttttaaaaaatatcgccttttggccgggtgtggtggcccatgtctgtaaccccagcactttgggaggccaagccgggcggatcacgaggtcaggagttcaagaccagcctggccaacatggtgaaaccctgtctctactaaaaatacaaaaaatagctgggcgtggtggcgcgcacctgtaatcccagctactcgggaggctgaggcaggggaatctcttcaacccaggaggcggaggttgcagtgagccaagattgtgccattggactccagcctgggcgacagagcgagactctgtctcaaaaaaaaaaaaaaaaaaaaaaaatcatctttaaagagataactaacccttccccagaaggcagggccaaagtctaaggttcttccaggtcctttgtattccctataaattttagagtcagcctgtcaatttctatacacacacaaaaaaagcctgctgggattatgattggtattgcattgaaattaaatcaatttgggtataagagacttcaatttggggattgagtctatattgagtcttccaatccaggaacactgtatatctctccatttagtcagatatttagtttatttcaacaatattttcagatctttagttcctttcagcaatattttctcatttttcctgtaaagctcttgcacatcttttgtcccatatctattgtgtatatgtgttttgctagttattaaattatattaatataaattttattttccaattgtttgtcgcatatatagaatgttttaaaaatattgtgtcctgtgaccatgctaaattaactaattctagtcattatgtcttcattatctttctcttgaattttcattgtcttccccttctgggactccattcatatgtaaggccatttgatactgtctctcaggtccatgaagttctgttaatttttcttcattcttctttttctctgtgttcttcaactgaatgaatgccattaataatttggtatgtaatggctcacttaaacttccttttgtttttaagatatttctactctcagctgtgtctggaatcctttagtccggagccccaccaaccctcagcctagaaggaaggaggagaaggatagggtgaaaggaaggggagagcttctagcttcaggacagagatcagaacaaacaacagagcagtcatcttggataaggaaacttccctcaaacctattacttatatcctcagaaataagaaaaataatgcatttatcaaattaaaggattttgaaaaagggaacattcagagaataaaactaaactcttgaaagttaaaaggatgataacataaatgaaaagctcagttgaaggattgaaagataaaagtaagaaaatatcccagaaataagagcaaaaagacagcaatgtaaaataggggagaagataagagaattagagaaccagcttaggagttctagaaagagaaaatgtagacaacaaaaggtaagaaatcatcaaagactggagtaggggaggtcatgctatctgtttctttttctattttttattttgagttacatttttttttactgtgaaacaagcatatgtacatgagaatgaacaaaacaaatatgcagtcatgtattgcttaacaacagagataggttctgagaaatgcatcattaggcgatgtcatcattgtgcagacatcatagagtgaacttacacaaatctgaatggtatgtcctacagtacacctggaccatatggtatagctgttgcttccaggccacaaacttacagcatgttactgtactgaacactgcaggcacctctaatacatcggtaagtatttatgtatctaaacatagaaaaggtmcaataaaaatmcaatataaaagaggaaaaaaatagtacacctgtataggtgcttactgtgaatagggcttccaggattggaagttgctgtgagtcattgagtagtgagtgaatgtgaaggcctaggacatttattatatgaagtctactgtagtgtaaactctgtagacttaggctacactaaatttatagaaaaattttcttcaataataaattaaccttagcstactgtaacttttttactttgtaaacttttaatttttttaacattttgactcctttttagtaacacttagcttaaaacacacacattgtacagctgtaaagaaaattttatgtccttcttctgtaagcttttttccatttttaagatgtttttatttttaaaactgttactaaaaactaatacacaaacacacacattaacctaggcctatacaaagtcagtgtcatcagtgttcaaccttcacatgttatcccactggaaggccttcaggggcaataacaaacacagagctgtcgttttctgtgataacagtgcctttttctgatatacctactgaaagacctggctgagagtgtttgacagttaacaaaaaaaaaaaaggacaagaagtacactctaaaataatgaaaaaagtataatacagtaaatacataaaccaccaacatagtcatttattatcattatcgagtattatgtactgtacacagttgtatttgctgtacttttctataactggtagcacggtaggtttgtttataccagcatcaccacaaacataagcatggtgttgtattacaatgcacagctgcagctaagtgataggactttttcagctccattataattttatgggaccatcactataaatgctgtccatcattgactgaaatttatgtcgtgcatgaccatacatacaatttaatgaaaaataataataataaagctagcagtgtgtaattaccaaccagggcaagaaatagaatattgccaataccttggaggcctccagtatgaccatataagtttacaaatcctattttgttcctcctccccagaggtaaccactgccctgacaaatgtgatcgttgttttcttgtttttcttactacctatataaacatccttaaacaatataactcagtttgtatattttgaattccatgttaatagaatatcatatgtatatgaattttatgtgaatagaatattatatatgtcattttgcatcttgcttttttcattcaacattgtaggattcattcatgttgtagtgtacagctgtcgtttattcattgctgtatagaattatatcctcagagataagatatatggatgtttataaatcattccactattatgaacatttgactagtttgtagtttttatttaaccaaaaaaatgctgctgccaacattcttacacattttactgtatatgcacattaatttatttacaagtataaatttctttttgaatacatatctattgatggagttgctacatcataggacattcttgtctttgactttactggataataccaaactgtcttccaaaatgattacatccttaaactcaggacacatcttattgtcaaatgtttaatttttgtcagtctgatgggtatgtaagttattttattgtcgttttaatttgcatttccctgattactaattaagctgagtaacttttcatatgtttattggccatttggagttcctgtattgtaaagtataagtttttttgtccatttttctagttttctgtccttttagttgaaatccaaatttgcctaaatctgttattctctgagcacaagtaacttgggatgctttcctttagatttagcctaattctttatcattttgtcagcttgatggtgcttttaaggagatatatatgtgtgtgtgcgcacacatgtgcgtgtgtgtatatatatatatgtatatgtatgtatgtattttttgagacagggtctcactctgtcacccaggctggagtgcagcggcacagtcttggctcactgcagcctccacctcctgggttcaagcttttccctgtctcagcaacccgagtagctaggattacaggtatgccaccatacccgctaatttttgtatttaatagaaacagggtttcgccatgttgacargctggacttgaactcctcacttgaactcctcacgtcaagtgatctgcctgctttagcctcccaaagtgctgggattacaggcatgagctaccgcgcctggcctggatattttttaaaaatattttttatctagcactttggtttttggcaggcaggttggcactcatagtctgacctaccatttctataaaaagaaacctgtaaatgttcttaaacagactttgaaccagtcttcctgattttgaacccctacctttacccccagtttttgagcctttcagaattttttttcataataattaggttgcttcttagctttccccactggtgacttaacagatcttaggaagccaacaatccttgtccatctgctttctgtcttgtgaactgttgctggtattgtctcttctctttattcttagaggtgtatgcttttaaaaacatatactgggtttgagagggagctgaaataaaagcatgtgttaaatataccatctttaaccagaactacatttgactggtcattttattttcaagctcacatacacttcaaacagagrtatggctaaaggaattatcatgtgaacaacagccagggctctgaacatcacagattatatcatcatacttgaaatatttgaaattttgattcaaaatgagagctttatagctatgtcctcaatggactaagtgtttaagtacttaacatccaaaacattcttactaatcaagagaagacaaacaccccaacagagaaataggcaaattttatcaatagccagttcaccagatttgttttctgttagaagcgaatatggggaaatacatgtgtccatgttttgcctacttttcctggagcaggtaaggagaggcagtttaaggatccatgtgataaaccctaaagttgtccatcggctttccagtcccttctaggaatttaacttagggaaataatcagacatttgcaaaggtgtgtacagtggtatttataatagtgaaaaaccaaagaatgaccaataacgggagaatggaagttacagccaaatactttacaactactaaagaatcatgtaaaatatctattgacataggagttttatcaaaatgtgaagtatacagatgaatagtaccacacataaaaagcaaggtgcaaattagccatttatattgttatccccaaaataaatagatgcagtttttttaaaagatgcaggctatatatggaagtgtttgctggttttctgtcaaaagaatggcgactttattttctaatttaaactttttgctgttttctaaattgtctaaatagttatagtttttataatgtaaaagtatcttccaatttagcttcatttgacaaattaccttttcattctatctagctatgtaattctaaatgaatttacagcagtaatcttagagcagatgaatttacaacaataatcttagagtagactacggattagatgtaaaaacatgagttgggctttatggttacagagagttttcctcagtgtggggatcatagctgtattgagtttattcagttttcctttcccacatgaatgaaaaatggggccagcctacaactggaagggcctcggcatgtaccactgtactgtgtatgatgtgatttcttgatgctagtagggagagaatcaaattgcctcctattcaaaccaagacccacaaatagcgtcaaccagtcatttcagctactccctgcagtgtcaagaaggtgtgaacccctcatgttctctattgcatacccttgtctaattcagtgtttcttcttcttttcaggttttggctttatgctacatttcagaaatcataataaccttttctggtattattttattctttttcgcactgtgagaaaaattaaactttcaagtggatgcttcttataaactatttatacccttttgctcccttttgggaggcagggacagggacagagttcctcctcaggctaactaagaaaacttactgcttccaatgtaatttaaaagatctccctctttctattgctctctgtactcttaattcttttttttttttttcacagcagagacaagtgaacatttatttttatgcctttcttcctatgtgtatttcaagtctttatcaaaacaaggccccaggactctccagattcaattatgtccttgggcttggtcgactgctgtaggagtctcagggagccttctacaaatgctagagtgactcatttaccaacattaaaccctaggatacatgcaacaaagcaggactccttcctccatggaatgtgccgatttcagatgacacagcacccaatgtagaaaacgctggaatttttccttggaactagactgtgatgagaggtgcttgacatgaacataagctactgtcttttctttttttttgagacagagtttcgcttgttgcccaggctggagtgcaatggcgtgatctcagctcactgcaacttccacctcccaggttcaagcgattctcctgcctcagcctcctgagtagctgggattacaggcacgtgccaccatgcccggctaatttttgtatttttagtagagatggcatttctccatgttggtcaggctggtctcgaactcccaacctcaggtgatctgcctgcctcagcctcccaaagtgttgggattacaggcatgagccaccacgaccggccagctactgtcttttctttgacccttcctttccagtttttgaagataaagcaggaaataatcttctctgaagatacttgataaaaattcccaaaacaacaaaacgcatgcttccacttcactgataaaaaatttaccgcagtttgtcacctaagagtatgacaacagcaataaaaagtaatttcaaaaagttaagatttcttcagcaaaatagatgattcacatcttcaagtcctttttgaaatcagttattaatattattctttccccatttccatctgaatgactgcagcaatagttttttgtttgtttgtttgtttgtttgtttgttttttgagatggagtctcgctctgtcgcccagctggagtgcactggcgcaatcttggctcactgcagtctctgcctcctgggttcaagcgattttcctgccttagcctctcgagtagctgggactacaggcacgtgccaccacacccagctcatttttgtatttttagtagagacagggtttcaccatgttggccaggatggtctcaatctcctgacctcatggtctgcccgccttggcctcccaaagtgctgggattacaggcgtgagccaccgcgcccggccagcaatacagtttttagttactcgacatctttaagcctataactcttaggctatgcatagccccatgtcctaatcaggcattcactgatcccagcaggtctccatctatttgtaccagcctcctctttcctcccaatctcaaggttactcttaaatactagtaaatgcaaaaagaacttgtaaagtggcaaggcatggcctatcaaaagtcagcccaagggcagttttcagccctgcctcacctgggtctagttcagctgacggatgagctgattgatgcgttcaccccgatagccaggtgtgcccatctccttgaggaagcccactctatttttggtagcatgatgggccactgagaggtggaaagggcgcaagaaccatgagatctcctggaaatgcttccctgggaaggcaatttcatgaatgaggtcttccaagcaaatgaagccaaacttccccaggtgctcctcaatcactgtgttgtctgtcagagggatggtcttattcttgaccttggcttgtccacgtttcaaaatgagttctcggacagacttcagatttggaaatccccaggtcacataaggttccactatatgcagcatttttagattctagggggtaacttttacaaagataccactaaaaattttctttaggcgaagtcttgcagtggttctctgcacccgtaaactcacgccatcaatcctttcgatgcgtacaacaaaggccaaggaatgtttatctggcaattccaaggcatgaggtttcacttctagtcgtctgagacgcaccttgtcacgtttctgccgccaggaatcatgtaggaatgattccagtcgcttaaacctgagcccttttcctttcttctgtcttgctactgccatctttctagtggtgcagctactcaattctttttttaattataatttttattttaagttccagggtacatgtgcaggatktgcaggttacataggtaaacatgtggycatggtggtttgctgtacctatcaactcatcaggtattaagcccggcatgcgttagctatttttcctaatgctgtcccgcccccccacccaacgggccccagttacactcttaatccttatagctcagatgttatgatccacagtgtggttcttacagaaagttatggattaaaaaaaaaaaaaaacactcaaagtgcccgaactttcttaaaataatcctggtacagctaaactcatgcactgactgtccacctaatatttaacagtctgtgttgtgatatattgttttaatgttctgaatgcttgtcagctttcagtattgaagatgtgaatcatttatcagcaatgacacatttagtctaaggttgtcagctatttatgctacaaattaatgacttgtccttaaaatatcaattttgtgattcatgttttggcaggtggttagatgttttgtgttctaattttaaactatggataaaggttttgtcataatcattgttttattggttccttttctcccctgcccactccccaaaaaaccctgcaattcttttttgttaaacttttattttaggttcagaggtacatgtgcaggtttgttatataggcaaattttgtgccacaggggtttgctgtacagattatttcatcacccaggaaataaacacagtacttgatggataggtttttagtcttcattctcttcccaccctcaagtaggccccagtgtctgtccttcccttctttgtgtccctgtgtactcaatgtttagttcctagttataactgagaagaacatgtggtatttggttttctattcctgtgttagtttgcttaggataatggctgccagctccatccatgttgccgcaaaggacatgatttcattctttttatcgctgtgtagaattccatggtgtatatgtaccacattttctttatgcagtcttctgttgatgggcttttaggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttccaccaggagtgtataagcatttccctttctctgcaacctcaccaggatctattattttctgactttttaataatagctgttctgactggtgtgagatggtatcccagcaccatttattgaatagggagtcctttccccattacttgtttttgttgactttgttgaagattggatggttttaagtgtgtggtcttatttctgggctctattctgttgcattggtctatgtgtctgttttgtaccaataccatgctgttttggttactttagccttgtagtagtttgaagtcgggtaatacggtgcctccagctttgttcttttggcttaggattgctttggctatttgtgcccttttttgattctatatgaattttaaaatagtttttttctaattctgtgatgaatgtcattggtattttgagagcaatagcactgaacccgctaattgctttgggcagtatggcgattttaacaatatcgattctttctatcccctgcaattctttgttgttgtatttaactatttttacttgtgaagttttttcagggatgattttgttgaaagtgacaactctaaaaattatgttggtaattaaaattttaagtaatgacttttattttcagagattccacttctcttagactttggagctgttaacagcagtgtccaatctgcagtggtactcagcagtttctgtttcctgcatgcagaactgcttatatgaaaacacagttttaaaaatgctttcttatggctgacattcacattcttattccttttgattcttttcaagagggatttggtttgttaaaattaatttttgcaatacttttatgaagatacaaactctgacaaagcttttaaaacaagtttgagagaatacagtattgatttcacttgtaaatctgacrattattttagaaaaaaggaaaatattatttactattattttgcttataaatgtttatcaattttaaagcttccacattgcacatctcccactacaacagtagctaccatttattctttctcaaaaaaagtgctaagtgtgcccttgaaatttttacattgtgcagaatatccctaaaattttaaaacaaaaattacatcatcacttgctttaaatgtttcttctttatttaacatacagtttctaaaatgttagcaaatagcattttagaagagacacgttacttttctaatgaatgttctaaaatgaaccacagtaacctatacttacttagactgtgaaaaacaaaacttatattctattgttaaattttcaaaagtgaaactacacgatagtttacttggcacatcactctgttattgtgaattgacaaatgtatatgtagacaaatatgtgaaaatcagagtacatatacattatatgcagcaccacaatacattttttagtatgttttgactgatatttaattatataatttaccaagaggatctcaccagaatgtagaaaagtattgaattttagaacaattcacatatttaaaaaaaatgtagtcagcccttttatctgtatctggagaatgcagggtaaaggaataatacatgagtattggtatttaaaaaaaggtgttaatttcttacctatgatacctgttactttgggtatcatttaacctttatttctgtgaaatagaggagttctaacatcctctaattattataatattgttctaatttaatctatcttaatctgtgatacagtttgaaaaccaagcttttactattggcatgtgcaaaaaaataaagcagcagtagacttggaatcttgaatgcaaatttagattttgcctcttaataaatgtataatatagtgttctgggaccaattctctaacatttctgagtcctagtttctgcatctgtcaaatgggattagagatacctactttcaggatgtgatatggtttggctctgtgtccccacccaaatcttatcttgaattgtaatccccatatattgagggagggacctggtgtgaggtgtttggatcatggaagtgatttcctccatgctgttctygtgatagtgtgggagatcgcaaaacatctgatggtttaaatatggcagtttcccctgtgctttctctctctcctgccaccatgtaagactttccttgcttcctctttgccttctgccrtgattgtatgtttcttgaggcctccccagctatgcagaactatgagtaaattaaacctcccttataaattacccagtctcagatattctttatagtagtgtaaaaactgactaatacagagaattggtactggcagggttgggtactgctataaagataatctgaaaatgcggaagtgactttggaactgggtaacaggcagtggttagaacagtttggagggctcagaagaaaactggaagatataggaaagtttggaacgtcstagagacttgttttgaatacttttgaccaaaatgctgatagtgacgtggacaatgaagtccaggctgaaatggtcccagagatgaggarcttattgggaactggagcaaaggttatttttgctatgctttagcaaaaagactggcagcattttacccctgccctagagaactgatgaactttgagatgatttagggtatttggcagaagaaaatttctaagcagcaaagcatcctagtggtgacttggctgattctgaaagcgttcagtcatgtgcattcacgaagatatggtctgaaattggaacttaggtttagaagtgaagcagaacataaaggtttggaaaatttgcagcctgaccatgtagtagaaaagaaaaccccattttctggggaggaattcaagccagctgcagaaatctgaataagtaacaaggagtaataagtaataataagtaaaaagtaataagtaataagtaacaaggagccaaatgttaataaccaagacaatggagaaaatgtctccagggcatggcagagatcttcggggcagcccctcccatcacaggcctgagaactaggagggaaaaatggtttcctgctcagggccttgctgctctgtacagcctcacgacatggtgccctgcatccctgatgctccagctccagctgtggctgtaaggggccaagttacagctcgcaccattgcttcagagggtgcaagccccaagctttggcagctttcacgtggtgttgggcctgcaggtgcgcagaagacaagagttgaggtttgggaacctgtgcctatatttaagaggatgtatagaaacgcctggatgtccaggcagaagtctgccatggaggcagagccttcatggagaacctctgctagggcaatgcggaagggaaatatggggttggatccctcatacagagtccccactggggcactacctagtggagctgtgagaagagggcctctgtcctccaggccccagaaaggtagattcaccgacagtttgcagtatacgtctggaaaagccacagaatgccagcctgtgaaagccacaggggtaccctgctgagccacaggggcggagctgcccaagggtatgaaagcccaccccttacttcagtgtgccctgaatgtgagacatggagtcaaaggagattttggagcttttagatttaagggctgcccagctgggtttcagatttcatggggcctgtggcccttggtttgaccagtttctcccatttggaacaggaacatttacccaatgcctgttccctcattgtatcttggaagtaactaacttgcttttgattttataggctcatacgtggaagggacttgccatgtctcagatgagactttggtcttggacttttgagttaatgctgtaataagactttgggggactgttgtgaaggcataattggttttaaaatgtaaaaagacatgggatttgagagggagcaagtgcaaaataatatggtttggctctgtgtccccacccaaatctaatcttgaattgtaacccgcatgttttgggggagggacctggtgggaggcagttggatcatgggggggttttttccatgctgttcttgtgatagggagttctcaggagagttgatggtttaaatgtggcagtttcccttgtgctctttctctctcctgctgccaggtgagacgtgtcttgcttcccctgccccttccaccatgatcataagtttcctgaggcctccccagccatgcagaactgtgagtcaattaaacctcctttccgtataaattacccagtctcagatagtatctttatagcagtgtcagaatggactaatacaggatagtaatgaagattacagaatatgtagatgaagaagtgctaagtaaatagcagctattattatgtagtcaaattgaatgtatacattgtggtacttcagtgtcctttaaattgaataactagaaatttgttggctttctcaatctgctcacatcagatgacatgttaatttatgcctatacttttttctagttaatagatataaatctattcactcaacttctattgacagaactggtagtgtggcaagacatctcatttctagttaaggctgtataatattaagttcattttacttaaattaactatggtttgggaaatgcttttcatgtcatcatgtatgcccaatttgatactttagtgggacagtatatttcagaaaaaaacaaatgcttccccaaaaattccagggttgaatacattagtcagacatataacaatgtacttcagagttcctctaagggcaaaaatcgtggtatgaatatacaaaacactcctatttatacttttgtatttttgaaatgtagtcttcatgttaatttagcatttcaatgaccagcatgacattatcttaataatttggaatgccaatatgttcatttaagacttaatatagtaagtatctaaagaaaaaaatggaagtgactgaatgcttttgtatctcttaattataatttgtgctccattgtgatatgaaggatagaaggggcaggatagatagaaaacagaaattaactttgatgtttaaccttaccttaagactgtctgttaagtgacccacataatcttaaaaaactctgtcaagcttaatggatgctactctgcaggcccctgccaggcaacagtcacaaggttatgaggtgcatagattttggaattaggcagagctgaattcagatccaggtgttgccttataatgcgactttgggcaaataaaaggcccaatttttgtattcttatctgtaaaatggactcagtaaaaattatttgagataatttatttgtgtactgtacctaggcatgcagcttgacacacagaattacaagtcagtagtttccagtatgattattattgtgaaagagatattttgtttcacctactgaaaacttttttcagtcttaaattttttatctaactggctgtattgcagatgtctgctatataacttttatataattttaaaaactatttctttyctccttgatcttctaggggtaaggttaccaatgttttcattatttactaaatatagcagcccccaccccttattcatggaggataggttccaaaacccctagtgtatgcttgaaaccacagaccacagataatcccaaatcctatatgtatattgtttttcctatacatacatacctatggttaatgtttaacctactaattaggaagagtaaaagagtaatagtaactaataataaaataaaacaattgtaacaatattccagcatcactattcttgtgctttagggccaccattaagtaaaataagggttacttgaacacaagcactgtgatactgtggcagtccaactggtaacagagatagtgatgcggtttggctgtgtcctcaccagaatctcaacgtgaattgtatctcccagaattcctatgtgttgtgggagggacccagggggagctaattgaatcacagggtctggtctttcccttgctattctcgtgatagttaataagtctcacatgatctgatgggtttatcaggggtttccccttttgcctcttcctcatttttcttttgccaccaccatgtaagaagtaccttttgcctcccgccatgattctgaggcctccccagccctgtggaactctaagtccaattaaacctctttttgttcccagttttgggtgtgtctttatcacaagcatgaaaatggactaatacagtaaattggtaccagtagagtgggtgttgctgaaaagatacccaaaaatgtggaagcgactttggaactttggaggactcagaagaagacgggaaaatgtgggaaagttaggaacctcctagagacatgttgaatggctttgaccaacatgctgatagtgatatgaacaataagatccaggctgaggtggtctcagatggatattaggaactttttgggaactggagcaaaggttactatgttatgttttagcaaaaagactggcagcattttgcctctgccctagagatttgtggaactttgaacttgagagagatgatttagggtatctggtggaagaaatttctaagcagcaaagcactcaaaaggtgacttcggtgctgttaaaagcattctgttttaaaagggaaacagcataaaacttcagaaaatttgcagcctgacaatgcagttgaaaagagaaacccattttttgagaagaaattaaagctggctgcagatatttgcataagtagcaaggagcctaatgttaatccccaagaccatggggaaaatgtctccatggccatgtcagagaccttcacagcagcccttcccatcacaggcccagagacccaggaggaaaaagtggtttcgtgggccaggcccacggtcctcatgctatgtgtaggctagggactttgtgccctgtgtcccagctgctccagctgtggctgaaaggagccaatatagagctcaggctgtgacttcagagggtggaggccccaagccttggcagcttccacatggtgctgagcctgtgggtacacagaagtcaagaattgaggtttgggaacctctgcctagattttagaagacgtatggaaacacctagatgcccaggcagaagtattactgcagggcagggctgtcatggagaacctttgctagggcagtgcagaagggaaatgtgggattggagccctcacacagaatccctactggggcactgcccagtggagctgtgggaagagagccgtcatcctccagaccccagaatggtagatccaccaacaacttgcaccatgtacctggaaaagccacagacactcaatgccagcctgtgaaagcagccgggaggtaggctgcaaagtcacaggggcggagctgcccaagaccatgggaatccatcttttgcatcagcatgacctggatatgagacctggagtcaaaggagatcattttggggctttaaaatttgactaactcactggatttcagacttgcatgggccccgtaacccctttgttttggccaatttctcccatttggaacagctgtatttaacctgtgacacccccctaccccctgccccccatccctccggcccttgtatctggaagtaactagcttgcttttgattttataggctcataggcagaagagacttactagccttgtctcagatgagactttggactgtggacttctgggttaatactgaaataagctaagactttgggggactattgggaaggcatgattggttttgaaatgtgaggacatgagatttggaggggccaggggtggaatgatatggtttggctgtgtccccaccctaatctcaacttgaattgtatgtcccagaattcccatgtgttgtgggagggacccgggggtgggggtgcagtaattgaatcatgggggctggtctttcctgtgctattctcatgatagtgaataagactgacgagatctcatgggtttatcaggggtttccaaaacttttgcctcttcctcatttttctcttgccaccaccatgtaagaagtacctttcacctcctgccatgattctgaggcttccccagccatgtggaactgtaagtccaattaaacctctttttcttcccagttttaggtatatctttatcagcagtgtgaaaacaactaatacagatggctagtaagggactaaccggcagggagcgtctccagtgtggatatgctggacaaagggatgattcacgttccagggcataagatttcattactcagaattgcacagaatttaaaacttattaattatttctggaattttccacttaatgttttcaaactgtggttgactgcaggtacctgaaactgtcaaaagtgaaaccacagataagtggggagtcctgtacctaagattattcctttaaattgtttcagtggatatgtagggacctgagtgtgaagtgagagcagcagcatcaaaacctgagggaaatccagatagcaaaagaaacttgtctagtatactggcatgacagagaaaccaaaaagttctcaagttaatgtgagaatctaagaattaaagaattaagcctttgcctttgagggaaggaaaggggtaatgtggctttaaatcaggttgagattggttctgagggttccttttccttcctttatattgatatgaatatagacacaactgttctgcatttccatttgtttttataaatgtctttttaggatttaggaactgctaattatgcaatatgagatatctgttagtttgaggaacatttgaaaatttggtcaaatgacacagatcgtcacacagttttaagacaaatgtttttacctatttgacctagtctggcaatccctatttgggcaaaaatcttcatttgcaggtcatgattggaggcaggcacagaaaaaaaattgccaccttttttgcattatgtcatcaagacatcaaacttcagcctacaaagtagaaagtgttatttctcaagttgaaggcctggatatacctcagcttctcagttctgacactttatcatagtggaaaatgaagaagattgcttaagaacactgatgttggtgtcagaaagacctgggtttgaaccctgactttactagttacttagatcactttaggcaactcaacttttctaaatcttgtttcttcatctgtaaatgctgaaaatagtacccacctcttaggtctgtggagaggattaaatgagataatctatacaaagaaagagcttgcataatagtgccaagtaatggtgaggttatacctgtattctgattataatctcataaatatttaccatgttagctgtctcagagttcttttgcaaaacagatamagatagaaagtataaataagaaaaataagtgaacatatactgaactttgtacaagatgctggcgatatggagagacccaagacatgggccctacctaaaagagattattgatagaaacaggatacatatacatcaaaaggtaacataggatcatctgtgcaaagtgctatatggcagtgttttaggaagtctagaagctgtcatggatcaggaataccatggtggacacttcaggcagggaaaacagatcttagcaaaagctactcctatcataggtacttgataaatatttgtagaatccaggatccctgtagtgataaagaaactacatggattatgtaggggagtgataagacatatgactggaaaaataaaaagaccaaattatggaccatactgagcttgtactataaacagtggaggagcccttcagatttttaatcatgttgagaaaagagttttagcagtgtgtgggggatagaatggaaagagaagccagtgccagaaggactacttagtatcaaccattgcagtggttaaagcaagaggtgagagaaggcatgcattagaatggcagcggtcagagtggatgggaaggaataggtcctgacatagtgttacagggagtaataaataggatgtggaagatgggttagaattggcaaaatctctgcatgtaagtctgggttactaaatatagtgagagaaattcaaatctstctttaagaatcgaataaaatatttagaaataagttactgttgtatttgaggtgaacacaaatggcatttcaaagatgctcgagataccttgttggaaaaagtcaataactgcactattgtctccaacatgttcttgccttctctgaagacatcatgttcctaattctgaattatgaaccatctattatccttgtatgctcttatgtgtgaggaaccataaggtgggaacaaaatccggtcttcattctagaaataactatgcgatcaaaaagtttttagtctttcttcttaccatactggttcttggtattctgtttaccattcaatgtactattattgcttctgcttaaaactcrcatcccctaatgcaagcctgagcaaacagaactgataacacacagcctgagaagggagtgcttggggtctcaagacttattctgtttttctccatctttgacacttggtttgaagagcaaagaaggatacagctgttaggaagtaagttacccaaacacagtgaccaaactggattaattcttccaatgagaaagaaatacattatttctgtgagacagattagactttaagtagcatagataacatgattatattctctctacaaataaatacacaggacctaagaaaccctttacagatccaagtgttttcctctccacttttccatccccaaacccatcttgcaagatatggccagcttatttggagttaattaaatcaagaccttcgttttacagacagggaaaccaagcccagagacactgagtagtaggccactggtgtcttagaggtctgaaaaatcctttactgaacattctcttgatctattaatgtataggttttgttgctgtaaccctctccccaagaggagtgaatataaatgatgcagagtttggatgaactatcttaataagaacctaaagttgaaaccaatgcaaacctctctcaataaatgcaaagcaaagagaataatcagtctttctttggcttgttaaataagataaaatgtgttctgctaaaaccatttaacagaaatattgtgaaaggtttcccctaaagcatttttctatttgatttgaaaactattccatagcttattatcaaacaaatcagtaatcctttagctaatgcagagataaatgggcagtcagaaaatataatcacctggtgtgtgcagctgagtatttacatttttcctaatgaacaaagataagaaaagtgcaggtgactttaatgtgtaaaaactaccttttagtgctagcgctagagggaaaaagaaattactggctcaagccaatcctgtacttgataactaagccgtatagtccatggcttggcttcagttctgttttgaatctctttttggacttgtcttgaatggactgtttagggctgcttcagtagtgcagttgttgcatttttaagcatagtttaggttttaaaatgtttctggtccctttttttttttcttttccactttatgttgcttaaagctttatggccaggttttctcatcctcagcattattgacatttgaagctggatacttctttgtggtgggggctgtcctgtgccttgtaggctggttagcagcatccctcgcctcttctcacttagatgccaatagcatttccccaaccgtgataaccaaaagtgttttcagacactgccaaatgtctcctagagagcaaaattgctctctgttgagaactactgtgttacggtgtttggacaaaaactgacaagccaatgggaatattctattggtagttgtaaaaaattaatccagttatagcagctgtatttctggaatttttttccatattaacacttgctttctgaggtgataatatctttgttttttttctcccaaatagatttcttgcattacactgaaaaattgctgattaattcacttaaattgaagactaagccaatcatgtcatttgggtaatagtttaccaactctgcccctttctctgtcagggaagcctctaatttagtaagcgatactgtatccttttgtcaggtacattaccattcctattagcaatagggcaattgagattgagaaagattaaaaggtcaccaagctattacattgtagaattaggttatgaattgtagcctatctggtttagaatctttaccttactagtctccataacaacaattcttccagtgtggtccatggggccctgggagtctccccttaaagggcagactattttcacagtaacacgtactttatttgccatttcattatgtcagcatttgcaataatggtacaaaagcaaagatgagtaaaactgttggcatcttagtatacagtagttactgtattcactgtcatgcacttaaaatctttgaagaagcaaaaaaattattaattacattaaatttcaacccttaaatacatgtggtctttctcatgtcagtgtgacaaaatgagaaggtgcataatccacttatatcgcatatagcatttgatagttgtctcaaagaaaagtgtataagattaaactgtgagttaacctactttttttcatggagtaccatgagagataaactctggttttcagccttgggtatttggcgatgttttcccaaaaatgactgaagtaaacttagcactttaaggaaaacaacttaaagtatttgttgccaattgataaaatataggtttcaagcaaaaatcagaatttttgaagacttgtatctgccactgtgagcttgacaaatgtgactcttttatattacataatgaactatgtcaacatttgaaagatctgcataactcagtgaaccagtattttccagatgactaatgcatgataatacaaaatcatgcatgggtaaaagatacattcaaagtgcaagatagactgacatatttcaatgtaacaatcaaaagttcattgataacagttttggattccacattgcaatactaaaacctttaaaaaacgaaattgtccaattttggtgtagtaatcagaaaaggcaatctataattacctgaacttaagtttctggaggaccattaaccttctacaggctcatggggaagactgtagcacttctctttccctaagatcctccagaaaggaagaaggtaatccttgggggtagggtagagacctattgtgtgatgatcaccaagtatgtaacaatgctttatataactctaatatatataatccacacaaaccccctaaaatggcactaataagggaatggactcaaagaagttaagtcagctagccactgtcacagctattagagcactggaactaggatttgaacccagatttgtctgtatgtaaagctgattctcttcgtaatagtactgagacacaagaggcggctacaaaatattctggtactccatcctagaccagagtttcaaggttcgttatcatttgtagcatgatactggatcctcacagtgcttgcctttcattcaggtgccaggaaacgtctgcctgaatgaatgggtgtaatttacctgcacattttacatgcttctctaggtgtgtgawtaactcataatccatccatgactttcacccataatcctccttgtagcaattgctttgcttgcaacaaaactaagtagacatatctagctttatgcatggttttctctctctgaactctaacataaactcagcctcaggaattattcggtttctactacatttgccattctgattgggaaccaccagcattcaggtattcacctggaacaaggcattttgttccaagggttcctcacttaaaagcaagcaccctagcaatagttcataatggaacttcttaacattctcagaatgtttggcacagctgtgagtgaacacacattgagcaatcaataactattacagataatgatgcccttaagaccaggatattttagctttcccattcaaagggggtgaaatatgcactcttactatggtatacttttggttccttctgccatgtatccttaataaaagatgtcaattccatatggttttctcttgagttctaaccattttgttgtaccctagcccttttaacaatatcaaacttgcaactgaataccatttagcattcatccattttttccaatggtgttcattataggctatcttactcctcctatttgtatgacaaaaattggcttttttcaccgatgtctatggtacatctggcagctttccatgtactcagttcttatctgatgtagcccagaacgactgcctgaagggatgccaaaagcctgattgaggttccaaattttcagctactgtactatcaatccatttgttcatttttactttcccttgtcatctgtagcttacagttgagtggcctgaacatgttttgcatacattgtaatatctaagaatttgggaatacggtcctaggatttagacttaatactaccttccatttatataatacttactcataaaatcttcagtgttcctgaaaaagaaaaaggaacatgtattgagtgcctgctagaagcaggaacttgtagtagattttctatgtgttaccttattttcacaacacacacacaggtgatatccttcccagtttactgatgaggaaactcaggggtcaaagtagtagatacctacccaaggtaacagaagctgtgaagtggtacagctgggatctaaaatatgtcagcttcaccgtagataggctccctgatgaaccacctgccacggcccgtatgaccgcatccaggggtgatgatgtcattttcacagggttattgagagctaaaactacgaagtactayaaactattatttaaaatataaatacatactatatatgcatatgtgtgtatatataattaatggggtaaacattacagaatactgtcctaacctttaaacaatgcactcgttttctgtaaactaatatacaaacaactgtttggtccctaaaaatagatgtcaggtgacagagactggctgagcaagaataggagtatcttcagaatagaagccagaggagtttttgcttccccaacacattgtcgcaccattcactgttccaggaccttcctacttctctggaaaactctggcccaaagcagctcctctacattagtcacaagtttccattaatcaggggtggcctgtgccggacctacagcagagtcatttcaggttattctgttacaggctttcgacgtgtagtcagtccactcgcccaaatctagcagggaatgaatgccttgtaatacggaagcatctacaaattcttcttaacagtgttcagagaacaatgtgaaaccctggggccttttcccagaattagggtggtgggaatgctgtcctattgactaagcctgttaggtaagcaggcagttggcaagattcaggaagcttcatttgaagatagaatttagggcgatcgtttggatttactggcttaattacttaaggtaacatttataaaagaaattgtcattccattattattaccttttaacttttattcctaaacggaacattagcaacaaactacattacttgataaatgtaatttctaaccagattgataactagaaaaaaattttaagttactttgctctgtgaattagtttaaacatatttgtaattgagacttactactgttattggctgaaataaataaaagcaagagataataaagaataacagagacaacgaacacccaatttaagtttatttctaagttccatcttttttagagaaaaggcaaattaagaaaagtttagagagaggtactagtatatttatgaacttgtatagatgataagcaaaacggactttaatatgtagaattccagaatcaacaggttgccagcatccatgtttttgaagatttgcttaagaacacaaccaaaaatggaatgggcagtctctaattacaagcagaaggctacaaaatcattttagctgcataatacagttttggttctaaagtcagcacgtaagaggaaaattccttaggaaaatacaacattgaaaaccattgtgtcatgtaatatgaaatgcaataattaatttttcctccagtaatagaaagatcactgtttcattggtttataaaaatatatctttatcattaaatgtggcaaaatgttaagacttggtgaatattggtgaaaagtatatatccattgtacaattctttccaattttttttgagattgaaaatttttaaaacaacaaattatcttttaaacagctaataatcactagacctgcactctttgtggtgagactatgaaaaatgttagagacctagtaagagaagcagattcacatttctgtcttcttcttcaagccaaacagtcatagagtggagtgggcagaatggaactcacttttgaaagcctagtgctttgtccaatcttactgcaagccagacaggaaggttatagaaaatgtttctggatcagtcttctctgagtcatatgaaattgtggtttcagccaagatgacattaggaattagagacatgggacaaaaactttaagattgtaaaaaaattttgactctagtaggaaacatgggtagaattgtaatgacacttgattgaattttaaaagatgcctgtataagatcttaaaattaggaaaaaaattatggcctaagcaattaaaggcataggaggcatctttttgggatgatggaaatatcctctctcctgattgtgatagtagttacatgaatattcatttaacaaaaaccataaattatagacttagaaaacagtaaatgttactgtatgtgacaccttaataaacgtgattataaaaataaatcctaagcatctaaaaaaaaaaaaaaaaagaagaagaagtgaaccagaaccacaccattctattttggagacacttcaaaagaaatgacctcattcttaattttgtttaaagaagaatataacatgatttgaatatatttagctaggatattttagtgcctgctagcacytgaagccagagttcactgtgagcattctgactatgaagtgagaagctaagagaactgtattttgatattcctttgacagttaaatcataacactgttcttccccttctttagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagtgtgtgttttgaagagtttatttttcctctacttggttttcatttctcagggtggattttgaaatttccattatatgcaaagcccatgaaaggctaaatatcagttaagaggggagaggagggtggctcctaggtcctctaatgggcaggaaagtatttaaaacaacaatacaaaaagatctagaataaaatagaaaagtacaagttgatgtctgggagtttggtcagggagcataaggtaacactataagaaagtgctatcatatgaaatgatggtgttaagtttgggcataacataatgttcattgtattagaaacatgggctttaacttccataagctaataggtttcaaagtcaccaactttactggcctggcaaaaatgagtcacagtgagaactgtgacaggaaaaaaaaaagatattcatttcatttcttattcattttttttttctattaagccagggcactgtgctaagtggtataaataccaataagacctgatccttaccctctgggaagtcacactccactgaagtgaaagatgagttaacaatgacaaggtacagagattataatatagatgagggagagagaaactcggcctgaggaggtcaggaaaggtattttagagaaactgatttcactatataaatgttgtattaacacaaatcttactttgttatggattcagactgctgacagggcaacagcattatctccctaaagaatgagaaattcattccatagcaaatttattagaagagagtctaaaatgtcctaatactaccagtgactcctctaggaaaaaaattgtcatataatttagttatttctaaagcagtttgaaagtagcttggcctaaagctctgattatattaattttttaaagaaacaattattcattcactgtatgaggattattattatttgtctcatgttgtgtttgcatatccatgagagttagatgagtcattttcttttgttttactttttaatacattagcaaattataaaattactcatattacaccacaaagattacaaggatggcagctttggccagtgtagtagtcccacctattgattagagtcaaaagtaaagcccagccctgctttgtgcattgctcctaataaagtggatgttacttaacacatacgcagaagacagaagcgtcttcgtgtcctcactttactcctcactttcttaactgcttaagtatttccacgatataaatgcagtgataataataatacggacagtccctgacttaacgatttttcaacttttatgatggtgggaaagtgatacgcattcagtatggctcctcgacttacaatggggttgcctccagataaacccattgtgaattgaaaatatcttacacttagcactccattcttaatacctgctagaattatagattatccctcaaaattggcatagtataatatgggtatcagcaagttgttgcactttattcagagctttacactaggcaggggtgggctttacttttgactctaatcaataggtgggactactacactagccaaagctggcatccttgtggtctctgtggagtaacgtgagtagcattataatttacatcccccataacaaatgatccaagagagtatgtgatcaatgcagcagaactattgtcttttattatctgatttcacatgtaacatgccatcacttctgccatattttattggccacacagaccaatcttggtaaaggacggaaagggactgcacaagaccatgcattcaaggaggcagagatcactgggggccatcttgggaggctggctaccacacccaccataaatagaaaaccagaattatttgccaaaaatagactttaaccacaaaaatgaataccatataaacaaaacaaagtcacaaaatttcagctgacttgaagactcatctttctattagttagaaagggaatttaccaagtagtagaagacacaggaactccaaaataagatatctcattgtcttatcagaagggttgacaggaaaatgggctgggcactgtggctcaaggaaaatgggctgtgcactgtggctcacacctattatcccagcaatttgggaggccaagatgggaggattgcttgaggcctggagtttgagaccagcctgagcaacataacgagaccccgtctctacaggaaaaaaaaaaaaaaaaaaaacgttatccaggcatcgcacctgtagtctcagctactcaggaagctaaagcaggagattcaggctgcaaagagctatgacacaccactgtactccagcctaggcaacgtagcaagaacttgtctaaaaataaataaataaatgagtcaaggaatgaatgaatggattgacaggaaatgactattagttgtacgtggccatgtgttatgaaatagtgaatactagttaaaactcctcattttatagataaggaacagatagatagacttgtccaacttcatgctaataaccacaaagggctatttttaacttatgaaggtacattgcctctgatcctatagctcagagtcttagctgtgcacaagacatacctgggataaagaaatcaagattggcgtaatgtgcacatcctgacatttcagttggatataaacaaaactttggaatttttcatttttagcagtgggtgattttttttctttttttcttccagtaactgtaggacagtgatttagagattccttatagggtataacttttttgtattataaccacttcatcaatagatgtatctgttgatcgtacttttgatttataggggatagaattgggttagtgcttccattttctgtccaagtaaagaagctaggatatttatagagtacaaaaagaaattgaaacagctggtacagatatttggcattggagagcagctctgaacaaaggtgaattatagtctagtggtcaattttgtggcctrttctttacaaagaattgaacctgatacagttaaccatctaccccaaactattatttgtttaaaacacaatctattggctgggcgtggtggctcatgcctgtaatcccagcacatcgggaggccgaggcgggtggatcacgaggtcctgagatcgagacaatcctagccaacatggtgaaaccctgtctctactaaaaatataaaaattagccaggcgtggtggcgtgcacctgtaatcccagctactcgggagtctgagccaggagaattgcttgaacctgggaggcagaggttgcagtgaggtcatgccactacactactacactcccagcctgggcgacagagcgagactccatctcaaaaaaataaaaataaaaaaacataatctatcaaactgtgtaaaacacagtttatcaaaaaagtagttacccttggtgggtactggctggaattgggcagaaagggggcctgttggggtactgttctgtttcttgatctgagagctgattacataaaggttcttggtttgtaaaaatttattaaatggttcactgatttgtgtactttttttatatgtgaatactgcaataaggttttttattgcactgttttcagtttgttgaacagaaaaagggagactctttttgttgtttttgacctctcgacctcataatggcaatgtaggcaagaacattccctcaaggcaatacctgtgggtgtcttggttatattccaccggaaacaaagacagaggctgtccttataaaatatgtttgaagacctgtgaaactttaatagtgccttttattccatataggacagcacaattacctatgtgctggaaggaatgattgcatcatcgataaaattcgaagaaaaaactgcccagcatgccgctatcgaaaatgtcttcaggctggaatgaacctggaaggtaatataaatatctgaaagcaattgtttgtctctgtagcttataaaaatttatcattttacttttgaagatacacgtaagcagatgtaattaatgtagtcagttcagtatatatatgcttgactagcataatgttactgcccaataaaaatgggaaatttttttcatgaatatgtcatattgtttgtttatccaccagttcttcttacacacactgaattcagtacagccagactatatacaaagaaaggaaattatgtaataatgaaacttacacaacatgcagcaactttattattcttactccttttttcagcctcaaaactattccctagggttggaaatgtttctgtatcagacatatttacatgtccatttttctgtttgccttttaaaagcataccttttacttggagatctgtgttttattacagatcttcaagcggggggtggtgggaaaaaaaaaacctcaaggaagaactggatgggttttgttttggttttcaagtaaagaagaaacctgggccgggtgcagtggctcacgcctgtaatccccgaagtttgtgagaatccttctgtctagtttttatgtgaagatattaccttttccaccgtaggcctcaaagcgctccaaatatccacttgcagattctataaaatgagtgtttgaaaaactgctcaatcaaaagaaacgttcaactccatgacctgaatgcacacaacagtgagaagtttctgagaaagtttcttggtctccccgcactttgggagaccaaggcaggcggatcacgaggtcaagagatcaagatcatcctggctaacatggtgaaaccctgtctctgctaaaaacacaaaaattagcggagcgtggtggtgtcacctgtagtcccagctactcaggaggctgaggcaggagaatcacttgaacccgggaggcagaggttgcagtgagccgagatcacaccactgtactccagcttggcgacagagcaagactccgtcttggaaaaaaaaaaaaaaaaagaaacctgaaactagttataagttagagtttcatatccctgtttatataacaagttgtataattaacactgatctcagcattaaaaaattttcctctgaaaaaagtttggaattctgctgtggttgaaattgcaagttctgtgaaggtagtggtgatctcataacacatatgcttagtatttattgtgaaattagcacttttattcaacaaatatgcaccaacaaggcagtcactaggtataaaatgaataaaatagtgcctgtattcaagtagtttatctgctagttaggttgcagagtcagtcacaaaatagcrtggcacaccatagagggcatagggccacaggaacaagaggaaggtcacctaattctgtcttggaagtcaaggaagaagtaacattgaattttamatctataagctgagtaggaattagatagatgaaaaataagggcagagacatgatcagatttgtattttacaaagactaatcttacatggagagaccaattaagtgaatatggcagtcctccagataagagatggcagtactgagagagaatggaaaccatgtggttccttttatgattatgatgattattattattttagagacagagtctaactcttgtcacccaggctggagtgcagtgacatgaacatggctcactgcagccttgaactcctagactcaagccatcttcccacccagtagggctacggatgtacactaccatgcccagctgatttttttttaatttttgttttaattttttgtagagacaaaggggtcttgctatgttcccaggctggtgtctaactcctggccttaagtgatcctcccaacgtggcctcccaaagtgctggtattacaggtgtgagccactgcaactgacctatgtggttcttttgataggagagactaattgttggtgctatctagcacacactgtgtgtagacatcttgttaaatagaaaatagatttatgggtatgactatgaagagtctaattccccaaaccacacacacaactctatctacgtttgaccaggctatttaaacttaactgcagagtgtcagcatgttaaacattgatttacataaaatgatagctgcccactttcttgtaaatgttataaaaactgtagagattaactaaaaaatgcacacagaagtttgctttcagttccacaagggtagtttatttttgttataaaaacagtattccccactttcttagataccagatctctgcccagattttacccagtttcatcttgctgctctctaatctcctatgtatgtaatatactttgaccatttaaatatgtattaagacacttgagtttttagtgccctttggtttattttctccggtcccaattatctctaatcttcattttttcattttacctattttatatttcgaaataggttttgaatgaagctcaaaggacaaacccaaataaaattctgtcgtatctctaatatattgtggttgcttacccagtaacatttttaggtgcttttctgaatacatataaagtttaagatctttggagttttaagtatataatgtttttctgggcaatttctccctatccaaactatgagggccttctttcatcaaaagaaaaaagatatatcaactacaaagtaatgattttgatggactaggctacgaaatctgtccattttttcctccttcttacagtttaatagcaattgcagtgccctttgcccttactgtactagaagacgaccccaggcagtgactgacatctgatttttctattaattataccatcactgccatttccagttgaatcttttgttggacatcagaaatttttcttacatgaataaaatttaagcatacggttgggcgcggtggctcatgcctgtaatcccagcactttgggaggcctaggcaggtggatcacgaggtcaggagatcgagactatcctggctaacacggtgaaaccccgtctctactaaaaatacaaaaaattagccaggcgtggtggcgggcgcctgtagtcccagctactcgggaggctgaggcaggagaatggcatcagcccaggagttggagcttgcagtgagccaagatcgcgccactgcactccagcctgggcgacagagcgagactccgtctcaaaaaaaaaaaaaaaaaaaaaaatttaagcatacaatttaggctgcagtttctcaaaatattgtattaaaaataaccaattatatgcttttatagtcagtataacgtatccagttagtgtagaaattggcatttgttgaaaactactacatgttagtctttgatatacattcttctactttttggaccctgattattaaaaacacctttgaatagggccatgatttactttatatccatttttatactacatagtggaagaaaattctgatttgttatttcctactatgatatgtaccgtgtggcacatatcatataaatgatccaattctacttgtagatgaattgaaagaaaggcttaaaaaagttcttagggtttgtgtgtgtggtttcactgtaaaactatcatttttgtattgaactaacctcagtatacataaaatctttatttggcctggtatgtacgtatgccaggaatctttggcagaccctaacacttacaatacagatgagccatgtgtttcacactttttttttaacaaccttcagaaatattctcttgttcatcagagtgcttcccctaagccaagcagtttcgatgatagccccagaataactttgcccaagtctctccataaatgtaacttaggactccaagtggtgtatttttatactcttgccccataccaagtaaatctcaagatttattttaagggagtggccttcactgcttaaagggcctagcatttaagaacagataagatttttaatggtgatcctaaatgtttttttttaaaaaacttgcttgtttttctcttgaaactaaatgtttttattcacttcattttaagatatattgtaatcaatccaaagtatggctttatttttagtataaacagtcaaatgaagcttagtcttgtggcattgtcagatttataaccaaatattactgaaactaatttttttaagttcaaaaacccaatctagtagtttctctcttattttcaacttttattttagattctrggggtacatgtacaggtttgttactaagatacattgtgtgatgccggtgtttggagtatgattgaacctttcatctaggaagtaagcacagtacctaacaggtgctttttaacctgtgcctcccttcctctatcccccctcttgtatttcccagtgtctgttcccatctttatgtctatgtgtactcaatgtttagctcccatttataaatgagaacatggtatttgtttttctgcattagttcatgtaggatactggccgcctgctacatccatgttgctgcaaaggacgtgatttcattctttttgtggccacatagtattccatggcatataaataccacattttctttatccagtccactgttgatgggcacctgggttggttccatgtctttgctattgcaaaccatgctgcagtgaacatatgggtacatgtgtctttttgatagaatgatttatttttctttgggtatattcccagcaataggattgctaggttgaatggtagttaaactcttaattctttgaagaatctccaaacttctttccacagtggtgtcattgtggttttgacttgcatttctctgatgattaacaatcagcatttttccatatgtttgttggccacacgtatgtctttttttgagaagtgtctgttcatgtcctttgcccatttttaatggggttgtttttgcttgttaatttaagttccatataaactctggatattagggctttgtcagatgcatagtttgcaaatattttctcccattctgtagattgtgatagtttctcttgatttgcagaaactctttagttaggtcccattgtcaatttttgtttttgttgcagtttcttttggggattagtcataaattctttcccaaggccaatgtcgagaaggttatttcctaggttttcttctaggattttcatagtttgaggtcttacatttacatctttaatccaccttactaatttttatatggcagtaggtaggggtccagtttcattcttctgcacatggatagccagttatcccagcaccattaatggaatagggagtcttttccctatggcttatttttatcaactttgtgtagattacatggctgtaggtgtgtgtctttatttctggactctattctgtaccattgtgtgtggtttttttttaccagtaccatgctgtttcggttactatagcctgtagtatagtttgatttggggtaatgtgatgttgccaactttgttctttttgcttaggattgctttggctatttggggcattttttggttccataggaattttagaatgctttttgctaattctgtgaaaaatgacattgtagtttgataggaatagtgttgaatctataaattgctttgggtagtatgaccattttaactatactgattctaccagtccatgagcatggaatgttattccatttgtttgtgtcatctttgatttctttcagcagtgttttgtagttctccttgtaaaaattttaaactaacttagatgcattcctaggtattttactctttttgtgactgttacaaatgggattgcattcttgatttggctctcagcttgaacattactggtgtatagaaatgctactgatttttgtacattgattttaaatcctgaacctttaccaaagttgtttatcagctccaggagccttttgrcagagtcttcagggttttctaggtatagaatcataagtgaaaagagatcgtttgattatttattttcctatttggaagccttttatctctttctcttacctgattgttctgactaggatttccagtactatgttaaattggaatggtgacattgggcatccttgtcttattgcattaaggggaatgcttccagcttttgcccatttggtatgatgttggctgttggtttgtcatacagggctctttattactttgaggtatgttccttcaatacctagtttggtgaaggtttttatcatgaagagatgctggattttatcgcaactttttctgcatctattgagatgatcattattttttttgttatgtggtgaatcacatttattgatttgcatatgttgaacgagccttgcatcccagaaataaagcctacttgattgtggtgaattaactttttgatgtgcagctggattcagtttgctagtgttttgttgaagatttttgtatctgtgttcatcagggatattggcctgtagttttgttgttgttgttgtttctctaccaggttttggtattagaatgatgtttcccttgtagaataagttagggatgaggccctctttctagattgcttttttagaatagttttagtaggattagtaccagctcttctttgtayatctggtagaatttggctgtgaatccatctggtcaagggctttttttaattggtaggttttttattattgattcaatttcagaactcgttattggtctgttcagaatttcagtttcttcctggttcaatctaggcaggttgtgtgtttccatttccacatacatacttactccaaataatggctttatatatacgggggtcagctgaaaacaaaaatgatactttcatagtaaactccacccgcccccccacccacatacacacacacataaaccctagattttttaaagcctttgttccaatttatccatttcctctagattgtctactttgtgtgcatagaggtgcttgtaatagtgtgaagatctttttcacttctgtggaatctcttgtaatgtcatcttttacattttttattgtgcttatttgggtcttcactctttttttctttgttaatcttgctagtggtctatcaatcttgtttatcctttcaagtaaccaacttttataaactaggttttaagctaattaagatttctctactttcattaagaaggaagtagtgttaccacagactcatgaacacttctgtggagctcctgtattgactgctaatcaactatatgctccaatgggtcaggaatttatataaagttgtattaactaagttgctttaaaatagtgattgcttaactaaatgattcagttcagttaactccttcctgaagatattttgaaaaattaattagtattatttcttgctctagtcagtacagcacagttgggttcaattgtactttctgagctgtattgaaaaacatcagttttctcatttagaactatatataagtagtgagaaattaattacaaactgagtcatagaaaatgtttttttttaatcctccagcttgttactctttcttccttgttctaatgtggagtaaagaaatatgcattccaaaccatttaaagttatgactaattgaggctgtcaaagtactgtttcagtgtattgatttggcacatgtgtgttctcttttacattgtcaacaaaagtacattttatgattttggatcaagatttcactgagatacttctggttgtttaaagagtttctttatgtattggtgtctttcctttttaaaattttatcactcctctattaagttgtgatatccaaatttaaaatattctaaaaacatgttctcctgcaagttgaggtaatgatagttgttatgtggtacttactataatatatgccaggaactgttctaagcattttacatatttaattctcacaacaaccctatgaggtagggactaatattgtcctcattttacagaaggggaaatgaagagtcagggagtaacttgcacagatatccagctacaacatggcagaaccaggacttaaatccaaatatgctgatttcaggtttctgccctttagtcctatatcatactgtgcctccaagagagcatggtaaactaattagcatggttctatcatgattctgtttctattttgaactattaataaaaatttttgcaattctcagttaccccatttagtatagaacacaataagaatggaaccattctattctaacattgtacattgagatatcgttcccaccaccatatctgtcctccatagactatatggtgtgtcattttaaggacagaggatctaaaaatgatttttaaaggtgatttacatttactcttccctttgcaaaatggtttgcatccctaataatttagacaagtacatttcttcgtgatataaattacatttcttgcctttccctggaattctgagtactttccctctgagagaacaatgtaattcttatttatttagtcactaaaataacttcaggagtatgaataagtctactaaaaagtctacaggatccatgttgtagtttgagtagatggttccataccaagtcaaggtaaaagwtaatttatatataatatgaaaatggctgctttaggtttatagagtaatcaatataaatcttccttataaaagggaaatttcccacttataatttatgtaatgtaaagtttttcatttcatcttcccaaatgtttttagtcccacgcagtatttatgttagtacctatgtaaaggtgaaaagtgaattttttctactggtagaactaatactatttttagcatgtaatctgctgtcatcttcctatctttataagtggctttgaacaagtgtaaatagtgtaattctcttcattatatatactaccatgatttagattaatcttaaaccacagtttgtaatccgttactccaagcttagatttttttttcagtttatagtaagagtaatttgccttatataaccaatgaaattgttgcatttagagtgaaagtgagataaaaaaataatttatagaagaatttacaaaagttatttactcagattgttttaacataccgttataatactttgtataaggaataactctaatgaagtttctggcctatttgtaggcaaaattaattgggaataggttcctctggatcttttgctttcagaaaaaaaaaagttttttctccttttccatgtcactttatcataattgctaaataaaatatttctcccatcttaatagttttagaaagtaaaaatacttcttgaataaactgtgtagcgcagaccttcccattacagttcatttctatgtatttktttaaatacccacagctcgaaaaacaaagaaaaaaataaaaggaattcagcaggccactacaggagtctcacaagaaacctctgaaaatcctggtaasaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtaagatgcaaaacataaaagagcaactatataaacctttgtgttttcttcagcaaaaacactttggcttttatatcatcgtgagcccatggcttatcttgtttctcttagttctggggactatgaaggggagagtcaggtgaatacaggtgatagggagtttataataaaacatttacattactccctgcttttcaaatcattatgcacaggatggtaatttcacataggatgatgtaatatcagaattcaagttacaagactcactcaaaactccttttacactgaagtttggggaaagaaaatgtttttagttaattccatttgttttccttcattgtgccacttttaaaaatcaggttgtttgtaagattggtaaacatcaagtatgttgattgtcaaaatttgtactaaagtagaatgattttaacccttcactaaatgaaatgctacacattgaatgtaattttaaagataattttaaataaaagttaccctattggaatttggtgtggaatggcagaggtcaatgttagtgtcagctctgactttaaagacagggaattgacaagcctgtgttcacgcaaatagttagggagagagcaagaaagtaacctgacctcctgtcatccttgttttattaagggggaaagaggtgtgaatagcagggcaaatgttttgcttaactcattgattaatacctcaagccaagattcttttctgttttttaaaatcaatacataatagttgtacatatttactgtacatatttatatttagggggtacatgtaataatttaataaaagcatacaacgtgtaaggatcaaatcagagtaactgggatatccatcacctcaaacatttgtttggggaacattccaaatcttctcttttagctattttgaaatataaagtaaattattgttaactatagtcatcctgttgtgctactgaacactaaaacttatttcttctaactgtatttttgcacccgtcaaccattcccgcttcatccccatcaccactatctttcccggtcactggtaaccgccaagccaagaattttggctattttactatttagttcatgtttacttaagcagacagaggtgacaaaactggctttttttttttttttttacattaaaagctattaaaaagcacctagggggctgggtgcgatggctcacgcctgtaatcccagcactttgggaagcccaggtgggtggatcagttgaggtcaggagttcgagaccagcctggccagcatagcaaaaccccatctctactaaaattacaaaaattagccgggcatggtggtatgaatctgtattcctagctacttgggaggctggcactgagaatcacttgaacccgggaggcggaggttgcagtgagccgagatggcaccattgcactccagcctgggtgacagagcaagactttgtctcaattaaaaaaaaaaaaaaaaaaaaaamcacaagagggtttgtgagtcttaaagtgtcagatgacagaagaaaactgtgtctacctagtatttaatttccattttctgttaggggtgcccttgttttgacagggctaattgatctcattgctccttggcaattcccacagagatgatcttctgaagagtgttgcctcatacctttatttctcttaattcaggtttcaggaacttacayctggatgaccaaatgaccctactgcagtactcctggatgtttcttatggcatttgctctggggtggagatcatatagacaatcaagtgcaaacctgctgtgttttgctcctgatctgattattaatgagtaagttgtatgtgtgtcattttccctgtattcatagggtatctttaaccagctgatgttttcctgattgactgctattgtgataattcaggactgaaacaatcctactaggtatctaggatctaggcaaactggaaatagagttatgagtgcttggggcaggacaagtgtaatgtaaagcaaatgtacatgtggcattattactgtcccaggacatgtttgaggatatttaacagcatatctgaggttagtaaagtctgtcgcaagcaacaaggaatcttactgtgatatcatttacataaccctattccagaaagaaaaaggagcatggtaaaactcatgtggattcagtggggacaattgtagatgaggatatctaggctgatggggtgggacatatggacccagacacaagaggtatctctttgcatggcaaggctcacccagtgtctgtggtttaagaatatgggaacaaatttgttttgtttaactgagagaagaccaagcctttaagattttataaatcagctattctcttatcctctaagcttattcctgtgtctgcgaaatacttcaggtgtccatttccccttacctcattgcagttgtttcctcactcgttttctccctccagtgtaacgttcatcatgttggctaatgtttgcttcctcaagcacagtctgactgcatcacatatctccccagtacacagattgtcttcagtatcttcccactgaccctccagtacatattctgcatgatttcagactttccagaatctgacctcacttcctctcccattgttttccttcacacactcttcattcccatccatcctttccagcatactcttagactcttggtgttcacatcaccagatacacagcagagaagtcacatcctagttactctcactttctaccttgtattactacttttcgtacccctagcttattgctattagtacaatgtaaacagggagttcacacacacatacccctggtctaagaagaataaaaaatgaaggagatttctgtttgtatagaaaacagaagtcaccttgacttttattgccaaaaagaggactgttcaaactactgcatcacaatgtaacaagattaggtagttggatccaattttaaattaactggtaaatatatttagtttctggggaaactgaagacattattactcatcataatcctaccatgctgtttaaaaaataccatgttggcagtatttgttttttagtcactttctaatatgtaatttgaaggcatttaagtggaattaaaagcataaacagatttgtatgaaacaccaacttatcctggtttataaaactaacctaatttagggtttttattattagggcattcagatttagctttaagcagtcacagcaaaatctaatcatgccacatacattccttacataaagtgggatttataattttttttcctcaacagatttacattagtttcattttcattaagggatatgtacttcctattcttgtgttctcatgctgctgcctaaaagatgggcagtcctccacctttttcttttctttttttttttttttttttttgagacgagtcttactctgtcacccaggctcaagtgcagtggtgtgatcttggctcatggcaacctctgcctccagggttcaagtgattctctgcctcagcctcccgaatagctgggattacaggcgcactccaccacacttggctaattttttgtatttttagtagagacggggttttgccatattggccaggctggtcttgaactcctgacctcaagtgatccacccactttggcmtcccaaagtgctgggattacaggtgtgagccaccgcacccagccctccacccttttttcttagcccactatgtttccatactgctctggtgtctgtgacaggcagatattgcatatcagaaagtatgcattcaagttctgaccctctatagagctgtcaaacagtctctcatggttgcccttaggtcagaacgttgtgggggaaaaaaaaattgttgttgtttttacagccaacaagaatgagtttttacttattctactacactataactttgttgaaattttcagttatatgagtataaccatgtacaagaaactaaaggaaaaaaaggtgcctcccagaaaaggagtgctttacctactattaaggactagggaggtgcctcttcggtaagagcagattttaaatttgaagagcctctgatcactttggcagcatataagtcatgtctaatttattttatataaaggaataaaccacatattcagtagagaaaaataataacctttctgttgttaagtccaagacgactttctgtcagaaacttaaaaaaaaaaaaaaatcttgaagcattttaaaagctgtgaactgggcccagtttcaggctcttagtgtcatttcacaagtcaggaaactttagagacctatttgaaaatcataggtatgtaatgacttcagaatcataagcaagaattggtttagtacctttagtttaaagaatattaaggcatatgcctgtcagaggcagattttgagcatcagaagtctagaatcaagttctaggtctcgccctctgcataactgtgaacagtgtcacacatttttgtctttaggatggactgctgtgaaaaaatttacctttaaaaatcaagtgtgtaggacctaaaactgtcgtctaattgaccgtattcaaatgataaaccttgatttaaatgagcaactagtaataagttctataagaattctaacactttaattaaataataaaataatacatggcatgcatgatagaaaataatatctccactgttacattagattattcattagtctatttaaacagccaagatgcaggaagtttaaggaaagttctccaaaattctgattttatagggaattagcaataatattattgcagtagttgtttttctttatgagttcatagttttgcaaaacaaaacaaaaatgtgctttttggggggaagtagcagtatttctaactaataccctgctatttatctttcacaggcagagaatgactctaccctgcatgtacgaccaatgtaaacacatgctgtatgtttcctctgagttacacaggcttcaggtatcttatgaagagtatctctgtatgaaaaccttactgcttctctcttcaggttggtagaacaccttttcaccttatgtcaaaagcatgaaatatgaaggcctagaaacaaaggttaatttatatacatagtactaataattataccaagtctactattatttcctactagtcagatgatttttatgaatgtaaaatattagaaaggcacagtaagtgacaccaagattaataagacaaataggtatggcagaaacagagaggtatatgagctgcatagggatctctgttgataagaatctgtgtagacttttttctccttccttcctttgatctttgatcatggraagacatggaaaaagaaagctaactacagtgattttgtcyactacactgttatttggttaaaaattttagtttcctaatgagtattagcatgtatgagaaattatgggagaaaaaggcgcatcctagaaaaggtgtgcttaattactattggggattggttaacatagcatgggagctggattgtcagagattcattatctagaaaatggcaacaagagtttataaaacgaacttctgtgagattactttttagctagcaaagacaaagatgtccttcagtaggtgaagtgataaactatgatacatccagatgatggaatactattgaggactaaaaagaaataagctgtcaagccatgaaaacacatggagggacgttaaatgcatattactaagtgaaaaaagctaatctgaaagggctacatactgtgtgattctaactatataacattccataaaaggcaaaactgtgaagacagcaaaaaaaaatcagcggttgccagggtttagaaggaagggagggataaatgtgcagagcacagaggatttttagggcagtgaaaatacttcgtatgatactacaatggtggaaacatgtcattatacatttatccaaacccaaagaatgtccaccaccaagagtgaaccctcaactatggactttgggtgatgatgtgtgggacaggaggtatatgaaaaatctctgtaccttcctcccaattttgctgtgaacttaaaactgctctaaaaaaagtcttttttaaaaaaagctctatgaactagttgstattataaaccttaggccatttcaagtaaaaattacatatcaatgtttattaaatactgagttaatagctgaatacctctttcatatacaaataagtacatttgcaattttttaaaaagtcttaattccattagtaactgtggtttcatagttgccaaataactgtaagctatggatgttgcacaagactgtgattttatttaatcatttcatatctatttaaacatttccaaagcgcacattcatcttaatgttttcacactatttttgctcaacaaaaagttattttatgttaatggatataagaagtattaataatatttcagtcaaggcaagagaacccgataaagatcattgctagagacgtttaatgttacctgtagcggtacacttgttaaagaagtgattaagcagttacataaaattctgatcatagctttgattgataccatgaaggtataattcagtgcctggatactaacaactttacttgtttaaaaaaaaaaaaaaaagaatggtttcaattgtatacatcccagactaattgagctatatgatttttttcattgtaaataatatcacgagttcttcttgttaaaaaataatagaatcataaggatggaaatatataccttaagatatagacttctactatgatagactactggaataggtatataacctcccaccaaaaatgctagactaaaaaaattaagaactaagtgaaggcaggaacctacagagataagtggaactcaagccaacttgctctttgacggcatttgtagaacctggtaaattagtaagtttagtaagttggggtttttttaagtttataatcttttttaaaatgatttcaataggtttttggggaacaggtagtggtaggttacatgaataagttctttagtggtgatttctgggattttggtgcacccatcacccgagcagtgtacactgtacccaatgtgtagtctttcatccctcatcccctccccaaccctagtccacaaagtccataatatcattctcatgcctttgcatcttcatagtttagctcccacttagaagtgagaacatgcaatatttggtttcccattcctgggttacttcacttacaataatggtttccagttccatccaggttgctgcaaatgccattattttgttcctttttgtggctgagtagtattccatggtatatatataccacattttctttatccactcgttgattgatgggcatttggactggttctgtatatttagtaagtttaaaaacaagggatggaaatataaatgcagttgaaaaggcagtggatggatctaaaagcagaagaatacaattgtttttaatgattgtgtatatgtttgtgtatataaaccacaagggaaatctgtaggtactgaaaatcacaacaggaaaatggcaacaaagctatagaaactggaaaagcaatgacttttcttagatccctcagagaatggaggtcataggacaaaccaccacttcaaaatctagaagaatagacaaatacagagaaacagccaagatcagcttactgggaaaagatgccactgaagccaggaagactatggcaatttgggaaaagatgccactgaagycaggaagactatggcaattttgatgaattgctggaggctgagtgaggactagcttcagagttaaaaactcccagggacccagtcttagtgggggtttcctgcaatttcttgggtttaccccacaaaatttctaacttccagaaactccacaaggttcttatggtgaagatgcaagaaaaattccctcctttttctggtaggagtagagggaaggtaaaatttggaaatacgtagcagagtgttcacaacaaaaggcctgccctgtaaggaaaactaattcaacaggcccttatgtgacctgggggaaaggcaaatagaggattctagcccttccttagccttcttgtctcatttctgaaagtcacagcccagggattcagacccactaaaaaaaactgagatttaatcataaagattaaaaaacaattcccctccccctccccaacaccttaccaccatataaacagggctccaggataaaataacagtggattacaactgagagagctgcaagacacaagctgtttaaggagctcttaggaaacccaaaaacaacagaagaaaaagtaaataaaaacaaggaaactagaggaaactgaagcctccagtacctacaattatggcaaacattaaatacagcccagctcctagccagattagcatgaaacctcacactaaaagtctaattacttcagttttgatatatcaatcatgtccagctttcagcaaaaaaactacaaggcatgctaaaaggcaagaaaaacccacggtctgaagagacaaaacaagcatcagaagcagtcctcagatatgacacaaatatttcaattatcagatagggaatttacaatacctatgattagtaggttaaaggctccaatggaaaaaagtagacaacatgcaagaagtgatgtacgcagagagatggaaactctaaaaataaatgctaaggaatgctgtaaggaaatgcagaatgatgttgatgggctcatcagtagactgagcacagccaagcaaagagtcagtgagcttgaagatagataggtcaaaggaaattcccccaaactcaaatgcaatataaacatagtagacattaatccagctgtatcagtaattactttaaatttgaatgctctaagtacaccaatcagctatttttttaactaggaggtgaaaataaagtttgccaccagatgctcactaaaaaattattagaggatatatcccagccaggcgtggtggctcacaccggtaatcccaacactttgggaggctgaggcaggcagatcacagagtcaagagatcaagaccatcctggcttacgtggtaaaaccccatctctactagaaatacaaaacttagctgggggtggtggtgcgcgcctgtagtcccagctactcaggaggctgaggcaggagaatcacttgaacctgggacgtagaggttgcagagagccaagatagcaccactgcactccagcctagtgacagagggagactccatcttagaaaaaaaataataaaagtaatcccatctttaagaaggactgaagaataacaaaagtggtaaataatatagatacatttaaactgacatttactatgtatataaaataacaacagtaacaatttccttgagggctaaaaagtagaactaaagtaagtttcaaggatgacaactagaaatagggtatgcagggtatgcaaagtaccaaaccattgggggaagagaatacctaagaaaaacaatccaaaagaatgaaagacatgagaggagggagaaaaaaatgcataaacaagggcatgataacaggaagtaacagataaggtacattagtacagctaaattcaaacacatcagtagtttagtttcattaaatatagagatggggccaggtgtagtggctcacacctataatcccagcactttgggaggctgtgggcagatcacttgaggtcaggagttcgagaccagcctgaccaacatggcgaaaccccgactctactamaactataaaaagccgggtgtggtggtgcatgcctgttatcctagctactcgggaggctgaggcacaagaatcatttgaacctgggagatggaggttgcagtgagccaagatcgtgccactcttctccaaactgggtgacagagggacactgtctcaaaaataaaataaatgtagagatggactgaatgctccaagctaatctgacaggattttagaaataatccaaatttatgctatttaaaaaaagctatatctgaataaagatattgaaaggctgaagtaaaaggatctactttgcatagtataacccaagacatggccaactttttctgtaaagggccagatggtaaatgttgttagctttgcacagtctctgtcacagctactaaactctgyccttgtggcaggaacatagtcattgacggtactcaaatagaacaggcatggctgtgttccaataaaactttatttacaaatacaggctgcaagtaggatttggcccataggccaaagtttgctggcccctatattgaccaaaacaaaaccgaaggagctacattattaccaagcaaaatagatgttaaggcaaaatactccttaaagcatttgttcaggaaaaataattgtaaatatatagtttcaaattacataatacaaaaattcatagaacaagaatacttagataaatctagtaaaaataatgagattttactatacctttcttacaaattaagcagacaaaaaaataaggatatggatgtacatttcatctctcttgggtcaatactgaggtgtgagatcactgggacataggttgagtgtgtgtttaaatttatttttaaaattgccaaacttttccgcaattgttaacatttaccagaaatgtatgagacttcttaagatccattctatatcctcctcagtacttggtactgtcagcctctttcatcgtaggtatactgatgattaaaaatattaagcatcttttcatgggcttattggccacctatatttcttatttggtattgtgcctcttttaatcttttgcccattttttaactgggttttaagaattgttcaaatattctcaatgtggccctttgttaaatatatgttttgcatgttttctttaagtggattacatttacagttttcttaaaaaaatgtagagatgagcaaaagtgtataattttgaagaaagcttcgtgtctttgtttactaagaaagttttgcttaatccagggttaaaaagattttctactatttgttttcttatagaaattctgtagtttcagctcacatgcttaagtatatgatgcaaggtaagggacaaggttcattttcttccccaaaatccatatctggttgctccagaacttgactctcttttccctattgagttacttggcaattttgtagaaaatcagttgtttgtatatgtgtgggtctactttcagactctttttcttacccaacgatctgtatttcttacccaatgatctgtatgcctatattcatattgataacaccctgtcttgattactgttgcattacagtaaatcttgaaatttggtaatatgaattctccaaatctgttgttcttttccaaactgttgttttggatattctagtttccttgcatttccacttccttttttttttttttttttgagatggagtctcactattgttgcccaggctggagtgcagtggcatgatcttggctcatcgcagcctcagcctccccagcagtgggattgcaggcacccaccatcatgcttggctaatttttgtatttttagtagagacggggtttcgccatgttggccaggctggtctcaaaccctgacctcaggtgatccacccacctcggcctcccaaagtgctgggattacaggcatgagccactgtgcctggtcttccacgtattttttaattagcttgacaatctctaccaaaaagtcttttggggctgggtgtggtagttcatgcctgtaattccaccactttgagaggccaaggcaggcagatcgcttaagcccaggagtttgagaccagcctgggcaaaatgtcgaaaccctgtcactacacaaaatagaaaaaattagccaggcatggtagcttgtgcctgtagtcccagctacccaggaggctgaggagggaggtcaaggctgcagtgagccatgatcatgccagtgcactctagcctgggcaacagagtgagactctgtctcaaaaacacagtctgatagaatttttattaggatagccttgaatctatagatccatttgaaaataattaacatcttaaatttccaatttctggccgggcgctatggctcacgcctgtaattccagcacgttgggaggccgaggtgggcagatcatcaagtcaggagttcgagaccagcctgaccaacatggtgaaaccctgtctctactaaaaatacaaaaaaattagccaggcgtggtggcacatgcctgtagtcccagctactcaggaggctgaggcaggagaatcgcttgaatctgggaggcagaggttgcagtaagccgagattgtgccactgtactccagcctgggcaacagagtgaggctccgtctccaaaaaaaaaaaaaaaaattccagttgttgagaaagaataggaattccagctttggaggagtggggagaccatcaaatcctctttccaaaaatactactaaaatactactgagcagagtatagttccacaaatagtcttctgtaaagagactcacagtacatatttgtctttgtaggccatatagtccctgttgcaatttctcaattctacagctataacaggaaagcagctatatacagtatgtgaatgcttgtgttctaatacaaatttatttgcaaaatcaggaaaatggcttgaaatggtttaagatctagttttctgactagatcatggtatataatcttttccatatatattttgaatttggtttgctaatattttgctgatcatttttatatctctctttatgaaggatgctgatctacaactttcttttcttgtgatatctttttctggctttgctaccagggtagtactagcctcttaaaatgagttgagaagtattttctgttttcttaaagagtttatagagtattgatcttatttattctttaaatatttgatacatgttaccagtgaagccatctgggtctgtgttttctttcagggaagatttttaattatttgcttatttgttatatagatctattcagaatttatatttttccttgacatagttttgtaatttgtgtgtttctatgaaatgagccattttgtctgagttgtctaacttgggcataaagttgtttgtaatcctttaagttttgtaggatccatagaggtgtcccctccattatagattttcataatttgtgcctgatcatctttttttcatggtcagtctagttaaaaatttatcaattttgttggtctttacaaagaaccaatttttagtttcattgaaatttttagtttcattgattttctctttttgtttcctatgtcattgattattatttcttcttttctgcttgcttttcatttaatttgttcctctttttctagtttaaggtagaagcttccattgttagttgaagaccttattttcttatatagatgtttaaagctatacattttttgtatattttcattcatttcattttctaatgtccttcatgatttttttcattgacccatgtgtattgcttaatttttatatatttggggattttccatatctcttcctattcatttctaatttaattccactgaggtaggaggtacattgaaggactctaatattgaatgactccaataagtcttctgagacttttttaggcacttgcatatggtctatcctgagtgttccatgagtgcttgaaaaaaaacttactgtgctcttgttaagtagagttttatgaacgtcagttaggtcaagttgattgatagactaattcaagttttctgtatctttgctgattttctgtctagttgttctagatcctacaactttgtctacatccttgccagagcttggtatggtttttttattatcgctatcctagagagtatgtagttgacccttgtgacttgccatgcatttaatgactgcccatgttcatagcagcattattcataatagcaaaaaaaacttttatcatatgcttttgtgcctcaagatcatatatttttcgtttttagtcactaatatggtataatggtataatatactgtttaatttctgagtaattgactagcctttcattccggggataaatcctatttggttatgatatagtatcctttttacatatagctgaattcattgtactaaaattttggtatttttgcatctaaatccatgagggatatattctatagctttggtgttatgataatatggtattatttctttcttaaacgtttggtaaaactcagcagtgaagctgtcttggtttgtttggagccttttttgtagaaaggttttcaagtacaagttcatcaaatgtttactgataatatgtttattcttgagtgagctttgttggtttacatctttgaaggaatttaactgtttccttcaaatgttgaatttattggtataaagttaagttattcataatattcccataatatccttctaatggctccagtatctctagtgttattccctttcattcccgacattggtatttaatatattcttgctttttttttttttttttaatcagtctggctaaaagtttttcagttttaccaatgttttcatagaaccagcttggtcttgattttgttgttgtttatgcatgttcttagttattcgtttctactctttatcctttccatttttcttgtgtttagggtagaagcatatataattaattgagacctttcttttctaatcaaagcttttaatgctgtaaattttctaagcactgtcttcattgcatcccacacattttgatatgctgtgttttcagtactagagatttttaattttatgataccttatttaatcatgatgccttatttaatctatagcttattaaatgtcaaattctaaacatttgggtttttctccagatatgtttgttactgacttctattttaatctcatttttgtcagacagcattcattgtatgacttaatcctcctaaatgtattcagacttgttttatgttctagattaatgttctgtgtatacttgaaaagaatgcaagttcttgggtagactgtttcagaaatgtcagtcaaatttaagtcttgtttattcttattgattctgagacaaaggtgtttataatgttagatttgtctgctatatctctgacattgccaaatatccccttggaggcaaaatctccccctcccttttgagaaccactgatctatgtagccttttttctgggactaatttagccttgcttctgagatgtggcccctaggtctctactgaatgcccggcatatttaattagatctttctttcctctatggcctcaagggatttcaccctaagtatgcacaaatttttattcagccgaagactgtacagatttctggaggcctttctttgtgtacctccttcgtttccagtagtctgacccataaattgtacagatttctggaggcctttctttgtgtacctccttcgtttccagtagtctgacccataaattaaagctgctttagcctccccaaacttcaatctctttctcctcaacccagcaagattgctagaccctgggttccctttcccttcactgcagtatgataattactttcaagcacaaaggtttagaattaagatttcttactcctgggctaggtatggcttaccgtatttgtttctcttttcctagggatcataatcatgtattgcttgttgtccagttttccagtaggaggggaattccaggctgtacttacttcctgcagccaaaagaggaagtaatgttagtgatttcaatattaaaacattaaaaaaaaatttaagatggatgaaattcttttatatgcatattgaattgggcttcaccatagttatttttagaattaggactaaccggcagggaaaaaaactatacggcagggaaaaaaactataagccatcgctgttttacaattttgcaataattagattttctgtagtatagtaatgtgtaaaattaacccattgttaatatagaatgccgttatcactcctgattaagcggtcttcattttcatgttaatactgatgtcttgtaatgctttmtggaatcaaacattttcatacatattcattagtctaattctaatcataatccaatgaaaaagagcaggaaagatgctcaaggaggttatattcaagtccacatggcaagtaagaaataagactactcggctgggcatggtgacttactgcctgaaatcccagcactttgggaggccaaggtgagcggaattgcttgaacctgggaggcggaagtggcagtgagctgagatcatgccaatgcactccagcctaggcaacacagcaagactctgtctcgggaaaaaaataataataataagacttctagaagctcctaaatccatagcttttcctctataccagcatcttctaaaaatgtcagcagcagtgaagtttcagtttgggaaataatgcatttcccctctctggagagtgcacagttatatctccaagaagtactgaaattcagaagtctgcctaatatgtattaaacatttagcttttctcaaactttgaccaccaaatcctttgtctcgctctaactatagttaacacagaatcagtgttcccaggagcacactgtgaaaaatgtagcactctacaaaagtcctaatctccacaggattaagtgaaaccatgattaaccctctgttccttgtccttattagtaccattttctgaagagtaatgtatccccccaaaacttttatactagtttcactaaccagaatccatgtacataaggaaggacagatatttgctccctactaagacatatctattagctacattaaaaaaagtattgcatgccgattttaaagttataattaactggtgatatcacagatattccaagatataattgctggaataaacactgttgttgaagccttctatctatctcagtactagaattaaactcaagtgcagaatggcagacaaagttaactaaaaatcactgtattatttcatttggtcctccaaatagctttgtgagctaaggaggagaaggtgtatcatcaccacttccattttatagatgagaaatcaagtgatttactcaaggttaagtcctccaattctttgttatcctgcattttctcttggctgtagtttaattaataatcctaagaaaatgcttatattttagagtgcagtaagagtacataaacaatgttaaatgcccatcttgcatgtataaaaagttatagcaagaaatctggctgggaatggtggctcacacctgtaatcctggcactttgggaggccgaggcaggaggattgcttgagcccaggagtttaagaccagcctgggcaacatagggagatcctgtctctacaaaaaaatttagccagacacagtggcttgtgtcctagctactcaggaggctgaggtgggaggatcacttgagccaaggaggtcaaggctccagtgagctatgattatgccactcagacatggtggcttgtgcctacagtcctagctactcaggaggctgaggtgggaggatcacttgagccaaggaggtcaaggctccagtgagctatgattatgccactgcactccagcctggatgacacagtgagaccctatctatctcaaaaaaaaaaaaaaaagaaaagaaaagaaaaagaaaatcctttaactgacttcatcttaaccttttagttcctaaggayggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtaagtgtcaaacataaagccaaatataagagttttctgggacaaagtatgttttgattagtgaatataattatataccagcagcgcccccacccccgcccccagtttgtggatgttggtgatagcttgagttcaacttatgaacttcagttttgtagacatttttcctaaggccaattatgaaatatcctttcacctagtcatgtgtatataaaatcaccatgttattacagaatttagtaayactgtttttaaaaagtatgattaatccattaaattagaataatgcacccttcatatattatggtactacagtgattcatgaaataattctatataattctacatacaatcaaagaaatataaaatgtgttttgtacrgaagtgcttatttttcatctggggaattccagtgagattggtatattctaggccagataattttttcaaaatagaggacaacaaacatgagatgttcccactgaccaatttggaagcctgatcattaccatatcttctcttgcaggtggttgaaaatctccttaactattgcttccaaacatttttggataagaccatgagtattgaattccccgagatgttagctgaaatcatcaccaatcagataccaaaatattcaaayggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatakttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgayttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggkgtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctrtcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttktgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcrtttaaatttgctgttctggtattaccaaaccacacatttgtaccgaattggcagtaaatgttagccatttacagcaatgccaaatatggagaaacatcataatwaaaaaatctgctttttcattatgtgactccaacatgcttttgtagaacttgtacagttccgattgtccaatctgatttttgtttactgaaagtagagttacccctgcttcaggaaccttaagataatatggtgggcatttaaatgtcagtgtggcaatgttcgcctgctaatatggcatagattcaaaataagcttaaccctggtgccaaagacctgaagattatcccatccatgcctcaaatggttgtgtgccaattactgcaaagggtactaagggaaggagaaattcactcctgaggctgcttcaaatgtatgtctttatcacaaaagatgacattttatgtaagctaatgttatctagtcaaaattcttagcttattttaaaatcaactcttcaagaaaaggaataaacatttaatataaatatcatagcagtattgcacatagaatagaaaggtcgggcagggtagtggaagtcagctattctatacaatccattcggtattttccaaaacatttgatgttcaggccatatccaggaactggatgacctaacaaacttctctgagtacctttttttccacaagagatctccatcactaagaaaaaaagcattgtgatttaaaagccaaatttgccttatccatcatcatgtgcaccaagtatttgctacctgcctactatataatattgaagatacaatgtgaataagaaaaatactattgctaccctcaatcagagtatgtgattggaaaagtgtataacaaacctttcccagtgtcttcaggtataatgcagagataccagatacggcatcaatgtgtatacacattatggctgtaccattcactttaagtagtaaccttacatttctgtagaacaccttcacatacatttttaacaagcctcactgaatgaattaatgacatgaaaataatgaggcagattattctcgtttccattttataaggaagtaaactctgtaagaaagtaaacaggctcagaatttaagcactgattcatagcccctagctcccatgttattgaaatttgaatggaaagcctctaatgaggccattcatctatcagatgtcaaagagcatgtctctggcctatgagcctctcagggaactggttatgtttttctgttttaaattaaactaatgctttactgagcacttactatgtgccacgcacaatgataattcaatatattatttcatttaatcatagtacccctctaaagtactactgtaaagcagtgctattatcctcattgcatttatatcaggaaactgtggcttaaagaattgagtaacttgcctacagtcacaaagctagctccagaatccatagttttaaaaaccactattgagaaattactaatatgagctaactagggcgaatgaacccatattgatcattatgtgtctggccttttgacatgtcctcatttaatctaatcccttttgctaccgtatcaattttgacttagaaatttaacaatgatacattagtccccgcttatctacggaggatatgttccaagactcccaatggatgcctgaaacatagatagtactgaactgcatgttttttcctatattacatacctatgataaagttaatttacaaattagatgcagcaagagattaacaataactcaattacaacaatatactgtaataaaagttatgtgaatgtgagctctcaaaaaatcgtactatactgagggtaactgagaccacggaaagtgaaaccgcagataaggcgggcactattgtatttccttctcttaaaaacgtgtcctgtaccctggggtggttgatggtggaaaatactagttgcccacagattacagaatgccctttggtttgtctaatatacaacagggagcctgtctcactaatgcccacagaaaaatcaaacatttcttcaagtgatatggagcatatagggtacagtcaaaccaaggaagaaagttgtttataaatgagaactatagtgcaagttaaaatttgctcctagttttgcaggtaaagagccagactttgggtgtagaaaaaaagttgaaaatactgaggcttttacataaggtgattttttttttttttttttttttttagaatttcaactaatctcttttaacttaagtcgttcttaacagtattggtaacttcatagcactttctttctggtgaaataaccccatcctccctcttatttaggcttcctgtttcctagttaaaatggggcagtactttgttagggaagtatttttacttcacttggttacaaacatgtaagtctcagaacaaaagagtttgtgcagaccatatcagacactcaaaagactttcttcactctacccacttgagtaagagacaatttatattctgttcaccttatgtaccctcaccaaaaatattcaatagggtaataatgtgtatataatgtaaataaggcacacgtttttctatttttgttaaagttgcattgtcttaaaagtactgagtatatacatggggttttgctagaaataaaaatctaggtcatccaaaacctctacagttgttcactaggattgcaaagaatcaagataaaaatgaaactctttcaatatggcaagaaagggggacagtgtgcataaaagcaagcaaaggctcacaaaacaggagaatatgtcacaaacaccacctgatcaatttcaagacctactatgtggcaagcatgctagatgaagcaattcaaagaccactaaggcaatactaagactccaaggagaggttcctgccctcaaggaattaaagatgaaaggcaaatgactaagcaattctactcctatgtatctactcagaagagatgaaaacgtgtccacacaaatgacttgcatgcaaatattcttagcagcattattcttaatagtcaaaaagtggaaacaattcaaatatccatcaaccaatgtacagataaacaaaatgtggcacacaaaatgtggctgggcacggtggttcatatctgtaattccagcactttggaaggccaaggcaggtggatcacttgaggtcaggagttcgataccagtctggccaacatggtgaaaccctgtctctatgaaaaatacaaaaaaattggccgggcacggtggctcacgcctgtaatcccagcactttgggaggacaaggcgggtggatcacctgaggtcgggagtttgagaccagcctgaacaacatggagaaaccctgtctctactaaaaatacaaaattagccgggtggcgcatgcctgtaatcccagctacttgggaggctgaagcaggagaattgcttgaacccgggaggcagaggttgtggtgagccgagatagcgtcattgcacaccagcctggacaaaaagagcgaaacttcatctcaaaaatatatatatatattagctgagtgtggtagcgctcgcctgtagtcccagctactcgggaggctgaggtggaagaattgcttgaaccagggaggtggcagttgcagtgagccaagatcgtgtcatagcactccagcctgtggcagcagagtgagacttcgtctcaaaaaaaaaaaaaaaaagtgacgaacctcaaaatcatgctaagtaaaagaatccagacacaaaaggaccatatattatttcacttacatgaaacgttcaaaaaaggcaaatctatatagagaaagaaagcacatcagtggtttcctatggctagggataatattagggtttaagtgcaaatgggcacatgagggtacttttgggggtgatggaaatgttctaaaactagactgtagtaatggttgtgcaattctgtacatttaataaatgctacacttaaaatgggtggattttatatggtatataaattaaatctcaataaatacgtattaaaaatagaggcagccaagcaaatgtgtaattgccattcagttgtatcaaaagcaggtacaaatgcactaaatgcactttgaatgcactaaaacaagtgcagctattttttttggaaagcctgtcagaagatgtcttcattgtgctacatgttaaaggatgagctggagttcagcagcacaaagccttactcgtttaatattaatggatgcccctgtaatgtttaattagtcatatgttctacccatccccagagagggcaaccatgtacaaagagatcaccaacatgacaagtaaaaaaactcacagcatatacatgactactcatgtcttgtatgaattctaagtgttaataactgttaagaccttagtggtcttacaacttcggaataaacaaatctgggttcaagccttgcttctttatttactaagtctgtgattttgagaaaattccataatcactttatatctgtttctacatctgaaaaatatatgtagctgcttagctcaactcctaccatatagcaagcattcaatacacgttagctgttttttaagtcctcatgaaaatctaagagaaggggaattttttaatgctgtccccaaaaatgtatagaagtgaggcaaatgatgaagagcagtatgaacacagtaactgcacacaaatttccaaccctgcatttcttaattaatcaaagctatgcataaggctgagggaggctgttctgttatttgccaattctacagaaacttccaaaaaagctgaagcggggggaatacttctcaactaattccatgaggtcttcattattctgataacaaaattagacaaaatataagaaaactgcacactaatatccctcatgaacataaatgtaaaagttctaaccaaaatcttagcaaatagaatataataatatattaaaggaagatacatcatgaccaaaggattatctcaggaatataggtttgacttagcatttacaaatcaaccaatgcaattcacaatagtggaaaagaaaaaatccatgtgattaagatgccagacaaaccatttgacaaaatctaacatacactctgaattaaaaaaaaaaaaaagatcagcaaactagaaatagaaggaacctcctcaacctaataaagggcatcacacacaaaaaaattatcttccagcattatacatacttcatggatactttcctcttaagaacagtagcaaaacatggtctgctctcaccactttcatacactattttactggtgtctccagccaatgccatcaggcaagaaagagagataaaaggcatccagatcaccaaagaagtaaaactctttactaacagatgacgtgatcatctgtttagaaattctgatgtgatctttaaaaattaaaaaacactactagacttcaaaaaggctgggcgtggtagctcatgcctgtaatctctgcattttgggaggccaaggcaggaggactgcttgaggccagaagttcacgaccagcctgggcaacacagtgggaccccatctccacaacaattttttttttttaaaaataactgggtataatggcacatgcctgttttcctagctacttgggaggctgaggtggaaacatcacttgagcctaggaggctgaggctgcagttagccatagtcacaccatcacactccagcctgggtgacggtgagaccctgtctcgagaaagaaaaaagaaagttaaatgcagaattaccatatgatcccacaattccacccctaggtatatacccacaagaatgaaaacaggtactcaagcaaacacatgtagacacgttcatagcagcattattcacaacaaccaaaaggtgaaaacagtccaaatgtctccatcaaggaatggcagataaacaaatcatagtatatataaaaatgaaatattcagccataaaaaggaatgaagtactgatttatgctacaacacgagtgaagctccaaagtattaagcgtagtaaaagcagccagatgcaaaaagtcacatatagtgtgattccatttatatgacatatatagaatatataagcctatagatacagaatgtagattgctggttgtcaggggctgggggaa

SEQ ID NO: 10733 - DNA, 41973 bp, Homo sapiens
gccatcgaaaagagttttgtttgtttgtttgtgtttgtttttgagacagagtctcaactctgtcacccaggttagagtgcagtggctcaatcatggctcactgcaacctcaacctccctaggctcaagccatcctctcacctcagcttcctgagtagctgcgattacaggcgtgtgccaccacacctggctaattttttgtattttttgtagagatggggtttcggcatgttgcgcaggctggtctggaactcctggcctcaagcgatcctcctaccttggactcccaaagtgctaggattacaggtgcaagccactgagcccagccgaaaagatctttgtttcctgtttttttcaacattctactggctttgtccatgaagtccttcatcaaacaaaactccttaatttttatgtagccaagtttgaagaagcgaaagtttgtagagaagttttttccatccccatctcttctgtaaaatatctgttcaagtcttttgcttacttttctgttgggatgtttgtcttttcttactggttttaagaattcttgatatattgccgggcgcggtggctcatgcctgtaatcccagcactttgggaggccgaggcgggcgggatcacgaggtcaggagatcgagaccatcctggctaacacggtgaaaccccgtctctactaaaaatacaaaaaaattagccgggcttggtggcgggcgcctgtagtcccagctactcgggaggccgaggcaggagaatggtgtgaacacgggaggcggagctttcagtgagcggagattgcgcccgccactacactccagcctgggcaacagagcgagactctgtctcaaaaaaaaaaaaaaaaaaaagaattcttgatatattatggatcataatccttccagggagcgttactccctgacatttctggcctaccctatctaccctatgcatgggctgagcagactcatatgcccagggaatgcttcaggtaagaagccatgggtatgtttaggaactacccgttaaagctggaggtgacatctgggatggctaagggggtgtgggtgaggctccgacagtatttgctgtacccacgttgtccaatatgaacagccacccatcatttaagactccttttgggctgggtgcagtggcttacgcctgtaatcccagcactttgggaagccgaggcagggggcggatcacaaggtcaggagatcaagatcatcctggctaacatggtgaagccccgtctctactaaaataaatacaaaaaattagtgaggcgtggtggcacacgcctgtaatcccagctattcgggaggctgaggcaggagaatcgcttgaacccaggaggtggaggtcgcagtgagccaagatcgtgccactgccctccrgcctggatgacagagcaagactccatctcaaaaaaaaaaaaaaaagactaaaataaaaaagactccttttatcctcttgttatctgggaagcttttcctaacctacctactccaccactccttccaaacaatagtttttctgtattgctatgagaccgagtacctaatctcattttatagtgttttatgcctgtctgttggcttatctgtctccttcactagtgtgagatcctcaaggcaggcaccgagtctcatccacctctgattctctggtaccgaacacagggcttggcacacactatttgctataacatgtgctaacacttgttaagcacttaccatgtgccattcgccatgctaaaagctttatgtatattatctcgcttgatttttacaacaatcctaggaagtaatatgttcctctagatgccacaggattgacagaaacaaaactcaaacaactttaagatagaagtgaattttactagttcaattaaaggaaaatctagaaacatgccttcaggcatggctggatccagacactcattgagcagttggggttctttccctccatctctcagctctgtttctctccatcaggcttcattctgcaagcaagctcactctacaaagagggggaagctagctgccagcaacagttgtatcttcctacttagcaaccacaatgggaaaaaccaacattcccactgactcagcagaaaagcgaggtctctgattggcgcatcctgtgtcaactgcttgtacctgctcatggggtggaagcacaatgattggcagcccaccaagaggtcttgcctaaaagaaccaaaataaaacaaaagagatgggaagccttcctgagcagaataaaaccatgatccaccagagatgggtccttgtgttgtcccattgcatcaatgaggaaagaggcacagatcacttgcccggggataccactggtgataagtagcagaaaaaacatttaaactgatgggtctgatgtcaagtcctgcaccccttgtccatccattatactggctcctcctatgaattctgggatggatgagagcccaggattcagatgacagacaaactcaggtttaagatctattattattattattattattattattattattattattagacagtatcttgctctgtcacccaggaatgcagtggcaacatcatagttcactgcagcctcgaactcctgggttcaagccaccctcccacctcagcctcctgagtagctgagactaaaggcatgtgccaccatacctggctaattttttttttaattttcgtagagatggggtcttagtatgttgcacctgctggtctcaaactcctggcctcaagcgatcctccagcttcagcctcccaaagcactgggattacagacatgagccaccgcacccagcctgagatccttttttgaggctgtgatctctatgagctcaagtgtcctcatcagtcaaatatgggcaataatagtatctctatctggtggtgaggattaaatgaaatcattcaaataatatatttagcatagggtctggcacataaaaagagctaaattaatgttagttcctattatcaataactattcattgaatgaataagtgagtgcatggtacctagactctaacatgaagactctggttagactctggttagagatgatacctcacgtatcatctcacggtgtgaaggcctgggagcagggtttagggagggctttggacccttgaaaatctccaccacggtgcaaaacactctccatggattttctattctttgagctgggcaattaacttttcttaatttttctttctttctttctttctttcttttttttttttttttgagacagggtctcataacataatgttacccaagctggggtacagtggtgcaatcacagcttgctgcagcctcgaacacctaggctcaggtgatcctcctgcctcagtttcctgagtagctaggattacaggtgcacaccagcatgcccagcagattttttttttcagatagggtcttgctatgttgtccaggctggcctcaaactcctgatctcaagttatcctcccaccctggcatcccaaagcactgggattacaggtgtgagccactgcaaccagccaacttttcttagttttacataaagtaaaaataaaagcatgtttagaaagtgctgttcatattattgatctgtaacttagctctaagcaagtttccaagcccactttctccttccaaccgaatgaccaccccaagccccttccattaggaattctaggccaggtgcagtggctcacacctgttatcccaggactttgggaggccaaggctgacagatcacatgaggccaggagtttgagaccagcctggccaacacagcaaaaccccatctctagtaaaaatagaaaaaaattacctgggcatggtggcacacacctgtaatcccaggctacttgggaggctgaggcacaagaattgcttgaacccaggaggcggaggttgaagtgagccgagatcacgccactgcactccagcctaggcaacagagtgagactgtctcaaaaaagaaaaaggaattctagagccaccactggcacccacgctccatacagctgggtttggaatgagcgctgtcctcaygtatgaccacgtgcaggtaaagagctttgaaggtgccaagggccatgagtagcttgggaggtcatctaggttctcccagcactgtggagtcaaggagtcctgaaggccggtcccaggcctgggcagggctgggtggggcagactgagacagggcaggggacaggaacgggatgacttattgaggtctctgacaggcctggcagaccagcagggcactacaactcttttcccagtagtaattatacttggcctgaaaaagctttagaattattcccacgttgagtgggcacacagtgtcctgagacatccttggccctctgagatccaggaaactgctctagatgccaaagttatagagacagtaggaaagtgcatgggtggagaggccctcagccccagcaggaggcaataggctgcctctctgagggctggatgcagtgggaggggaggggatctgaagggagaggaggcaaggaggaaaggaagcaaactttacccaactcttcagcggcccagctgggtgtctgcgatgtccacatatggctgagagctccaagtctgggacacagagatgccagcatgcaggacacgagatactgccttgttttctcctcctttcccctgcctttccccctgccccttccccattccccatccaaactctcctgctggccaggggtgtggaaacagttggatgtctttggccactctagctggagttctgccctatgtgatcttggctgagtcacttaatgacaataacccagtttgtgtggagtcacaaatggtgttcacatcataacgtcaccagactctccagccacacccattgtacacgcattatctcattcaatcctcatgacaactctggaagtgaaatcatgttagtgcacccattttgcagatgaggacactgaggcttagggagatggtgtgtgaccttcccaatgtcatatgtctaataaatggcaggaatggaattcaaaccatggtttactaaactccaaagctggagcccttctacagtctcaggatctagaacagggattattactatctctgctgttgacatgaggaaactgtggttcagggaggtcaagtgacctgccaaagcttgtacacatggaaagtagtagaaccaggatgcaaacacatttctttaccaccaacaccaatatctattttgccaacaaaacaatgagggggcctgagtaaataatctcaacggttaactccaccctccaattgagatacttttttttttttttttttttttgagacagggtctggctctctgtcacccaggctggaatgcagtggtgcaatctgagctcactgcagcctctgcctcctgggttcaagccatcctcccacctcagcttcccaagtagctaggactacaggcacatgccaccatgcccagctaatttttgtattttttgtagaaacagggttttgccatattgccaaggctgttctcaaactcctgggctcaagcagtcctcctgcctcagcctcctaaagtgagccaccacacccagcagctgagacactttttaattctgggctagggcaaagagaagttggaaggaaaatgggtgaaaataaagaagttctcagttatactgcagcttgttcatgcctcctgcctcgggatgccgcagtggctgccccagccctgccctttcagcctcagcccttccctcagtgaaggagagaaaaagtgatttaacaaagtgaggactgtcagcccttggagcttggacctttgagatctcacactgccccacccagtagcttccccttccagtagcgtggcaccaccttctgacccacccctcagtgtgtccaccagtgagagtggttcctaagggagagtgtgaagcacacgtaggcastgtcttacaccacacctgctgagtccaaaccatgggaggctcctctcctagaccctgcatcctgaaagctgcgtacctgagagcctgckgtctggctgcagggacacacccargggraggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagmagtcagcctactgcccctacagtcactttcctgtgggggctgccctgctcacccaggaggggagaatcttcaaaggtaaaggtgggcaccccagggtcccccagcccagcarcctgggtggtgggtcagaggaagatgtacaggaagaggcgcagaggcacaggcagtggcaagagcgcggctctgtcccttcttcccccagtctccgctggaatgttcctaccctgccgactgccccagaccgcgctcaaatgtggcttaaatccagggtctttcaatgcttagaggactgggatgaggaaggaagttgratgggaggcaggaaggggaggccataaatcaaaaacatcaacagtcctggggtgcaggcagggagagsgttcgtgctttcccagcctcggatatgtctggcaccttactgaggcttccacaacactaagtccacacctcctgcccactgacctaagtgttaatgctcgtctttagatgaaactacggaggtctcgagaggtgacatgacttgcccaaggtcacacrgggcgctggtggtgaaaccctgggctggaggttccccaaagccctgctctcttccttccacccactgtgctcagtgctggccagggtggtgacgtgtttgtcgggggtggtcggtggagaatcttggaggagaaaagccagctgggctttcggagtccagcagtgagcagcgccctgcggggcgggggcgggtaatggaacctgarcccatctgagtctgctctaatctgttcctaaactcttttctttgatttattgcttttgtagaaaagttcatgtgagcaaaaattcaagcttgtttttgmtaagcttagaggcattctccttcagggcagtaggggacatggtgtggaggtaccccttggtattattccctgtctgttgaggttctgtcgggtgtgacttgcctgggtcttaaacatctttgagtgggagaagcaggtttgattgagtgctaacagcctgtgaaaggaaggtgattaatgctatccatttaacccctgcaaccctgaaaggcagagaaggaaacaggtttggaaagtttcagagctcraaatcacagagctgggattggaacccagacttcccctgactccaaaagctgttgctctgtggggagtgaaggatctctgagtaccgtgttgaaattcagacctgttttggtggctgaggtgaatattaaacattaaccaccaccacaaacaacaaacattcaccaccaccgcaaacaccattgcaactcacaacattgcagaatcttgaatgtggaaatcagcccttgattctttcgaaagcctccacatcctttccagatggcacagaaagggccctcctacaatcccccggcacccacactgacccctcctgccrtgcttatcacatggtgtcatcactgtccacttatgtatctgcctctcccttgggactttgtgctgcagagggcaggagctgtgtcttgaatctttgtrccattgactttctcgtgctgtgacgtagcacctgcctggctcagaacaggcactcaataactgttgagtgactgattggatgaatgaatgagatgagtacgtttggagaagcagaaggaagagggatggtggggcaggtggtggtgatgggggctcagcatgttcggccacagcatttcctggcctgtggggccagcatggctgccttccatccatgctttccagcactggaactggtgttctgcttggaacagcaggaggtcagacagcctcatcgtgcctccagagccaggggacccccatgccagaatgctygggtcctttcttgttttaaaacccacaatagtcgggcatggtggctcacgcctgtaaccccagcactttgggaggccgaggcaggcggatcacgatgtcaggagatcgagaccatcctggctaacacggtgaaactccatctctactaaaaatacaaaaaaaaatagccrggcgtggtgrtgggtgcctgtagtcccagctactcgggaggctgaggcaggagaatggtgtgaacctgggaggyggagcttgcagagagccgagatcgtgccactgcactccagcctgggcgacagagcgagactctgtctcaaaaacaaacaaacaaaaaaaaacaaacccacaataaaggaggcacactttcactcataagtgacacctgggagctccttccagtgaagtccacacctctgtcaccctcatactgatcattcaacagatatttgctgaacatcaactctgttccaggtaaggtgccaggtgctggggatatcacagtgaacagggatgacacaatccctgcccccatggcagtcccctcatattgcataggtgatgactgaaggckcgagcctcatccagtggaaggaaggaatggaggagataaacaggactgtggcccatttgcattgcagggaaagacctggtgtcaccagagaaagggttgtgtgatggggatttagagagtgaaatggaggcttcagagtcagaggttcctgggttggaaggctggtgtttatcaactgtgtgactctgggtgagacccttcacctttctgagtgtcagctcatacattttatttatttatgggtttttttttgttttttttttttgagatggagtctcactctgtcacccaggctggagtgcagtggcgcgatctcggctcactgcaatctccgacgcccaggttcaagcgattctcctgcctcagcctcagagtagctgggattacaggcacccgctacacacctggctaatttttgtacttttagtagagacagggtttcatcatgttggctaatctggtctcgaactctgaggtgatccacccgcctcagcctcccaaagtgctgggattacaggcatgagccaccgcacccagccagctcacacattttaagccagggatcataaaacccacctttcaggatgactgtgaacagaaccagattcagctggtatgctggtatgcctggcacgacacggcatggcaggcagcattcactctgatcggttggtgcctgcgctgagtatgtagaatttcacccctggttgtgaggctttaaatgagtaaatgcttataaagcattcagcgcattttctgcctcgtaataagaaggtcacaaatgatagctgcttctgctaccactattaatgctatcattatycttattatctggaggcagattgtggaggacttttggaggccaaacagagacactaagatttgaagaggtaggaagtagggagccaaggaatgttattaagaagaagagtaacataaaagtggtgtgtgatgacatttagtgtgacaggtgctcagcaagggcggggacagaggaacagtgtcagggtacagtatctgctccactcactgacctgtctgcagtgtcagcacacttcctggcctatcactgggcctctgtaaggtttgttgaacacatgaatgaaaggcttctactaggactgggacaggtagaatgaagagaaaggaatgatccgagagatattgtgtgggacacatggaccgggcctggcatgggcagtgttacaaataaaggctgggtgcggtggctcatgccagtaatcccagtgctttgggaggatgaggctggaggatcccttgagtccaggagttcgagaccagcctggacaacatggcaagacgtcgtgtctacaaaaagtacaaaaatgagctggatgtggtggcgtgcatctgtggtccyagacacttgggaagctgagatggagggatcacttgagccccaggagttcraggctgcagtgagctgtaatcacaccactgtacatcagctgggcgacagaatgagaccctgtctcaaaaaataaaaaacaaaataagaaataaagtaaaggcacatggctttaggatcgccagccaggtggcccaggtgaatgatgatgaggcactgactgaggtgaggcattgaaggcatggctggactgtgtgctggggacgtgctgggcagggaccagcagcagtattcgaagctacaatggagtgagctcactaaggacttcatttagatgacctcctgtaatatcacagccacctcatgatgggggacaatgagtttcacatgcactaatcagagtacttcctatggtcaacgtcagaaagcaaccagaaccagagcgggcaagggtagtgcttgtctcagggtagctggatccaggaacacaaacatcaccacatccttctttatccttctgggtgcaggtctctttctcttgtcctgcaggtgggctttttctgggcatcagggaacatgagtgcaagcagtctctggtttccattcttttgtttttgtttttgttttaaaggcagggtctctctgctgcccatgctggaagtacagtggcgcgagcctagttcactgcagtctcaaacccctgagttcaagctatcctcctgtcttagcctcccaagtagctgggactacaggtatgtaccaccatgcccagctaatcttttttatttttatagcgatgaggtcttgctacgttgcccaggttggtctcgaactcctgacctcaaatgatcctcccaccttggcctcacacagtactgggattacaggcatgagccactgcacctggcctgtttatcattcacacattactgaagtaggaagtgaggccaggtgcagaatagggggtggatgcagtaagttggggcttggagcagggggcacctggacacccagaggaagcctggtgtggtttcatggggtgaagcagagctgatcaggaggcagaaacggcacagctgagtttagacactgtgagtttacagcttatggcagaacaggtctgcccaggtctgtgactttctccagctaaacacaagaccggcacaggtgaaggcttccccctccaaggcagctggtgtcccatccaattcaaaagcaggcctggctgcaaagacggccttgctatcgagacttcataatgatcatcattttctctctgttactcccaaccctggccagggccttgtgcccctcacagatgggccacccaggatggtgattaacaactacagcaattaggttttcatgatgcacctcgggctggtaacattcgtgactgcttgtggggagagccgagggagaggtacagaaagaggagctcactggtgaggaaagagctgctaagggaaaaaaaaaagtgaggacacaaagaggagagtggagatggcacagaaggaggattgagaaagcaaagaaaatgggccaggcgcggtggctcatgactgtaatcccggtgcttttggaggccgagctgggcggatcacctgagatcaggagttcgagaccagcctggccaacatggtaaaaccccatctctactaaaaatacaaaaaattagccaggtatggtggtaggtgcctgtaatcccagctattcaggaggctgaagcaggagaatcgcttgaacctgggaggtggaggttgcagtgagccgagatcacaccactgcactccagcctgggcgacagagcgagacgccatctcaaaaaaaaaaaaaagaaagaaagataaaagaaaagaaagaaagcaaagaaaatggtccacggaaacggagtcagctccgggccttgcacatggctgaggctcagccggtgttcrtgcagcgccgggtgggtgatgggcagggaagagaaggaccacctgtaaccctaggggcactgcacgaggtgtccctgggctcgtggggagtatgcatctggcgatgagaccacgacagtgccagaaagggtcccaggatggtgcccagacacaagacttcttggctgtagtttctgccaactctgctggcacaacccaagggatgggagggtttatcttcttcagctcatgaccttaggacagtggtctctctccctctttcctcctcctttcctctccgtctgccatttagggaaaaagccactttactcaaccagctggggtgaattctgagaggaacacaccacattttagaagacacttgaggatgtcttggttaagtaaccactgaatccagcctaccttggcttaattcttaaatctgagtcttccattttccctcaaaccaccccctgctgttctgattctgtccctggtctccctttctctgcctggatgcattttcctagaagcatttcttggtgcctgacaccagcccctctcttcagcagctgatggaccccaggccccatccccccaacaccacagcatctctggtctaggtaagagcaagcttctctaacctgggtcttcagcttacagcccagctcccatcacgccccgtttcccgctgtttccccctgccaaggaacttcagttagtcctctccactgtcactcaaaagtggctcattttgtgaccagcctaggcaacagggtgaaaccccatctctacaaaaaatacagaaattagccaggcgtggtggcacatgcctagagtcccagctactcgggaggctgaggcagaaggatggcctgagccccggtggtggagattgcaatgagccgtgakcacgccactgcactccagcccagcccgggcaacagagcaagactctctcaaaaaaaaaaaaaaaaaaaaggccaggcacggtggctcatacctgtaatctcactcagcactttgggaggctgaggtgggtggatcacctgaggtcaggagttcaagaccagcctggccaatatggtgaaacctcgtctctattaaaaatacaaaaattagccaggcgtggtggcaggcgcctgtaatcccagctgctcaggaggctgaggcaggagaatcgcttgaacctgggaggcggaggttgcagtgagctgagatcgcaccattgcactccagcctgggtaacaagagtgaaactccatctcgaaaaaaaaaattgtctcattacataggcaagctttactacagtccctcgactaaatagctgagttcgaatataattcatacctgaaatggtgcatttgcagtgggaggaggttaggaacatggagagagtgtcgtatttcttcaagtatatggacagaacattcctcacgtgattctcaaacgtggtcccagaactgcagcctcagcagctcctgggaacttgtgaaaatttgaaatttttgagctccaacccagcccagacctattgaatcagaaactccaggaaagaggcttacaagtgtgttttaagaagccctctactcaggaggcaaaggcaggaggattgcttgagtccaggagttcaaattccagctgggcaactaataacaagaccctgtctctaaaaaatataaaaataaataaatttaaaaagagaagccctccaaaacattctgatgcccacttgcttgagtgtgagaatactgctttaatcttgctaggatccctcagaaaagagagtgggtgcagtgctttctggcattattcttttctctgggtggctgggcccaaatagcctcattgtgagcttctttccctgttgatgtcttttttttttttttttttttttgagacaggatctcactctgttgcccagtctggagttcactggcacaatctcagctcactgcagcctcgaccttcctggctcaggcgatcctcccaccttagcctcccaagtagctgagatcacaggcatgcaccaccatgcctagctaatttttaaaattttttgtagagactgggttttgacatgttgcccaggctagtctcgaactcctggactcaaacaatgcacccacctcagcctctaaaagtactgggattacaggcgtgagccaccacactcagtcttgctgatgtcttaataacatctgaccgcagccctgccttaagcaccaaaccacctcaaaacatggccttccttcctgcaaggccatagagaataagaagagtctggccgggcgccgtggctcacatctgtaatcccagcactttgggaggccaaggcaggtggatcatgaggtcagaagatcaagaccatcctggctaacatggtgaaaccccatctctaataaaaatacaaaaaaaattagccgggtgtggtatgcaatcacagctacttgggaggctgaggcaggagaatggcgtgaacctgggaggcggagcttgcagtgagccaggatcgtgacactgcactccaggctgggcgacagagcgagactccgtctcaaaaagaaaaaagaagagtccatcgtatctcacaggccaggatgcatgttttggcctcctgccaccagccttcacttttaccttctgtaaaatggtgttctaacagtatttaccttacccaacagttaaaaggattaactgaccttatgcaggtaaagcactccacagagtgcctggcctatgagtgcccagtaaaagaaagcaattagtaatactggcactatgatcgtagtattatttggtcctatcttattattatggatttctaacttagcaccatcccaatctctctcatgtatgttttgaagtaagcaaaggcaatagcaraaacagaattggtttgcctggtcagaagacagcctgctttctgggctgagagaagcaaaacaaaattgcacagcatttcaggatgcagtacgtgggcaaaggcttccttcctttttttttatttgccttttttttttttttgagctagaaaattcaaggaaattrcttgaatttgttacaggctccaaatacagttattcctctgcgtcttaagcatctagmactgaagtggaaaattccactctttcaataatggttagccatcttagctcaggccatgctgtggtttgaaggtttgccccctccaaaatgcataagcgtactttggagggcttctcttttcaaatttattatttatatacacttttagagacagggtctcgctatgtttaattgccaatgcaacagtgttgggaggtgggacctaataagaggtgtttaggtcatgagggctctgcccggtgagtggatgaataccgctataaaaagggcttacagtatggattctctctctttcactctcctgccacatgaggaatagtgttcctcccctccagaggatgcaatgttcaaggcgccatcttggaagctgagactgggtcctcactagacaccaacttgccaacagcttgaccttggacttccaagccttcagaattatgacaaataaatttctgtcctttataaattacctagtctgggatattacgttacagcagcacaaaacggactaaaacaggctgctataacaaaataccatagactagtggtttaaacagcagacatttatttctcacagttctggaggctgggaagtccaagattcagttcttggcgagggccctctttctgacttggccattttctcactatgccctgacaggatggagagagagagtttaagagtctcttcttcttcttataatagcactaatcccatcatgggggctgccccctcacgacctaatctaaacctggttatctcacaaatgccccacctcctaatagtatagcgttgagggttaggacttcaacagaagaattttagggagacacaaacattcaatccataagagaaactgagagccccatgacttcactgttccaggcccaggacataccacaacacatgttagagacaaaatctctgccctcagaaagtttgtaatataataggaggaattagataataaagacatttatttcaggagactgttaagtgctatgaagaaaattaaagcaggagaaatggatacagagagttggaggcagtagtgggaggaagccattttagataggtgatcggagaaagcgtctctgagaaggtgacatttgagcagagccctgagtagggtgaatagtgcgcaaaagggaaagagagttccaggcaatgggaacagcttgtgcaaaggccctgtggcaggagcatactggtgccctgaggggagcagctggaaggacaacaggtctagagaacaaaaggagatgcgagccaagaggtagcaccagatcacatatgaccttggcaccagatcacatatgaccttgtagtcataagaaggatttcaggccaggcgtggtggctcacacctgtaatcccagcactttgggaggctgaggcgggtggatcacaaggtcaggagttcaagaccagcctgaccaatatggtgaaaccccatctctaccaaaaatacaaaaattagccgggcgtggtggcacgcacctgtagtcctacctacttgggaggctgaggcaggagaatcgcctgaacccaggaggcagaggttgcagtgagccgaaattacgccactgcactccagcctgggcgacagagctaagtccgtctccaatataaaataaaataaaataaaataaaataaaataaaataaaataaaataaaataaaataaaacaaaataaaataaaataaaaataaaggatttcaaagtgcctgaaggacagggacaggaccactgtcataccttgttgagaaggtgcagagggtcacatagccctactgccaccaaagccttgatttttatgcaattgataacagcagcagctaacagctgccgaccatttcctctgtgccaggctttgtgttaagtgctttacacgagtgatctcaatttattctcacaacaggactatgagggagattctatcattagygwtttacaaatgaagccagtgagcctcaaagaggttcagtccctttccccaattctcagagccagttgggcaaagagtcccagggcagaatgaaacctaatggaacctctttctacagggtgctgtttgagtagtggggcatgtgagtgtgccccctgccacaaccatctttctttctcattaactggcctattacatgttttacacaaagtaaaggaagatttctstctctgaggcctttctgaacttccagagcagacacatgtgaccatcctgagagactgggtcttctgcaagtgtggaaatgtgctttaacggcatgtcagcaaaacccaagatctgcatgcatcacttttgatgggaaaagtgtcagactttagtcagggatcgggcagggaagctggaagggcggggctgggagagtcactaggctgggagtgaggctggcagggactgtaatctgggagagaggcagaaaccaagtgtagggatgtcagtgaaggtgggagtggtgagcagatatggcaggtgagagtggtgtttaaagaaagtcattttcaggggctgggcatcttagctcacacctgtaatcccaagattttgggaggccgagctgggcggatcacttgaggtcaggagttcaagaccagcctgaacaacatggtgaaaccccatcttcactaaaaattaaaaaattagccaggcatggtgatgcacacctgtaatcccagctattagggaggctgagatgagaatcacttgaacccaggaggtggagattgcagtgagctgagattgtgccactacactccaacctgcatgacagagtgagactctgtctcaaaaaaaaaaaaaaagaaaagagaagaaaaagaaagtcatttcaggtgaggatcaggaacctggctggggagacaaggtggggagcaagaggcattattcatttatacattcaactttcattgactcagcagagagactgagcaataaggggccagttatctcagctataataactaacatttaaataaacaaaagctctcagggttgcaacttcctgattgtaccctgccccatattccaactgtattaactgatctctgtatggtttcaaatgataaaaatacacatgaactattttagacaaaaggaggatgtatggattcctataactaaaccgtgggaagacctggagtgtagccagacctcaggggcaactggcactggccagactcctttctttccatctctmttctctcatccattcttctgagtgtccatttcagcctctctcattggtctcttccataatgaatggaaacatggcggcccacactcagtgtctcaagagagaaactgaagttcccacacagagatgaactctgattggccagtttgagtcaggtgttcatctttatgcccatagcaaggtcataggagacaagatggcagctcccatttgaactacatgctggggaataaagtaagagtcattcctcaggggaaaaaatgtaagaggtgttaagttgtcaaaacagtagatgctcactatagtctaccctttggtgctcagtatacaagcctgttttcttccccaaagtagaattccaaaccagcccccatctaacaccatacagccatcccatgcaccactgtgaccacattcaccctcaccctgacaagggacctgcagctgtggcacccagtagtgtctaatgacatccgtcaactctggacatgaatgcctgygatcctgagaacgagttaaatgactaatcactcctaacatgccaatgtaaataatgaagggaccagaaaatatgtgaggaaaaatatacaagaagataatgaccaaataattcccaaatgtgatcaacacggaacaaaatactgcataatcacaatgaagacttggacttataaaaggaggtgtaggctgggcaccgtggctcacacctataatcccagcaccttgagaggccaaggtaggtggatcacttgagcccaagagtttgagactggcctgggcaaccccatctctacaaaaaaatacaaaaaattagccaggtgtggtgatgtatacctgtggtaccaactacttggtaggttaggatgagaagatcagtggagcccaagactttgaggttacagtgagctatgatcatgccactgcacaccagcctgggcaacagagtaagatcctgtcaaaaagaaaggagaggggagaggaggagaaaggaggggaggggaggggaggggaggggagggaaggctaagttgatgaaatcaataagtatacagtgactcaaacaagatgtggtggcttatttccctcatctaacagaccaggggcgggctggagtccacagcataggagatgtgtttctctgtcctgcaaagttgtcctggagaccagattccttctgtctagatgtcccaccatccctagagttgtgtcctcatctgcatgttcaaactgacacacatcatcacacccacatcatggttttttttttttcgttgtgttttgaaatggagtctcactctgtcgcccaggctggagcgcagtggcatgatctcggctcactgcaacctctgcctcccaggttcaagcaattcttctgcctcagactactgagtagctgggactacaggtggctgccaccatgccaggctaatttttgtatttttagtagacagggtttcaccatattggccaggctgatctcaaactcctgaccttgtgatccgcccgcttyggcctcccaaagtgctgggattataggcttgagccaccatgcccagcctcatcatgtgtttttataggccaggcttgtggcttctttggcgatccaattctatcaaaagttggaaacatcctgatctatttgcttccaattatttccatacagaaatgccacacccagagatcccttctggacatggttctgaagcctgccaactctggcattttcctaactggctcccatgcctggcccattcctgctgccccatcttaatgctggctattgtggtgcctgaaacaacaggctgtgtgggcagatgacacatcacatctttgccacagggctgattcccattgccagggagagaaatttcagtggtgggtaccacggcctgccttcctggttattgcaggtggagctttaccaaataacagactaggaggagtcaccatctggccatcttgcctcatctgtgttttctcctttgcgttgctcaaccactaagccaatgtcacatactttagattttttttgttcaagttgcatctcaccttcagcacaaatgtctgtattagacataggttatgctactataacaaacagattccaagatgcagtgatataaacatggtggaattctctttttctctcacacaacaattcagagtaggccccaggcaaacgggcaactctgccccatgagttgaccaggtttccaaattccttctctctccttgctgctcctccattcccttggccacgcagtcaaaagtgtcccaccccatcacctccaccttccagtctgtggaaggagaaaagaatggaagtaacaggcaagcaacctccttaccaaaagtatgatccagaaatttcccacatcacyttgggccacatcccattggccagaactgcatcatgtggccacactgtgctgcaagggagtctgggaattacagtccctagctgagcggccatgctggaatgggaggcacttgtattacttaaaggaagaaataggaaatgaatactggggaacaactcctatctccgcctcagggaaaaaggcaatttacaaacagtgatacagatggaataccacatcttgctggtcaggggaaaacccagctcccatagtgatttgttcgtagactcacttccctgaatatggggactttcttagccaatctggttatgccaacatcttgcctcctaggagcagccttggcttattgtcccccagcaacaaccctgagagagccaacaggaaggactcccttactgagagctgggccatcttaggagcccacatcccactggaggcccgaggattgttttaagtcttgtgaaatcacaggcaactcgcacaaagctcgaggtgttttttttgtttgtttgttaattgatttcgttgttagttggttttgacagtgtgtttgttttgcaacacaactgacacagaaccctggctgaactctgacagccagtacctaacccccaaaattttgtccaggctcaaacttggaatcaggatctgtcttagtccattcaggctgctataacagaataccatagactgggtagcttgtaaataacagaaatgtattgctcacagttctggagactggaaagtccagggttcaaggcactggcagattcagtgagggcctgcttagtcatagacggtgactccttgctatgtcctcatgcggcagatggggcaaggcagttctctggttttataagtgcatgactcccattcctaggcttggtccccttcattccattctcattatctaatcattcctccaaaggccccacttcctaataccatcactttgggggctaggatttcaacatatgaatttgatgggacacattcagaccatggggctcttagatctcttagatgcaggtgtgggggctctacttatttttgtaagcctcgggatctaccctggccttgacctctgcaggggtgatggagctgcctaatctgcctgttgtgctgccctgctcccaggctgtgcttcatcatggaggcattgggtaaattaagacagtgccaggttcttgggaagggccactaccatgggccaaagaatctaccagtgccccaggtcgaattgycctaattgccctktccttctccccaccttgtttggagtaaccagttccttcctgctttggaatggggcaaacttcttactcaacacacgcaacaggaagtgtctctgccagacataccactggactctgctctcttctcagggtgcaacatagaaaatgcctgctacccrctgggcatctgtgctgaacggaccgctatccagaaggccgtctcagaagggtacaaggatttcagggcaattgctatcgccaggtgagtgggaaagccaggttgcaacaatattcattcatctctttagccaacatcttccttacacatattattcattcattcattcatctgacatatgtttattgtggacttcctatgtgccaggcactgtacagggccctgggatgagtgctgaggataaggagataaataagaaatggagtttgccctcagtgagcctgcaaagcaggtaaataagcaaggcaactctcatacaagggccagtatgcccctgttccagcaacacaacgtgatacagactcctgtcctacaagatwtaacagaaaggcagcattgaaacataaagcggggggaacctgagccaggygcggtggctcacgcctgtaatcccagcactttgggaggccaagatgggcagatcacgaggtcaggagatcgaaaccatcctggctaacacagtgaaaccccgtctctactaaaaatacaaaaaaattagctgagcgtggtggcrgatgcttgtagtcccagctacttgggaggctgaggcaggagaatggtgtgaacctgggaggcagagcttgcagtgagccgagatggcgccactgcactccagcctgggcgacagagcaagactccgtctcaaaaaaaaaaaaaatttttttttgctgatggtggcatgcccatagtcccagctatttgggaggctgaggcaggaggatcacttgagcctgggagttcgaggctggaatgagccatgattatgccattgcactccagcctgggggacagagtgagaccctgtctcaaaaacaacacaaaacaaaaaagcattgagaacagtttggaaaggtcttcaccggcaagtaattatcacagtgttgtaccattggattctcttggcttacttataggttctgtattgtttgaataacaaaaaaggaatactgaaagctgggtttagtgcaaggccagtggggactgcacagaagcaagcccacgtgccttttataagatcctacactttgcctcagtctggccccaaggagacccagcttaatttgtttctgagtaagtaaagcccgaggtgcactcaaggagaagggctccagtatccgatagccttccctgtcaccgaggtgtgtcctggcttccttaaggcttcyggaggaataaatgacggttggcgggcgcctgtagtcccagctacttgggaggctgaggcaggaacatggcgtgaacccgggaggtggagctcgcagtgagctgagatcacgcctctgcattccagcctgagtgacagagcgagattccgtctccaaaacaaaaaagcgggagggacctaaaaatcacctgctatagactcccttgccaccacccccattttatagctgatgaaattgaggccccgataagttgaacaactttcctgggagttagtgccagagctgggacaaaacccaggttccagagtctcactgcagggctcattccactacatcatgctgtgccaggagatggaacacttttccctgttctccacaagctgatgctaggatcctgaatgagccactcagcactgctctctccttcatttggcaacactcacctctaggtccaagaaccaggatacaaaaacagtcaggtaaacagtagttatggttcaaactaatcagagtccagccaaggttctggctgaacaagagccccaatcaatgctcctatatgtcccaaacataaatatcctagttggtatggcttactttccacgggagcatgttgaattcttgttggctctggccctagactcagtggtttcaggatccaagcacgtaaattagcccttttactggactccattattgaatgacttaatggtgaattgctcctgtgtgcacctttgcattgtgtatgacagttttcttaacaagttaatgatgcaagaaaaatgacatgggaaatgttgatcccacccagaaggaggctgcatgcctgttggtctttagggacatctgggtgcataggtcacattctgtgaggtaattatctcttcactcatagtggagttaattcctgtggtagagctayagcacctttctggctaaaatacagaaagagagctacaccttttagcacctttctggctaaaatgcagaaatgcaggggtttagtgcaaggccagtggggactgcacagaagcaagcccacgtgccttttataagatcctacactttgcctcagtctggccccaaggagacccagcttaatttgtttctgagtaagtaaagcccgaggtgcactcaaggagaagggctccagtatccgatagccttccctgtcaccgaggtgtgtcctggcttccttaaggcttccggaggaataaakgacgctgtgctgagaacattttgtgcagataggccaagatcaggatgtgaattgcactttatgaaaaaaaagagaaaaggagggaaataactcaatttcaaagctgatccaagaaaataatgatattctagggaaaaagaggccaaagtcaaccaaaggataatgatgccttgctctatttagaattttccaaatgagaggctttttctcttggtcattatcgacttttaaacaaaactaagtatcactagcaatgattagcaaatgtccttatttacacaaaacctgccatttttccagcacccaactgctgtactctrggtattcagctcagtttccctgagcccaagatgcactcattatcgcactcatgatttgttaaattgagarcgtttgtggatttagaggatgaatgagaagtaccagctcccttgttaacatcagatgggtctgagcaacctcagagagaacccctctcaggtctttaaggatggagaccgcactcaggaaaggtccgtgtgtcttactgctcacagacagatgagactgccccactgggtcccagctgtagtgatcagagtcagtaggtttccagcccgtcaagtctgataagtacggcctcagtgtgtgaccaaggtgagcacaaaccacagaaaactgtaaatagccagcaaaaggcaggacagagtgaagggcagggtagagggagaaagggggaagctgtgaagaaacatcctgaggcagccagcaggtgctcagtcttgagtgctctctcttggcaggaacgttgagtaagttagaagcccaggcttcagggtcagtgaaaccagtttccaaatccagccgcattatggaccttgggcatgctgcttagaccctgagcctggcttctcatctgtgaaatggaggagactggtctgttacagggtcttaagaaacgatttctgtaaagttcctgacacagggtatgtaatacattcaaactattatatakttttgttttgttttgttttgttttgttttgtttgagaacaagtctctctgtgccgcccaggctggagtgtagtggcaagatttcggctcactgcaacctccgcctcccaggttcaagcgattctcatgcttcagcctcctgagtaattgagactacaggtgccggccagcacrcctggctaatttttgaattttyagtagagacagggtttcaccacgttgaccaagctggtctcgaacttctggcctcaagtgatctgcccacctcggcctcccaaagtgctgggattataggcatgagcaaccgcattcagcctcaaactattayattgttttaaagttatcattatttcttctgcaagctgcaaaactaccaaaggcagagtgtgtagatttggggttcaaatcctgattctgccacttcactaactctgtggccttgggcaagtcgtttcacctttcatgatctacmgcatgcaggtgataagagcgmctgcataccccggccccttacagggttgttgggggattaaatgaactaatccacttaaggtccttagcacagaggctggcacacagaaccactatgtatgtgtaagccattactgttaatgcgctgtctctacatcctcagtgctaggctgcctggaaacactatcctgygacttttggttgttgaagcctacaccaaatctaccttcccagtggaatgcatgcttgcccaccttgaaatccctgatgcagatcaccttgtccagggagctagccattgggtagtgggccacagatgccacaagattcagaaagaaggccgggcgcagtggctcatgcctataatcccagcactttggaaggccgaggcaggcggatcatgaggtcaggagatcgagaccatcctgcctaacacggtgaaaccccgtctctactaaaaatacaaaaaaaattaaccaggcgtggtggcgggcacctgtagtcccagctactcaggaggctgaggcaggagaatggcgcgaacctgggaggcagagcttgcagtgagccgagatcgcgccactgcactccagcctgggcgacagagcgagactccgtctcaaaaaaaaaaagattcagaaaggaagcggtgagctcagcaggggtcagatcacacagggccttacaggccatgaaaggaaggctgaatttcattcagagcaactctcccatggccctaaccatgcctttgttacggcatttgtgtgaaattttatctccccctccagagggtaagctccaggaattgtccgattggtytttgttgctcctttcccatgcctgcctgacatagagaaggattttggtcgacatgtstggaatgaagtgaaraataacccccaaaaagcttaagaggccctggctgcaacagctgtcacccagtaattccaagagttcactcggcatcctgggcaggagtccccaccctcttatgtgcccgtgggtttttcttctgaagctggaagcgtcctcagagaggtccccatcatcccatggaacagaacctttcattgactggacccccacatgtaaaaggtagtaatggtgaggattagagaaaatagcacctcagctgctttattctaatcataatatcatccctatctccacttgacgcatgtggttggttggttgggtggttgatcagttgcctagctcccctcactagtctataaactcctgagcatagtgaattttgtctgttttgttcactgctgcactcctagcaccaatgacagtgcccagcactgctcagtaaatatttgttggttgaaatgagacaatgcatataaaatgctttgcagaatgyctggcacattctaggcacacattatcttttttttttttattttattttatttttatttttatttatttatttttatttttttttgagatggagtcttgctctgtcacccagactggagtgcagtggcatgatctcggctcactgcaacctctacctcccaggttcaagcaattctctgcctcagcctcccaagtagcaggkattacaggcatctgccaccacgcccggctaatttttgtattcttagtagagacagggtttcaccatgttggccaggctggtcttgaactcctgactttgtgatccacccacctcggcctcccaaagtgctgggattacaggcataggcacacattatcttaataacaattgttgttaagatataataagatgaattatgaaatagtacataaatcacatagcatataataaaactgtgtatgataaagtactaaaattatgacagagcttacatacgtaaggaaataaatgtccagcacttagaacaggcagtaacaatatgtatataacattctaaagtttacaaagtcttccatacaccttatctcattttatcttctagcattcttacaaagcagatgacgtatcatccacattttacagcaaataaatgagacttggatgagttaaaatgacttagtcaaagtcacacatagcaaaaggaagagccaactaaaaaccaaaatttaaatcctgtgttctgccaggcatggtggctcatgtctgtaatcccagtactttgggaggctgaggtgcaaagatctcttgagcccagaagttcaagaccagcctgggcaatatagtaagatcctatttctacaacaaatcagaaaatgagtcaagtgcggtggtgcgtgactgcagtcccagctactcaggaggctgaggtaggaggagcctttgaggccaggaggcagaggctgcagtgagccatgattgtgccactgcactgtagcctagacaacagaacaagaccctgtctcaaataaataaataaataaaaatcctatgttcttccagagatatcacaaagctgtgggtccagaagagtaagaaggatggtggctgctggcttcacctgtggtgcaggcttggaattttccatcatcaaaggcacttgtttgttttgttttgttttgttttgaggcggagtctcgctctgtcaccaggctggagtgcagtggcaccatctcggcttactgcaacccccgcctcccgggttcaagtgattctcctgcctcagcctcctgggtagctgggactataggtgtgcaccaccacacccagctaatttttgtatttttagtagcgatggggtcccaccatgttggccaggatggtctcggtctcttgacctcatgatccacccaccttggcctcccaaagtgctgggattataggcgtgagccactgtgcctggccaaagccgcctgttttagggaccaatccttgtcctgctcagagctggaggtctgcctgtaggagcctaaactctcacaggcaatccctggctggtgagcttcttcagtgcaaggagcccatttttctctctgagacacatgcactttattctttcatgcctcagggcctttgcacatactgtttttttgtttgtttgttttttgagacagggtctcactctgtcacccaggctggagtgcggtggcacaatcacagttcactgcaacctccgcctcccaggctcgagtgatcctcccacctcactctcctgagttgctgggactacaggcctgcaccaccacacctggctaattttttgtattttagtagagatgcagtttcgccatgttggccaggatggtctcgaactcctgacctcaggtgatccatccgcctcagcctcccaaagtgctgggattacaggcatgagccaccacgcccarcctgcacatactatttatttccttcgcctacgacacagagaaacccagggcttccgaatagcatctctgcctcttcatcacactgaacctatctcctcacccttaaagtggccattctgacatcttgatgtcagscctctgagcccaagctaagcggtcttaacccctgtgacctgcacatatacatccagatggcctggagcaactgaagaaccacaagagatgacattccaccattgtgatttgttccttccccaccccaactaaccaatcgatcttgtgacattccacccccccaccaccgacaatgagtctcacgrtctccccaccctgcaccgtgtgacccccgcccctgcccacaagaaaacaaccccctttaactgtaattttccattacctacccaaatcctataaaactgccccaccctgatctccctttgctgactctctttgcagactcagcctgcctgcacccaggtgactaaaaagctttattactcacacaaagcctgttggtggggcggggcggggtggctcatgcctggaggccgaggtgggcggatcatgaggtcaggagatcgagaccatcctggctaacatagtgaaaccccgtctctactaaaattacaaaaattagccgggcgtggtggtgcatgcctgtaatcccagctactcgggaggttgaggcaggagaatcgcttgaacccgggaggcggaggtttcagtgagccaagatcacgccactgcactccagcctgggtaacagagcgagactccatctcaaaaaaaaaaaaaaaaaaagcctgttggtggactctctttacacagacgtgcgtgacaccaggctgctctgagaattccatgaattaatgaatgttgagtgcctggtacagagcctggcatacagtagacattcactaaatggtgacttatgaactctacacttcctccaaggaccaggacacatgcctcctcctccataaaatcttccttctcagtccacaggcagggatgagctccctcatactgtgtgttccttctgcaattttttttttttttgagaaggattttcattcttgttgcccaggctggggtgctatggcacggtcttggstyactgcaacctttgcctcccggattcaagcgattcttctgcctcagcctcctgagtagctgggagctacaggcgcccaccaccaagcctgggtaatttttgtatttttagtaaagacggtgttttaccacgttggccaggctggtctcgaactcctgccctcaggtgatccacccacctcggcctcccaaagtgctgggattacaggcgtgagctaccaagcccagctgcattttgtttaacatgataactcagctggttttttacataacagagacaaattctctttgacctttgtattcccgggtgtgggtgatggtaagtgctcagtaaacgtttatggatggcactaatgaaagtcctgcccatggccctgccttgtggcagtgtggaaagccaccacgtggccttctcagccttcaggacacagtggatctgtgaatcaggaactgcctgatggggtatgacccaaatcaggaacagaccgagwctcagggcctgaatcttagcaattgtcctcagtccttgggagagactaatttgagtttgattctttgcttccccagtgacatgcaagatgattttatctctccatgtggggcctgcaggcaagtcatgagagaggtaagcagcttctcttgctgtctggaatgcaaatatcttccctgtcgcaggctatgggagccamgccaagytgcaggcatggcaggcatggcaggcgtggagacacagctactgtcctgtttgcttggttggctgacttctaaggcctccctacgcttgcatgagtcactggaaattattccttcatttaacaaatacttaccgagtgagtgtctgctttgtgccaggccctgaggtagctctggggaggcacagggaaaagatgggccaggccctgccctcacagagctcataggctaatgcaggagacagatgataaacaaggagcaaaataaataaacaaacagtggcgtttctgagtcaagagggctatagaggaaaacaaaatgcagaaaaaaaaaaggagtccagtgacaaacgggcaaacaggggacactgcagattggggtcagcaaacaacagcccttgggccaaatccagcctgctgcttgtatttgtaaataaagttttatgggtatacagccatggccattcattcacctattgtccatagccactttgccctgacacagcagaggtgagccattacgacaaaggccacatggcctctaaacctaagatatttactgtctggtccttgacagaaaaaggtttgccaacccctgctttagatatccaggaaggccctctttttgagcatgacatttgagcagaaatataaataatgaggaaaaaaatgagacagacaaaggtcaaaaaaggagattcagaaccagcaagttcagacccttggtgaatttgagaagaggcaagaaggccacgagggctagagagctagggcctggtaggtggaaggaaagcaatgggattgaagtcagaggggtgggcagaggccagatcacatggggcctggccatggaacgaagggtacattttattccaagaataaaggaaactgaagtgtacacttttttttttttgagacggagtctcactctgtcacccaggctggagtgcagtggyagagtctcagctcactgcaacctccgcctcctgggttcaagcaattctcctgcctcagcctcccgagtagctgggactacaggcgccagctaccatgcccggctaatttttgtatttttagtagagactgggtttcaccatgttggccaggatggtcttgaactcctgaccttgttatctgcccacctcggcctcccaaagtgctgggattacaggcgtgagccaccgcgcccagcctggagtgtacacttaaacatggttaaaatggcaaatcttacattatatatattttatcacattatatacattgggaaaaaagggaataaaggtaagccattggatattttcaagaagaaacttgaaggactttttataaaagtcctcttgatggaaggctgcaatttcttcaactctaaaaacaaaacggtaagccaggtatggtggctcagcctgtaatcccagcaattarggaggcagaggcaggaggatcgcttgggtccaggagttcgagacctgcctgggcaacatagcgagaccctgttctccacaaaaaaaaaaaaaaaggaataaaacaaaacaaaaaaatgaaaacgaagggatagtttagatcatgggttcttaatccaggctcaggggaaggttttcatgtttatatgtacgtttggggaaaggggaatgtcagtaactattgtggattctcaaagagatctgtgtcctctagagtcccaaaagattagagaatcccacaggccctgagctccagcataatatcaagagcccctcgaaatacggcatcttgtgggcatgatggcttacacctgtaagccctgcactttgggagactgaggcaggaggatcaccttagcccaggaattcaaaaccagcctgggccacatagtaaaacccggtcccttcaaacaatttaaaaattagcaaggcatagtgtgcacgcctgtggtcctagctgctccagaggctgaggtaggaggatcactagagcctaggaggtcaaggctgcagtgagctgtgatcaagccactgcactcctgcctgggtgacagagcgagatccggtctcaaaaataaatacatacctacagcatcttgtttaatcccctccccaagactgagtgaaatgcatgtcgttattcccatttcccagtgaccactctgaggctcagaggagtaaaatgacttactgaagggccccctgccaggcggtgacatatgggtatccatggcccatcaggctgactctgaagcccgtgctcctcacggctgcctctctgtctttgtggttctgtaagttggacaaaattattttcarccatggaggaaacataatggtactttggcatgtggatgctgcttgtaccgtgggagtttctgcttttggagttgtgttttgggagaaagggggttgttttagctttgtttttgtgccgtggggtttcaaagcatctggggatgcagacacttccatcttcctcctgcttcctgccaggagtgcaaatcagacacatttcccaaatccaaaaacawaccaccgggaaagcagtgaatttacacggtggaatttgtctcacttgagaggggcagaaatagctgccctgcacggtggaaatgtcgaaggtcatataaggaagccacaacagggcgccaagtccctggctcccaaggccccgacgtggtccaattgctcagtgctgttttctccaaacagattggatgttggcaaacgagagaaggcaaatgaaaaagctgaaggaggcaggggggaaactgaaaccaaatgcaaatgataagagatgaggcgttggggccagggacctgacacgtaaactcgccctcggctcaacttttgtctgtacctacccttaggcacagcctgtcaagcagaaaaatttccttccttaaaacattaattctaaaaaagccagaagattgagtgtgcccgggaataacttggtgattcagagagaagtgtggaagaacaggaggctgcagacctgagcagtcactggctaccaacataatcaataagaatggcatctattaattgaacacctactatgtgcatagagatgctttacatgaatcatctctgcatctcagaatacctggccagaaagagcttaggtctgttgaccccacctccagggctcttgtcatgacaccgctgctgattaacctcttgcctaccatcctgcattctcccatccctaaaaccattccatggaccaagacactgagtgagccccagaaagttatcattttcccaaggtcacacagcaaacaaacagtgctcctcatagtataggagaaagatcaagagacaaatttttctttgctgactttactctgctaagcctcagtttcctcatcagtaaaatgggcatcatgatagcacctacctcacagggtagattatgaaaccacgcatgtgcagtatctatgtggtgtggtttggctgtgtccccactcaaatctcatcttgaattgtagctcccataattcccacatgtcatgggagggacctggtgggaggcaattgaatcatgggggcgggtctttcccaygctgttctcgtgatagtgaataagtctcatgagatctgatggttttataaatgggggttccctcacacaagtcctctcttgcctgttgccaggtaagacatccctttgctcttccttcctcttccgccatggttgtgaggcttccccagccatgtggaactgtgagtccattaaacctccttttttattttattttattttwttttttttttgagaccgagtctcgctctatggccmaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcgaactcctgacctcaggagatccgcctgcctcggcctcccaaaagtgctgggagtacaggygtgcgccacaacacccggcctaaacctcttttctttataaattacccggtctcaagtatgtctttattagcagcttgagaacagactaatacactgagtatatgtagcaggcttgcagcttctcctggtgtgaggtgtaaaggggatactgaagggaagcgggtgttagttgtcatttgtcatagcagaaggaggttccaggggttagctgttgctcttataaagccctgggtgagtcttgaatggtgcctgttcacgatgtaccatgcactgttcagtttcacagcattctttcgtttcctcctccctgcagcactatgatccaggtacaattatggtcattccccttttacagatgagaaaatcaaggtaaagagaggaacattagacagtggcagagtcagactcagacccagtccgtctcagccccctcagccacgctgtgtctctcacgccagctttgcctcttttccagtttggcaccaactggcccgtgtacatgaccaagccggatggtacgtatattgtcatgacggtccaggagctgctgccctcctcctttgggcctgaggacctgcagaagacycagtgacagccagagaatgcccactgcctgtaacagccacctggagaayttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaagcgtgtgtcttgctctgtctctatccttgcttgcagctcttaggagggacagcatgatttgtctttataggaagagctggactctttctgttcggagaggaaatgggtaccttggaaccatggaccttatggtgtggagagctgaggttttaggcaacttgccccagcgttctctaaacgggcagctcccctgggctggacctaactgccaataaccatcctagagtgtgtttttgtctcatcatagacctgagcaccaggagactccagagtataaagggtcaagcacggtttgtctagacagtgtaacaaagggttttctcagtagctactgtatgtcaggtaatttgtgtgcatcattttaagtttaacatgctccacagttctgtgaggagggtgtggagatgcccccttttcacagatgagagcactgggctttggagaagttgaataccctgctctaggacaatggcaaacctcagaacagaatccaggccccttaacccccactgtggtccggaaacattgcatgctttttgccatgcactgcgctaaggtgtgtgacatatatgaacccgttcagtcctcatttgtcaaactcaaaggttaattattagtgttctcaatttagaaataagcaactcgaagctcagagtgattgagttgctcacccaaagtcacacagctgatgtggcagaactggaatcagaactagatctgtctgggccgggcaaggtggctcacgcctgtaatcccagcactttgggaggccgaggagggcagatcacctgaggtcaggagtttgagaccagcctggccaacatagtgaaaccctgtctcttctaaaaaatacaaaaatcagccgggcgtggtggcaggtgcctgtaatcccaaccactcaggaggctgaggcaggagagtcatttaaacccaggaggtggaggttgcagtgagccgagattgtgccactgccctccagcctgggtgacagagtgagactccgtctcaaaaacaataacaacaaggattccaaggatttttttccattcccccataactgatgtctcaatttactgattatcttttatatgtcaaatattctaaatattgcagagaaaaacagcctctgcccttgaactcccagcctgacagattgagagaaagagaggtgtacacaggtctaatgcacaggagtgcacactgtgatccaggcagaaccaagtgtcaggtgggtgtgtcggggagcctgctgctgtctggagtgtgaggacagggagggactgtttctttcatgggtgcattggttatcacacatgcacaaaattaggaaggtcaggactgaataaggaaggagccagggtgggtgctctggagggggatgacagctccaggagccctcccaggaggagttggtcttggggctggctcattgggtggggtaagaatacagcttaggtttcctgttcccagggcaagcaagtacctaggggcacccaagtggacatcaccccttccctggaagccctttccaccctgatccagtgttgccacctgatgagaatggctttgccacaacacactcagacttatctgctggcatcttgggagcatcccagtcattccagcatggctatatgacacacaactccattctgcttttttttttttttattttattttttttgagatggagtctcactctgtcacccaggctgaagtgtagtggtgcaatctcggctcactgcaacctctgctgcccgggttcaagtgattctcctgcctgagcctcccaggtagctgggattacaggcacctgccaccgcacctggctaattttcgtagttttagtagagacggggttttaccatcttggccaggctggccttgaacacctgacctcatgatccacccgcctcggcctccctaagtgctaggattacaggtgcgagccaccacgcccggcctgactttctttagaaatggctttggtggctgagcacagtggctcacacctataatcccaacactgtgggaggctgaggtaagaggacctcttgaggtcaggaattcaagactagccaagtaaacagtgagattctgtctctaaaataaacaaataatataaattaattaaataataaaataaactaaataaattaaattagcttggccttatgatgcttgcccgtggtcccagctacccaggaggctgaagcagacggatctcttgaggccaggagttcagggccacagtgggccatgattgcatcactgcactccagcctggacaacagagtgagatactgtctctaaaacaacaacaggccaggcacagtggctcacacctataatcctagcactttgggaggccgaggcaggtagatcactcctgacttgaggtcaggaattcgagaccagcctctccaacatagcaaaaccctgtccctactaaaaatacaaaaaatcagccaggcgtggtggtgcgtgcctgtaatcccagctactcaggaggctgaggcaggagaatcgcttgaacccaggaggcagaggttgcagtgagctgagattacgccactgcactccagcctgggcaacaaaagtgaagctccatcacaaaaaaataaaataaaataaaggcccagtgtttgaccctcagtaaattctccgtaaatcttggctgttaaccctcaacaagggtgataaattttgttttttttaaggatggatttgtttttgcaaaattttacagcctttttttttttttttttgtgagatagagtctccctctgttgcccaggcgggagtgcagtggcgtgatctcggctcactgcagcctctgcctccagggttcaagtgattctcctgcctcagcctcctgagtagctaggattacaaacgcccaccactacgcccatctaatttttgtatttttagtagagacggggtttcaccatgttggtcaggctggtctcgaactcctgacctcaagtgatctgcctgcctcagcctgccaaagtactgggattacaggggtgagccactgcatacagcctatacgttcttttcacaattttttttttaattattattatttttttgagacggagtctcactctgtcgcccaggctggagtgcaatggcatgatctcagctcactgcaagctccgcctcccgggttcacgccattctcctgcctcagcttcccaagtagctgggactacaagcgcccgccaccatgcccgggtaattttttgtattttcagtagagacggggtttcaccgtgttagccaggatagtctcgatctccttacctcgtgatccgcccgcctcagcctcccaaagtgctggaattacaggcatgagccaccacgcccagcctcttttcacaattatctatcggtgcttactgctgagaccagttcccagggacacagcagtaagcgaggcaaagtctttgccctcacagagctcctagtttatcagtgggaaaatgagatctacatgattatagtacttcatgacaagtgaagaaagccctggcagcaagcagcagaaagagcagaacttggctgggcacagtggctcatgcctgtaattccagcattttaggaggctgaggcaggcggatctcttgagtccaggagttcaagaccagcctgggcaacatggtggaaccccatctctacaaaaagtttaaaaaattaggccagccatggtggctcacgcctgtaatcccagcactttgggaggccaaggcgggtgggtcacgaggtcagaagttcgagaccagcctgaccaacatggtgaaaccccatctctactaaaaatacaaaaattagccaggtgtggtggcacatcctgtaatcccagttactcaggaggctgaggcagaagaatcgcttgaacccaggaggcacaggttgcagtgagccgagatcatgccactgtagtccagcctgagcgacagagcgagactctgtctccaaataaataaataaataaattttaaaaattagcagggtgtggtggcaggcacgtgtaatcccagcttctcaggagactgccatgagaggatcacttgagcccgtgaggtggaagatgcagtgagccgagattgcaccactgtactccagtctggatgacagagccagaccctgtctcaaaaaaaaaaaaaaaagaaagaaagagaaaacaaagaataaaacttgccttcatgcaagaccacccggaggagaggatgttttagtcagagcagagaagtgtcatccagtaagagaatggggtttggagaagggtaaaatatgagactgatggaaggactaagcctagtatccttatactatgtggaaacaatctatggaaggcgattctcaaaggattctagagattcttcaacaatggcctcttggaagaacaatactcatttgcctggagagaggcaataaaagcattttcactttgcagccccattgtacagaacacagcgcggaggacatgcgttttcggagcagtcccattgtgcagaatgcagtgctgaggacatgtgttttcggagcagctcatgttcttttttttttttttttttttttttttttgagacggagtttcactcttgttgcccaggctggagtgcagtggcgtgatctcggctcaccgcaacctccgcctcccaagttcaagcgattctcctgcctcagcctcccgagtagctgggattacaggcatgtgccaccacgcatggctaattttgtatttttagtagagacggggtttctccatggtggtcaggctggtctccaacccccgacctcaggtgatccgcccaccttggcctcccgaagtgctgggattacaggggtgagccactgcgcccagcctgtgtttaatattttgtatatggtgatatgagcacgggaacagatgtgataggaatgcccaatctgtaaacacagtttttgatgggtacaggaaagaggcgttaagaagattaaattgttaggctgggcatggtggctcacacctataataccaatactctgggaggccgaggtggacggatcacctgaagtcaggagttcaagaccagcctgcccaacatgacaaaacccagtctgtactaaaaagacacaaaaattagccaggtgtggtggcacacgcctgtaatcccagctactcaggaggctgaggctggagaatcacttgaacccaggaggcagaagttgcagtgaactgagatcacaccactgcactccagcctgggtgacagagtgagactccatctcagaaaaaaaaaaaaaaaaaaggaaaactctatgactgaatagaaaactatatggcataatggtgacattagttatctattgctgtatagcaagttactccaacatttagtggcggaggacaacaaatacttatcatctcacagtctctgtggggcaggattctgggctgagccagcttctatggctcgaggtctcttacaaagtggcaatgaatatgtcaggaagggcttcrgtctcatcggaagatttgactgggggtggatccacttcaaagctcactcagtttctggcaggattcagttcactgtgggctgttgctgttactattcagttccttgctatgtgggcctctccacagggcagtttacaacctggaagctcacttctcttagaacaagcaagcaagacagaaaccagagtctttggaatgtcatgaaagtgacagtccatcacttttgacaaatttagtccacagaagcaaggcattaacatccagcccacaatccagaggaggggataatatatatggcataaatgccaggaggtgggtattctaaagatgtaaaaattcacaatgtacatgaacaaggaaaacaaaataaaattaaaaagtagataagcatggtggaagggtcagaagatgcaggcctggttagccctgttaaggagtttgactttattccaaagggcagccatcagtttcaggtgtgggtcacgtgg

SEQ ID NO: 10734 - DNA, 9140 bp, Homo sapiens
  misc_feature (1)...(9140): n = A,T,C or G, or insertion/deletion polymorphism (see Tables 1-2)
ttttttacttttctgagacaaagtctcactctgtcgcccaggctggagtgcagtggcgtgatcttgactcactgcaacctctgcctcctgggttcaagtgattcttctgcctcagccacccgagtagctgagattacaggtgtgcaccagcatgcccggctaattttttgtatttttagtagagatggagtttctccatgttggccaggctggtcatgaactcttggcctcaagtgatccacctaccttggcctcccaaaatgctaggattacaggtgtgagccacggcgcccagctactggaagtcatgatgcaagctgttgtttgaatcatgaattccaaacttaatgagtgctaggttgaagttattttttttctgtttcccttaatcttctattgagatataacatgtattgaagcacagacatcttttgcaagaattcattgagcactatagttatattcatctgtacttactgtctccctggtaaaggcataaactcccttcaagatggggacatggttttatactttcctgaatctcctttagtgcttatatctaacagcacttaaccaggatctggagggggtcaaccagtcttgcttccttccaatctactctgtagatgtttgtgtttttctactgtaactatagaggtaaaggagccaatggtgtttccagtgtctggcacataataggtgctctatgaatgtcaaatgaatgactgaggcataaaaagttcttcctatgacataagtagtataataggaagatcactgggatagaattttcttagaagacgtggctcctagtcctagcactattactcttactgactataactttggacaagtcatttgtttaatttcaaacatttactgaattctgtgtaccaaatactgtacaagttgttcaaaaggctacagagtctctactctcaaagtctagtcaggggagagattacacaggagtgaaaccccatctctactaaaaaaaaaaaaaagaaagaaaaaaatagccaggcatggtggcaggcacctgtaatcccagctcttgggaggctgaggcagaagaattgcttgaacccaggaggcagaggttgcagtgagtcaagatcacactactgcactccagcctgggcaacagaacgaatatctgtctcaaagaaaaaaaaaaaaagaaaaaaaaagtatgtttagagatccttaaggaagttttgaacctatccaatatgttgggagtcaagatgaggagggtaaaagtaggaattcagagaaaggataaatattttgaaggaaggcagcataatggttaactagtcagactgcagacaaacaagcagtacaaatcccatgttcccaggtcttagctggaggattaaatcccagattctcatccttgagaacctctttaagcttgttttcccatctgtaaaatgtagatgataatagaatccttttcctactgtaaaatgatgcacattgggggcttcatgtagccagatatataataaatcctcaatacatgtagcagtggtaggggagaactaaaagacttgttaacatattggatgtaggtgagaaagaagaatcaaaaagaatatccaggttcccgccctgggaggggcagacataaatggagccaggaatggtacaaggagctttgtggtgggcactcactagtacctttctttggaatagctcaacaaatgttcactaagtacacataaagtcaatataacttgatgagctagagttaggctaagatgttgagttagcagaagagtagtacccaactaagggcttgaggaaggcttcctagaaaagataatgggtgcacgtagtcctgaaggatgagcaaggcttgcgaggagggaaggtaggaagggcattccagacaaagggacaaacatgcacaaaggtgagacagagcatggtgaacacacaaagttgtaggcattttgtctttctaggacacaaaaaacaaggtgatgaaaacaaggctggagagacaagcggagaccacaagtggtcacccctcactggcctcgctgtactactggactgctccagcccttcctggcccagagctagagatggcaccacccccgcactgtgcacncaataggtacagacactctcagccccaaacccctccagcctgttactgtgagactcacacatcctgttttcccaagcttgccccacagggtgagcaaactggaccagctggattagagtatttggaaaagtgcaggtggagtttctaggctatgccacgtcaggccagggggtgagatttttttcccttcccctggtctttgggctggggcactccctgaggagggaggggtgtgacccatcccacccattggtggtccatgatccattcatccagtacatcatccataagcatctgctgagccgggcgcagtggctcacgcctgtaatcccagcactttgggaggccgaggtgggcggatcatctgaggtcaggagttcaagaccagcctggccaacatggtgaaaccccgtctctactaaaaatacaaaatttgccgggcatggtggcacatgcctgtaatcccagctactcgagaggctgacacaggagaatcgcttgaactcaggaggcagaggttgcagtgagtcgagatcgagccatcacactccagcctgggcaacaagagtgaaacgccatctcaaaaaaaaaagcatctgctgaaggcacagtattgtgttagaggcttggactaccctgaggaataatagtcctgacacttgaggacatccccatccaattggaaaggcactggataaacatctaagaaaatgtcacaaggcataaaagctgtaataataatagctaacttgtatttagggtaaacaaaaggctgaatcaggctttggactaaatattttgcctgtggctcatttaatcttaataacaaccataagattatctcattttatgatgaggaaactgtatacagagaggtgattgacttgcctaaggttgaacagcttatgagtagtagagccagtattcaaatccagtcagcctccagtgtcccctctctttagtcattagatatagtgctacccagagaatctgctaagccttatagataaatgctatgaattcagaggcaggagcaattactgtggcttgggggcatccacaaagactttctaaggtggtgacacctgatttgggccttgaaactggttgaatagagataagaaaagaacagataatcaatttaactgccgttgtgttttgaatcatcactttaagcctagaatgacaaagctggaaaagaccctaaatatcatctagcccagtggttatcaaattttcttaggatgtggacatttttctttaaatgaaacatgagtagaagccagatgcagtggctcatgcctgtaatcccaactacttgggaggctaaggtgagaggattgctcaagcccagaagttggacaccaacctgggcaacggtgagaccttgtctcaaaaaagaaagaaagaggccgagggcggtggctcacgcctgtaatctcagcactttgggaggctgacgcgggtggatcacttgaggtcaggggttcgagaccagcctggccgacatggtgaaaccctgactctactgaaaatacaaaaattagtcaggtgcagtgctgcatgcctgtcatcccagctactcgagaggctgaggcaggagaatcgcttgaaccccagaggtggaggttgcagtgagctgagattacaccactacactccagcctgggtgacagagtgagactttaatttcaaaaagaaagatgagcagtaatcttgtctcttaaaaaggaggaccaaacattccctagccccaaaacattccctgaaaagttcagttgagaaccactgatctagtccaatgtcctgggatcctcgcttttatctttgctatctggagaaggaagagacagcggtagttcccaaaagacacaaacaatggggacattttaaacgggagtaaccagctaagcactctgctgctgctgcttgtctatttgccctcttgtcctgcctcagggtgaattgttggcagctacaaatggcaaccaagagagaatggagttggggcttagaagtgcggtagaggaatatgaagggggctggagttggagaggctcttaaagaaagagctgactatattgggactggagagttaatgtaaatctcttcttggttcatggggattttgttgttattgtttttttccccatgacacaactctcaggagatcctgagaacacgtgccctgatttggggggggttttaattttaacttttttttttttttttttttttttgacagagtctcactctgtcacccaggctggagtgcggtggcgccatcttggctcactgcaagcaagctccgcctcccgggttcacgccattctcctgcctcagcctcccaagtagctgggactacaggcgcctgccaccacacccagctaattttttgtatttttagtagagacggggtttcactatgttagccagaatggtctcgatctcctgatctcgtgattcacccgcctcggcctcccaaagtggtgggattacaggcgtgagccactgtacctggccaaaatttttttttaattagagacagtctcttgctgtgttgcccaggctgatctcaagcagtcctcccaccttggcctcccaaagtgctgggattacaggcgtaagctatagcacccagccttccttctttccttaattctattttttgtttgtttgtttgtttatttgtttgcttttgagatggggtcttgcactgttgcctgggctggagtacaatagcgtgatctcggctccctgcaacctctgcctcccaggttcaagggattctcctgcctcagcctcccgagtagctgggattacaggtgcctgccaccatgcctggctaattttttgtatttttaacagagacagggtttcactatgttggccaggctagtctcaaactcctgaccttgtgatctggcctcccaaagtgcggggattacaggcatgagccaccatgcccagccttccttaattctattaatatatgaatccttttctttttttaaaaaaaaagagatagactcttgatctgttgcttaggctggagtgcagtggcacaaatcagagctaactgcagcctcaaactcctgagttcaagcaatcctccagcctcagcctcccgagtagttgggaccacagttgggaaccactacacttggccctactacgggtttttcctgtttgtttgttttttgtttttttgtttttttgttttgagacggaagtttgctctcgttgcccaggctggagtgcaatggcgcgatctcagctcactgcagcctccgcctcccgggttcaagcgattctcctgcctcagcctcccgagtagctgggactacaggcatgcactaccatgcccggctaattttgtatttttagtagagtcggggtttctccatgttggtagtcaggctggtcttcaactcctgacctctggtgatccgcccatctcggtctcccaaagtgctgggattacaggtgtgagccaccgcgcccagctgtttgtttttttgagatagggtctcactctgttgcccaggctggagtacagtggcatgaacatggcttactgcagccttaacctcccaggctcaagcgatcctcccttctctgcctcctgaatagctgggaccacaggaatacaccaccacacctggctgatttttaaattttttgtagagccagggtctcgccatgttgcccaggctggtctcagactcctgggctcaagtgatcctcccacctcagcctcccaaagtgctggggttataggcatgagccactgtacccagcccccttcagggtcttatctttataaggggtggggggtggtcagcacctttctcattgttacctctaccttccctaggtatgtgcaggtgaaatttgtctgcattcggacccaatcaaacaggaagagaacgcgggaggcagacatgtgcccagcgtacttgctcctaaggtacaacgagagactagatagactatttatcagtgaactaaacacacagcacatacatggtgactctaaagtggctagtcctggaggagacaccactggcaaatctcaaaagacaatgtgcctgcagagactccagcctgtgcagcccacaaccaaaaaagaccttgacactgccgagaagtccctggttgagccatcgttttgcctagataaggtacaagtgtcctcaaagccagagcaggaaggcatcactccttctgacctggccaagatagcaaaagtgatgaagaactttcttaaggtagatgagggttccatggcttccttcagtgtgggtgacagccagcacctggaccggctcagcttccagagcagtaagatgacygacctgttcatccgcttcccagagaatctcttgctacaccgggtggagaacacccagggccacatcctctatgctttcttggtggagaacaaggaacgagaaagtcgagtggtgcactttgctgtgctcaaggcggagacagncacctctgtggccaagatgctgagcatcttcacagagttcaactccgattggcccaaggtcaaggtggtctttgtggacccttcattccattacygggctatcctgcaggagatctttcctgctgcccgcatcctcctttccatctaccacacaacccgactcttggagaagaagttgcatcgtagttcagcaaatccatcctttaaaaggctcatgaaggaagccctgcgggargccgtgtttgtcacttctgaagccagcctgaaaaatctctgccagatgtcccaggccgtactggatgaggatctcttcaacttcctgcaggcccactggttcacctgtgaactgctgtggtacatgcatgttaggaagggcctgcttgcgtgtaacacctacatggacagcctagacattgtcaccagcaaggtgtcaagcctctttcgngaacagcagtcgctgctggactgcatcctctgctttgtggattacatagacttctttaataccaaaggcttgaagaacttgcccacacctcctcccaaattaaagagagctcggccggcaagcatgccactgaagtccaagaaggcttttggaatctgtggagagagccttaccagcctccctgcagaagagaccaagccagaygcacagcaggtacaggtacagcagcagtcacaagtgccrccctcgcaggttggcatgctggacaccttgcaccagagtggctctgaactagcctacaagctgtgccacaatgagtgggaggtggtacagaactccacccacctggtggacatggctggctcttcagtggacgttcagctgctagaggactctcaccaggttagcaaagatggctgtagctgcagctgttcctttcaacaatggtaccacctgccatgccgacacattttggctctgctgcacaccagccagcagccggttggtgaagccatggtgtgccgccggtggcagaagaagtaccagtacctccttgggcccaatggggagctccaggatcgtggtatggtcccaaacacaggccagcctgagaagcaaggacggaacgacatgattcaggacctaagcagggagttagcaaacctgctcatgcagaccgaggggccagagctggaggaacgctactccaccctgcgcaagattgtggatatctgggctggcccctcccagccatctgagctctttcagcagccaggagactttaaggacgtgggccgcctccctttcctctggggaaagcaagaagaaggggagggattccctcctgctacagctgtgatgcattattgaagcactttagctgaagcaytggaccacaaacacttctccttggaagtgtgagagtttaaagtgggcaggacatactagggtttagcattttagccaatgtcttcctaggtggggctaggaatattgttacagtagagaggaagggaactccactgtgtgacagtcctttcaatctgccccttttcagccctacttttggcattccttgggagcctcagttgttgttcaaggccaaagttatctccgtgctgcaaggtcaccctcttcctcccccagcccctgagatcagatcttatttgctctgcaaagatgaatccctgcctcaggttagggtgagacaaaatcggtctggtaaaagggcctgttttcagggacaaagggaatgaggatgatctttggctgttgctgctctttatgaagaatcttatttgtaactttttattcatattaaagttgtttttaataaaattaaacaagggaaatgtgttctgcttgatcagggaaggaagaggaattgcatagcaataggactcgactttacagttaggaagtggctgctctaggtggatttattaattttaaagaaaattgaggccaggcgcagtggctcacactcataatcccagcactttgggatgtcgaggcgggtggatggatcatctgaggtcaggagttcgagaccagcctggccaacatggcgaaaccctgttctactaaaaatacaaacattagccaggcgtggtggcgcacctgtaatcccagcttcttgggaggctgaggcaggagaatcgcttgaacccaggaggcggaggttgcagtgagcctagatcgtgccaccgcactccagcctgggtgacagagtgagactctatctcaagcaaaaaacaacaacaaaaaaaaaagaaaagaaaattaagtattagcaacctaatggggttgtggagccaaatagaacctgatgcctcacattcaaggatttggcaatctgcgtcttaatttgcctccttcctacaactaagccttcaaggttgatttcaggtttccttatattctagcgggaagaggccaaatagactggagggtgtgggggaaaaacctgaatcttagacttgactgccagcaacttgctggggaactgtgggcaatttctttgacctcagtttcctctgtaaaaattagcatgttggcctgttctaatcccagat

SEQ ID NO: 10735 - DNA, 63390 bp, Homo sapiens
  misc_feature (1)...(63390): n = A,T,C or G, or insertion/deletion polymorphism (see Tables 1-2)
acctctgcctcagcctcctgagtagctggggttacagacacctgccaccaggcctggctaattttttttttttgtatttttagtagagatggggttttgtcatgttggccaggctgtttttgaactcctgacctcaggtgatccacccgcctcagcatcccaaagtgctgggattacaggtgtgagccaccacaccggccagtgtattttgttttgttttttgttttttgtttctttttgagactgagtctcactctgtcacccaggctggagtgcagtggagtgatctcggctcactgtaacctctgcctccccagttcgagtgattctcctgcctcagcctcccgagtagctaggattacaggcacccaccaccatgcccagctaatttttgtatttttagtagagatggggtttcaccatgttggccaggcaggtcttgaactcctgacctcaagtgatccacccacctcaggcatgagccaccgcgcccggcctatggataaggtcttgatgctggagaaaggagagtgaacaaaacaatcatgatccctgccctcatggggcttacagacagggagtaatcagataattgcacaaataaataatcatagattttggtaaatgctaagacatttacagagggccagaagaaaacatgtcaggcagttccaatctctaggtcaagagagacaggcattctctgttgagctggaagaggaaactaaggcccaggacagggtaggtgtgcctgttgtcgcttggtgagtcagggctgtattaggaccagaagtctcactcctgactactgaataaaaggcctagcttcaggctgatatccatcatgacacatcttcccactcctctccctgctacctcctgattccactccctttggaaaataagttttgatccgcagccctgacatttgacgcccataaacctctaaactccatcttcattatctcctcacccccaccccatacagagtgcagtccagtcaggttggcaagggctgctggtcagggccagatgaccagaaagtgtagaggaggagagaatttggggctttcaggctgggagcagctagggaagggccaagccggaaaagcagcatctgccaggctggtaagagacaaggctcaagtgcaggcactgcgaggaagcgagagtgaggtagaaggatgctctaatgccaggaagtgacgtgcagggacagagggatgggggatgaaggatgaagaatggaggggaggatgaagctgggccacatggctaggaggaagagcagcagggaaggaatgcacagagagctctttgcccccaggtctcttccaatccctgtctcctccttctcttacccccacttctcacaattccagcagagggctgaggggaacacagtaaaattctggagactgcttcctagggagcagagtaccttactaataccccggccagatccatggctcagggaggggtggggtaatccacaggagagtgaaggcgttctagtccccaaggacttttgagaggtcatgcagtccatgcctccgtctcccaacacccaacagaggggaatcatattctctttacccctccctagacatgaagagattctccgcttctcccagaccctctgcttctcacaatccctggctgtggggaacttctcttaaggcacagattggatccctcttgctgcagtctctgacttggtttctcctatcctgtcctctgtggctagagaaagccctcttctgggtgatcacagyggttccttaggatctccccttcaacattccttcatcgttagttggttcttcccagaaggtaagcccaatcccttctactgcagtccctagcatcctctccgttgtcgcatcctacgcctccaaggcagaaatgcacccccttcctcaccaaataattaacagagacaagggagaagaagggagagatccaagaagatggggatgaattaaggagatgsagctggaggtggatgcttgacacagaagaaggaagaccggggacttcccaaggcagggcagggacggggtcagcgggcctcaccggtgtcggggtctcccagaaaggcgtcctcgtccttgcggcccctcagcggggccgcgggcgccggctcgtcctcgggcagccgcgggaagctggtgatgctcatgtagtccactggcgagtaggcgcccagggcgctctcctggctggcctcgttctccgccgccatcctygcccgcgccccccagcagcgcagcgcctgccggaagtggctgcggcgggggagtgggagggcggagggcggggcctgatcttcgcgacagccgggagggggcgcctctcccagccctcggccgtgtcccggtctgactcgcccccgtctgctcagcgctatcagcctgcagctggcacacaggtgcgygtagatggacagccaggaaggcagcgcagggtcgaggggagagcgcggggcaagcgagacttcagtggctctgcactttacgcagctcagggaccaaaccccttcctccttccagcctgaatacagctagtgtcctcctcaaatcccaggcttccttttcgggccccagaccctttcactgaccgcaaatccctctcgaccccagatcctgtctctgaccccaaactcctcggaccccagacccctccttgaattccgagatcctcctcctccgattttagactcctcctccgaccttagacctctttttcgacttcagactctgtcttcacccccaaacccttttgaaaaccccagcccatgcttcatctccaggcctctttgactgcagacgcctctttggacaacagatccctcctctgacctcagatcccttcccgcaccccgacacttctgactcctctttcaaccgcattctcaaactttagtgtgtgttaggatctttgaaagcggatccccagattccactccagagatcatgattcagtaggctgggatgaggtccttggaacctgaatatttaccatcattttaagagtttttgatgtggttctggaaaggacactttgagaaagaaggagtggtggtagtgatggtagggcaggagtggggcaaggtggggaataggtctccatattctggatgtctgggttctattctgccaccgctcaaacactgtgtaatcttgggcaagacaattagtctctctatcagtttccccatctgtgaaatggaaagaataatagtacccattttagagggttgtcatgaggattaagtaacagaatggaaagcgattagtatagggcttggcacctactcaataaatggcatcatcatcatcatcatcattgccttaatctggtagattcattccctccaaactcatccatcctctctccactccaaaattccaaccacactacagcttgtactacttctccatatccaaggatgagggaggttccttcttttacgaggtctctgttccaaactttcattgtgaagtccacaggaagagaggggggctggtgaagcctctatacacacatcctttctcttcccaaccccagaccagtctcagggatggcctgaagtgcttgaaaaatctactatatacacagcagctgcagtagcaactatagacaggagggggaagcagtgtgtcgggaacagctctggggtttgggtgtaggacttgggagagaggataggaaggagagggctactcagagctgtgtggtaagagtgcccagggagggtaacagtctatcaccaaaaagtgtacccattgtctgtgcctttccccaccccagagagttcttatctcctcagtgatgtttgtagggtctattacactaccctgaggtctaatccctctggtgggacccttccccacttgatgaggtctgcaccttctcagtgatgtccactcccacagtgtagttggcagctcctcactggagtttgagtcctctggtagggtccacgtctccttagtaaagtctatatcctctgtatctcttaggggaaatccatgtctcctcactagggtaagtgcccttcaaagccattcatgtcctattagcagggcccagggcccttcagtcagatctgagaacccccagcaacatctgtgctcccttagtggagtccatgtactgtcagtgaagtgtgtgtcccttcggtgcagtgaatatctcctttatgaaagtatctgaccccttggtggggtctatgtccaccccaagaggtctgtactccttcagtgggccctcagattcccgccctccttgggattgggcagactctcggtctcccatagagagattttttttcagcttagggtgtgcaaggtttacagtcagctgggcaaagtgcagggaagtagctgggaagggaggctgggctagatggggtcacaaggcctgtgtaggcttcaggaggtgggagctgcccgcttcaggcctcagaatcactcttggagttagatatttaagaatccttcctgccttgacagccagtctgtgaaatgatggtgaggtgggcacttctttgtggtgagtgcaggtgagagatggaggagggtcctgcctgacttctttctggggtggaggggctagagagaagctagaggtaattaagcccaggttgtggtggtggtggtgggggtttcccttggtggagtaaagagattgtgaaggaaagaagagaatgtgggccaggtgtggtggctcacgcctgtaatcctagcactttgggagcccaaggcgggcagatcacctgaggtcaggagttcaagaccagcctggacaacatggtgaaatcccatctctactaaaaatacaaaaattagctgggtgtggtggtgtgcacctgtaattccagctactcgggaggctgaggcaggagaattgcttgaatccaggaggcagaggttgcagtcagccgagattgtgccattgcactccagcctgggcgacagagcgagagactccatctcaaaacaaaaacaacaacaaaaaaagagaatgtgaatgatttttcctatttgcacagactttgatattttacaagccttagcttcaagcctgacgaggaagtaaaaccaaatctggagtcaaagaacctagctttggccctaacttggtcgttatttgctctctgactgtgcaccagttccttccctttcctgggtttgccatttgtgcaattaggaggtgggcttattacaaaaaacctgaaggtgtctcctagtcttcacttattgagtcttgtactttagatctggatggagatttgtgaaggcaaggagattgaagacatgtcctcataagagggagaaaatctgagctggttccagggtgagcagagaggaggtgctgtcgccagagcatgccctcaaggtcatgggagaagtttttccggaggacgagaatgtgggtgtggctcagagaggggggacctggagggaagggtgtcacctggaaggaactggtgatagtcaggactgtgcaatcagatcacggggcggctccgcgatggaccttactcaactcctctccttagtccatccctttccctttcgatccttgccttaacccaaccccttatctgtcactccaagaccccaccccactctggtcactccatggctctgcctcctctcctgtcacaaccagccgggttactccccatcactccatgggcccacctcctctcctgtcccgcctggccccgcccctcccttggcactccacggttccaccctctcccttgtcacacccggccccgccccttctgctttcactcgacggcgtcactccttccggcaagtcagctccacccctatccctcgacttttccttatagtatttctgtccttgccaacctcgatccctccccaaccagacacggccccgccccctctggcaccgcccacccgccagactaagccactcccccactcaccaggccccgcccctctacggaggccccgcctctagttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcggggtgaggcccggcccgggcgggcctggggtgtcagtgaggagaagagtgggggctccctgggggagtcgggggctcccttgggaagctgaggggtgggtgaggagatggaggttctgtgaaggaagaattgcggttctttgaaaatggaaaagggattccgggaggagacgagggttccatgggagctggggagttccctgcagacttggagggtccgtggtggagatgcgggtttttgcgaggagacgcgggattccgtgagggaagaagtgaggttccttgagattgggacggggaggtcggccaagagagtgaaagtttcatgggaagagaaggggagttcctgaggcgaaaagagggtctctaaggggcgacgggagccttgaagggaggagggccacgaatagaactttctttgcttccctttcacaccagctcagccactgcctcctgagacccttaacctgtgaactgttgagggcaataacgggtctggttcccatcttggggtcctcagattagtaatggagtccccgatctatttttagtatatcggacatcctaatggaaattacgcggtataagactgaacgagttactacgatgtcaagttgttttatttatttttttaacttgggctgggattgtattagtaatagttcmgaagttctgatagatggttccatgtctgttaaaatgtatgaggaaaatcggccaggagcagtggctcacgcctgtaatcccagcactttgggaggccgaggcgggcggatcacttgaggtcaggagttcgagaccagcctggccaacatggtgaaacccccgtctccactaaaaatacaaaaattagccgggtgtggtggcgggcacctgtaatcccagctactcgagaggctgagacaggagaattgcttgaacccaggaggcagaggttgcagtgagccaagatagcaccactgcactccagcctgggcgacagagcaagactttgtctcaaaaaaaaaataaaaaaaaaaaaaaaaaaggtataaggaaaatccccctacccttgccctcagtctgggtaaaggacagatagatagacagatagatagatagatagatagatagatagatagatagtttgttttgagacaaggtgttgctctgtcacccatgctggagtgcagtggcccgttctaggctcactatagcctgcatctcctgggctcatgcgatctttccgcttcagcctcctgggtagctgggactacaggcggacgccatgacacccagctacttttttgtattttttggagagacgaggttttgccatgttgcccaggctggtcttgaactcctggcctcaggctttcctccttacttggcctcccaaagtgctgtgattacatgtgcatgagctactgcgcctagccaaggagtcaaaattgcacccccattgggaggcagcatgatgtttggttgtgggacaaacatgggccacgaatcaaatccagaaaaatctagatttagaccctggctctgctgttcatttactgtggggtcttaggcaaatttttaagcctgtctgagattccttttcttccatctataagataggtctagtaatacttgcctaatgggtttgtatgaggtctaaagtgtgtaataagtatgcgctataacatgcctgatgcacagtacacattcaataaatagtagttagtctgatacaatataaatcaagcaattaccaagtaatgcaagacaggattcaatcaagtgtaaagtggtggagttgggatttgaaccaagacagtttgactgcagaatccatatcctaatagcaatgctattcctcttccatgaccccacagaatgcatttcaccaaattccrtcaaatacagaatttctaccagggaagcagcctcctaatttgtcctctcttgcctagtttcgccaacttgagtctttccagtagatttatcaagacaccattagattgatattatggaaatatgctttcatatgtcactgcaaaaactttcaatggttccctgtttctggcagtttctaattaaaattctgcttttcttttttttttttttttcttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggctttcaccgtgttagccaggatggtctcgatctcctgacctcgtgatccgcccgcctcggcctcccaaagtgctgggattacaggcgtgagccaccgcgcccggcctctgcttttcttttaagacctccagataatctagctccaccctgcctctctattcttatctcccactacttgctaccactcccctcattctagatagatcattctccttgatatcctggatacacatttattcccaccttcttgcctttgttcatttccttctgcttctctctacctagtcaaactccaccacttccaatagagcattcactgatcatcccaatttatgctcacctttttcctcttctgaatatctttagtacttagaaactatgccactcatccagattctgacacacacacacacacacacacacacacacacccctaccccccccaaaaaaacccagaaaaactaagtgtgcataaaattcagttttgtagccaaacatggtgacgcacgtctgtaatcctgctactcaggaggctaaggcacgagaattgcttgaacccgggagacggagattgcagtgagccaagattgtgccactgcactccagcctgggcgacacagcgataccctgtctcaaaacaaaaacaaaaacacctcagctttcttcattctttgttgatggacataaatgtggtttataaatagttttatatactatatgcctactattatcacttgaaaatatttttgagtatttgtactctcgttattagctgcgtggtccttggcagagtttcctgtgcttcctgagcttcagytttctcatctataaaattaggataattaatgtatactttgtaagaccataatgtcataaagattaaatgagattagtccagtccctgatacatgaatggcatttactaaatactagctctcatttgctttctctttaatggccatttattattctatggtattactacttgtattactagttttcatcagtttgttattgttgggctattgggttgtttccagtttcactattatagtgttgctataaacatctctttactaatcactttttttctttgtgattattttcttgaagtctattccctatagttgagatagcagagaaaagggtataaaaagttttatgggctgggcgtggtggcccacacctataatcccagcatcctttgggagggcaaggtgggctcccaaagcttgagcttaggagtttaagaacagcctgggtaatatggccaaaccctgtttctacaaaacaaacaaacaatgtgcgcctgtagttccagctactggtgggggagggggtacagctgagatggggggatcacttgagccagggagatggaggttacagtgagctgagatcatgcyactgcactccagcctgggtgacaaagagcgagacaccgagctaaaaaaataataataatagaaattaaaaaaaaaaagttttatggctcttgtcatgcattgccttgcaatctaataagactgcgccaatttcttacaatgccattattgtgtaagagtatctgttttcccagggccacccagacattgggcttaataatttttttaaatttttactagttttctaggtatataatggcaccttggggttgatttaatttggatttctttaatacattacaacgttgtacactatgtgatttagctttcaattatattctgtcttgtacattaaaaaatatttcatgtgttaatcttatctctccaactagattgtataagctctaaattgtgtaacctgaaacaaatgacttagcttctatgaattttatttcttatgaaatgaaatgagggggtgataatctgtaaggttacttccattgttacrgttctaattgcttctctttcctccaaattttttttttttttttttttttttttgagatagagtcttgttctgttgcctaggctggagtacagtggtgcaatctcaactcactgcaacctccacctcccaggttcaggcgattctcctgcctcacgctcctgagtagctaggaatacaagcacccgctaccacacctggcaattttttttttttttttgtatttttagtagagacaggatttcaccatgttggtcaggctggtctcgaactcctgatttcaggtgatccgcccgccttggcctcccaaagtgctaggattacaggagtgagccacagtgcctggcatcctctaactcttgattcagtactcagactatcctaaattctctgcattcatatgttttacctgttgagtacattttctgcagaatagccaggcagatattttaagaatgtaaatttgatcatgttacttgcttaaaacccttcaatgaattttcattgctcttgggatatataccaaattccttattatacacagaattgcatgatttgcccagtttatgcatcaattcctgctattctttcccttattctcagtgtttcagcctcaaggagttcctcctaacatatgcccttggtctctttttttcatatgggagtggagaaaaacttctattcatctttcagattttagcaaaaatgtctcaaggaagtttagatcttgacttagtaattgtgtaaccttagacaagttatttaacctctctgagccttgattttcaagtttataaaatgagaaaagcctcccttctagagttgtggtaaggattaaatgagataatacatatgaaaagcttaaagaaacatttggcacatagtgaataacacttatataagtagaagctggagaaggagatgctcaatatataattgctgagagagaatgcacgaattaagagaagaaagagttggtcatggaaggttctgtgggtgaagaattttttctttttactaattacttcattaaaaaatttactttctagttagacagatggtgaaaaaaattgtacctgatttcagcagaactcggtgtgtacctataatcccagcttcttgggaggctgaggcaggaggacagctgagtccaggagtttaagacaagcctgggcaacagcaacaaaaaattactgattgcctattttgtgctaggcattgtgctagtactaggtggctctgattttaatagatggtaaaaagtgagtaggcagtcttgaggacaggaggaagaatttgagtcaagattcagcccaagagaatagaagatgggttagaagagtgttggctgctggccgggcgcggtggctcaagcctgtaatcccagcactttgggagtccgaggcgggcggatcacgaggtcaggagttcgagaccagcctggccaacatagtgaaaccccgtctctactaaaaatacaaaaattagccaggcgtggtggcacgcgcctgtagtcccagctactcgggaggctgaggcaggagaattgcttcaaccggggaggcagaggttgtggtgagccgagatcatgccactgcactccagcctaggtgtcacagtgagcctccatctccaaaaaaaaaaaagtggtgggtgctaagattagacaggtaaagaagggacccaggtggtgggtcctagggcaaggaagttataatttggtcctgtgtatagactggtaagccttctgaggctaaatatgtctcagaagattaatgatatctgggcttccatttctgttgcagaattctggggagacattgccaaggaattttactggaagactccatgccctggcccattccttcggtacaactttgatgtgactaaagggaaaatcttnattgagtggatgaaaggagcaactaccaacatctgctacaatgtactggatcgaaatgtccatgagaaaaagcttggagataaagttgctttttactggtaaaaatatctatcttatacttggtggcagataaaaacactcatttgatacttacaacaacccagtagagtaagcaaagtgtcatcaacttaatgcctcaggtgaggaaaaatacctcaaggaagctacatgacttccttcagatcacataactagtatgtgacagagctgacattcaaagccaagtgtcctgacttctagtctagtgttcttggctttgtagttgaagagggagaaagggcattggcaaatggaagagaacaagactgagtagctttcttcctcattcttgctttggaagacaaatagtattgggtttttcaccaccactactaccactaccattatcattatcttttacagagctgtgtgccagaaactatgcttaagtgcttaacaaatactatctcctttgatgcttataataattatgaaagcactatttgttttcctcattttacataggtgaaaactgaaattctgagaagtcaagtgacatatctgaagtgaaacaactagctagaagcaaggctgagattcaaacctaggcagtataattacagagcttacacacaaccatgacactctattattcctctaattccttaccttggcctctcaacaggtttgtaaaataggaattcttagtttcattttataggtgaacaaatgaagcattgaagggttatgtagtgaataaggtcatagagtgaataagtggtagagccaggattcaaattcaagtctgcctgactccttgcttgtaccactaggccatgcagcctccccagcaggaaatttctaagactgcttctcccaggaatttagctgtctaggagatactactataccgaatccaaataggacttagaaattccaataattggggtgttgcttctgccacaatctatgagcactcagagttgatctattgtttttgtattgttttgttttgttttgtttttttggagacaggatcttgctctgttgcccagcctggagagcagcggcatgatcttggcttactgcaacctctgccctgcctcccctgctcaagcaatcctgccacctcagcctcctgagtaggtgggactacagacatgcaccaccacgtttggctaatttttgtattttgtatttagtattttttgtaatgatggggtttcaccatgttgcccaggctgttctcaaactcctgaactcaagcgatccacctgtcttggcctcccaaagtgctgggattagtgtgagccaccatgtctggcctgattaattatttaagctagccaataggagcagcttggatgcttcatgggagagttaaattgaaactcactcaatatctttgcccagtttgtgtgatatattgagaagagccttaacctgagagacaagaaatttaggttctcctttcaactctgccattaacatgttatataaccacagacaaggcatttaactaagagtcagtttcctcttccataaaatggggataataattctatccttgtttttctctctagattgttgtaagaatcaaatgagataacgttgtaaaagcacttatttgtttattggaaaacactgtataggtgtgagtggtctattattatactaccattgcttagttgggggccagtttgtcactgaaattcactgtccattgtgtctgttgagactctctttagcttctgctctagagctttatgcttgagctccagccaacacttgggctcatttcccaggctctttaaagatcagaaaacctttaaagatcttcaaaggaggccgggcatggtggctcatgcctgtaatcccagcactttgggaggctgaggcaagagggttgcttgagcttaggagtttgagaccagcctgggcaacacagtgagacccccatctctatttcacaaaaaagaaagaaataggctgggcatggtgcctcatgcctgtaatcccagcactttgggagaccaaggcaggtggattgcttgagctcaagagttcgagaccagcctgggcaacatggcaaaactccctctctacataaaagacaaaaattagctgggcatggtggtgcacgcctgtagtcccacctacttgaaaggctgtggtgggaggattgcttgagcccaggaggcggaggttgcagtgagcacagatcacaccactgtactccagcctgggcaacagagcaagaccctgtctcaaaaagtaatagtaataaaaataaaataagaaaaataaaaagaggaaaaaaaagatcataaaaggaaatgcttgtatctgaatttgttccctggtttgaaagaactcaggtgcctaatggaaaacagaatacacaggccagagttttcaatcactggagagttttccagaatcctgaggccctttctttctagagacaccagttcccctaccacccttacctgaacaggctctggagagcctctctttccccatctgtaaaatgagaggagtagactagatcagcattttccaaagaatgcttcaggaactgctaattactggagatattagtagggggcttcttaattcataaaatgattgagtctgagaaacactacataataaattgcctttgtgtgagattcccaatgtgtattagcatagtaaaatctccaagatgtcctatattagagatacctgattaattttgtttaacataggatttcctgaatttattgaagccccaaacactttttgccagcatgctattgatatcacaagaagcagtattccatggaacacccactggggaagcactggattaaataatctctaaatttacttccagtgcaaaattctgtaactcaaaaacaagacatcctcactccatttttacattggtcactccctcaacaagaattgttaaagatattggatactcagggctgcattaggcattatggatatgggggtaaaaaggcaggagacaagtaccatataggcaattactatttaattattttatgtttatagtaaagcaaaagcaaaatacaaataaattgcattttattataagaaagtaaagtgcaaatatgccggatatgtggttacatccctttgttgcctctatatttttaaatgatatgcttatactgctatttttcatcatttttaaagaaagtattgatttcttactacgatagataagaatttagttcttatatacctctctaacttccttctctcttcttctcaatataattatagctgttttctagttaatttaaaatcagtttacataagaatagcatactgtggttatatttccttttatgtacggatttttatttactctgaagttaataattgcttactgggctgggtgcagtggcttatacctgtaatcccaacactttgggaagcagaggcgggcagatcacctgaggtcaggagttctagacaagcctggccaaaatagtgaaacctcatctctactaaaaatacaaaaaaaaaattagctgggcatggtagtgcacacctgcagtcccagctacttgggaggctgaggcagaagaatcgcgtgaacctgggaggcagaggttgcagtgagccaagatcacaccactgccctccagcctgggtgacagagcaagactctgtctcaaaaaacaataaaagtaataataataattgcttacygtttttctttttgtactatttaagcctttatcatatatttaatattttccaatctcactatcatatgaaatcctccttttcctcccaaagttctccctcttggagctcacttctttctgttctaattcttactaatgcttttaaaaatgacatcttttctgtgattcgctccaattgatatacttcttatagaaacacattatggctttcttcttaactttatgtcatttagacagctatggtggcattaacaagccacatttgtagctagtttcttgttttggaacatacattgtgtagtcattgaaattatccacaaaggaaatggtgctcttaggaaagtactcccattatccaaaatagaaccatattaaggaataatttggccttttacttttggcttgacacattgcaaatgttcacggaatagtagtatttttagaacttgaagtgaccgttagagtccatctaggccaactctcttcaaagattggtagattaagggacaaagaagctaagtgatttgcctaagggtcatacacctgtttgaagacagaactgagactaatctccagatactctcactcctagtcaactattttttttcactcrtgacactacctcattattctagtagtccagcacttggctgtgacagataaaaagagaaattagccacattagccaaactgatttaaattaactttaaaataccagataaaatgtgttattaggtttaaatgtcccagaccctagtctcatggaatttacattctatttggaaagaccaaatagattggccgggcacaatggctcatgcctgtaatcccagcactttgggaagccaaggcaggtggatcacctgaggtcaggagttcgagaccagcctggccaacatggtgaaaccctgtctctactaaaaaatacaaaaatcagctggatgtggtggcaggtgcctgtaattgcagctacttgggaggctgaggcaggagaatggcttgaacccaggaggcagaggttgtagtgagccgagatcgtgccattgcactccaccctgggcgacaagagcgaaactccatctcaaaaacaaaataaaacaaaacaaatagatctacataaaaacagcctgggccaggcatagtggctcacgcctgtaatcccaacactttgggaggctgaggcgggcggatcaccttaggtcaggagttcaagatcagcctggccaacaagacgaaaccccatctctactaaaaatacaaaaatagccaggtgtggtggcgcactcctgtaatcccagctacttgggaggctgagacaggagaattgcttgaacccaggagacagaggttgcagtgagccgagatcaagccaatgtactccagcctgggcaacagagcaagactccatcaaaaaaaaaaaaaaaaaaaaaagcctgaaaagaattatgggccaaactgcaaagagctacttacacaaatagttcacagaaaggaaaaagccttatagggaggcaggataatataaagattaggagaatgggtgttttggtgtcagactaacccagtttgagtcctatttttgccactaattagctgtctgatcttgggcaagttacttaacctctttgagcctcagttttctcaactgttaaacgtggataaaaatagcttttatctcatggagttgtcagttttgtaagattgaataggataaaaaaaaacatgtcaaattcctggcacattgaatgcacttaaatattagccaccacaattatttatattggaacagtgagaagaccaagcatgtttagagtaaaaggtttatgcagggaacaatttattcattcaataaatgcttactaagaacttattaagtgccaggcactattctaaacaaagttcttgccctcatggaggttatagtccagcttgaggagacagacaataaacatagaaaccagtaagtatatgacaggtagtgatgagtactatagaaaaatatagagcagagtsaggggaaagggaagtgacagtgcagagtgggagctgataaggaaagaaccttttgataaatatgacatttgagcagagatctgaaggaaagtatggagtgtgccacgcagatagttggggtagggaggggaaatgttccaggtaggtggagaacaaatgtgctgctgcctggtgtgtttgaagactagctaggaagttagtgtagctaaaatgtgtgagctagggaagagagagtagtattgacaccagcaggatattagatcatgtcacatcttgaaagccaatgtagactctggccttttattcatggtaaaatgggaaaccactagacaatctttttttttttttttttgagacagagtctcgctctgttgcccaggctggaatgcagtggtacgatctcggctcactgcacccgccatcatgcctggctaatttttatatttttgtattttattttatttttttttgagatggagtctcgctctgttgcccaggctggagtgcagtggcacaatcttcgctcactgcaagctctgcctcctgggttcacaccattctcctgcctcagcttcccgagcagctggtactacaggcgcccgccaccatgcccggctaattttttgtatttttagtagagatggggtttcaccattttagccaggatggtctctatctcttgacctcgtgatccactctcctcggcctcccaaagtgctgggattacaggcgtgtgccactgcgcctggccaatttttgtatttttagtagagacaggttttcaccatgttggccaggctggtctcaaactcctgaccttgtgacccgcccgcctcggcctcccaaagtgctgggattacaggtgtgagccaccatgcccacccacaccactagacaatcttaagcacagacgtgataatgatttggcttctatttaggctctatcttttatattaagaagagactgtagaaggggaaaagtagaagcagggtaaccaattaggaggctattgtagaaatccaggtgatagattgtggtgatttagaccatagtagtagtcatgaagatggttagatgtggtcaaattctggatctattttgaatgaagaacctatggaatttgctgacttggattgggtctggggagtgaaagaggagttacggttgtcatcaacagcggatgaggtccaggtatgggagatcttgactatttttggagatctgtgaaaggattgcatgcagcggaagtcgcagcagaggttaagaggattcatctggatacatatggaaatgggaatgtgaagccagagaactgagagtttgttattcagtcctgaactaggatgctgctggtgggaatggaatggaacaatgacattttagagtgatttgataattttacagtaatttaatctgtataaagggcttagtgcttggcagaaagtgtattagctatttttttcattatggaaagaaaccagcacaggtaactaggtgtgtagatggtggagagacagggagaaagtgaaaggaaagagtcaaggattctcctagtctatataaacactgcctcttttgaaggcacacgttcatctgctccaagggctaaattttccctgcaaaatacagactttggttccaactttctcatgctgtcttccccctggtgtggcagataaatatgttagtgggggtgcatgtgtatatgtatgggaaaatgatcagtgacaaggtattgggatagtcattcagggagagagagtcagtgagggtgttagaggtagctgaaggagtggaagggagttagctagttgaaggaacactggaggactgtcggggatttgggggattaagtaaaaggtttataaggagagggtggaaagagtggttgatggctgatattctgatcatttatactagctactcagtctctactttttctagaagtccccagtaaccaaagcccaacacatttggtatcgttgattccttccattgtttgctttgctttgggttgcctaaggctgtggttatctctgagccacctaaattctcaccctcagctgaaatcactactgtctcttcatggctctcagtatatttcaatccttcttcaggaactggagcttttgagaataaggcaactttaggattgaccctaggacagaagctctgctctcaggatccttgtatgctcctgaatatgaattccatagtatgatatttggagctccccagatccttgtaggcatatgtgtgtgtgtgtatttgaggccaaaaaaaaaaaaaaaaagtccctacctccccatgtcactgaagtgaactccagaatatggacctagataatttagagtccctggacatgaatgataggacaatatactctagggctctgattttccatatcaccttgacaaatctccttgacaaaacatgggcttgcctcaccttctcaaccatccccaccttctcaaatacacacactacatctatatctttactagtttcacaacagcatatctattgattaagatatatttggtaaagaaaaacactcattttgagaaagatgacttcagaccattctcttcctctctctgggccttctctttgtgggcatgatgggaaatgaactacagatactctgcaaggtccctttcatctctaatcttccagaattctatgactgtttctgaagagaggaagcagtttttagaagttctgttgcaacctgtagtgactctgtggtgactcagtaggcgggttgaatttctgttgagatggtaagaaagagggaggattttgtttatttatttatttatttaatttattttctataatgatgttgacaccataaagcaagaattttagaaggtttggaatgaaggggctgaggaaggagtctgttcctcttgcctgagggttgtttgtggctggtagcataaatactcaaagctaatgggagatacawgggaaatacctgttgttgggaacagtctttctccacttgaatsaggtgagcagattgtggaggtgagctggaggatttcatgtttaaggtggatttctaacctgcttctctcatttctccctgagttttatgacccttgacactttacagaacacctccctaaagtggtgaaaatgagacaagtaggctgtactttccgagtcactttttttggaagtaggtggcatatgaataataaatgtattgctctgaagactctgtcttgaggcctgtttcagtgtcctgagcttcatatcagctacctgagtttgtgtctgggccaacttcttatactggcatgttcagtaaacatttaatgaaaagaatggctttagttaatgcccttttctaagccttctttttcccacttataaactgttagggatgtacaagactcttttttaagttacttctggcactgaccttcagaatttctgtcacaaatgcagggaactgcctggataaattctctacatttctgggagaagttaggggagaggaggaactggcctcctctcctttgaagatactaggtggtcagatgggagcaggggttcttgccttatggcagccccacatttataacaattaactcagaaggcgtggagttgaggatgggccttcccccacttcctggatttggtttgggagaggttgggcactggtaatgatccccggtgtctcacatcttgaacctctgagaattcaagactctcagtttcagtccttagaggtcatttggtccaattcccacacaaatcaggaattgtagtaccaatatcccaatccctaacaatccccataagttatcattctgattctgggtcattctcattcaattcctacatctctaccttaatacttactagttgggcaagttacctcacctctttaaacctcaattttcatgtctgtaaaatggaaataataagtcctgtgacatagattgttgtaaggaagaattggaataatctatataaagggcttagtgcttggcaaaaagtgtattagctatttttattattatgccaaaaccctatacctaaaacaggtaacagcggtgctgatctggttggagcatggatgggaggcctagagccacattctgtaggcttctccaccctgttactgtgttccctgtgaggtgtgtgtctggaatccctagggatttgcaaagctcagtttgaaaacccctgatctagtccagtgttcttgttttataaatgaagtgatactgagtccacagtctcaggttcctcatatgatgtggcttcctaaacaaccatgtcggtctcccctggatatactttagttggccaatatctctcattaagtattccagctatggtctgacttgaacagggtactattaccattctttcactttacatatctaagattatattagcctcattgacagccacactctccastcagtttataatctctcataatacttaagattttccttttctttctctctttctctctccttttcctttttcctctttctcctttcatttccttccctttccttcccttgtttgtctcactctgttgctcaggctggagtgcagtggtgcagttgtggcccactgtagcctcaaactccaaggtccaagtgatcctcccacctcagcctcctgagtagctaggagcacagtcatgcaccaacacaatcagcgaattttatttttatttttattttgagacagaattttgctcttgttgcccaggctggagtgcaatggtgtgatcttggctcgctgtaacctctgcctcctgggttcaagcaattctcctgcttcagcctcctgagtagctgggattacaggcacacaccaccatgcccagctaatttttttttttttttttttgkatttttagtggagacgtggttttgccatgttggccaggctggtctcaacttcctgacctcaggtgagcttcctgcctcagcctcccaaagtgctgggatcacagacgtgagccgttgtgcctggccagcttggaattttgaattagagaaggtacaagagaagactgcaaaatctcagatataggagggccttggactacctattatctctttttgggatataaagtttttagaacagccctcttctagggttctaaggtctggtctacttatggttttactatcatggtttattatcatggttaccttatggttttaccatcttggagcatcattattttatttaaataaaataaatacaaccctgaaactattcaccctggaatactttacacacagagttgcccgtacagaaaacatctctagagcatatgaacacctgcatttctaagtgtgatttttttgaccagagactaatttttgaaaccaacgtttgcttctttttgaccatgatattttaatacatgaaaatctatccaaaggagcagtcacagagggttcttgttgaactttagtttctgagctgcttttgaggatggttacttgaggtgtcctccaaactgccacatatagtgagttagagaatctgccaggcacagtggctcatgcctgtaatyccagaactttgggagactgaggagggaggatcactgaactcaggagtttgagatcagcctgggcaacacaggtagaccccatctctataaaaaattttaaaattaggccaggcgtggtggctcacacctgtaatcccagctactcgggtggctgaggcaggaaaatcgattgaacctgggaggcagaggttgaagtgagccaagatcatgccactgcactccggcctgggtgacagagtgagactctgtctcaaaaaataataataataaataaaaaattagctgggtatggtcatgcatgcctgtggtcccagatatttgggaggctgaggtgggaggatttcttgagcctgggaggttgaggctgcagtgagcggtgatcgtgctactgcactccagcctgggtgagaccctgtctcaaaaaagaagttagggagtcctaatacaacatctggatttgttaaaaatctgtctagttgttttcatatgatgggaaacaaactgacagaaatctaattttatttatatggatagccatgctgtacttgctaagaccacaagaataggctcagagagaggggaaagtttgtgtaaattatacattgaattaggggtaaacaatctagtctgatgactccatattcagagccagggtttcccaattttagtttatgtaaataattacctgaggatgtcgttagaaatccagatttctggaccctatcccagactattgagttagaatctccagaggataagacctctgacttgtatttttgtaacctcctcagacaattctgatgttggggggagggacaaagtaccattgaaaaattatttagattaataaccttaaactcttaaaattatatacctaaaagaattttgaaaaattatgtaactcttgacataatgttcatatctaaaaattttatcataagatttaaaaattgcaaaaaatcgaatttccaaaacattttacatattatatacacacatatatatatatgcacatataggttatacctctttcaaaacattggcactgcaaatttagctcatataatttatagaagacatctaccatacaacctgttttgcatagccagttatcacccaacataatcagccaaatcagatctactktgttagaaattgcctaacttctttcttaagataaatatgttaatatatgactctgtgataactgtttcacttctgagttgtaattctaagagatataaggcaagtagtcttgccatgagtttgttacgtggatgaattaagatgccaattctttcaatactgatttctcagagaagctctcattgatttgctttcttggggctctccctcagaagttatacattctcaaattgtccctttgtttaacactttgttcataccctgtcattgtaccataataaagtttgagataagagagagctatgacattcttgtttaacgtgggagaagggtaattgtaaaagagagtgagaaagaagaaccaactcagacagatcattgttaggaaatattacatatggaagttgaggatctagacatttattctcttcatatttttctgtgcaggtactcacaggaatagagtaccgtagattgaggactaatgatttaaactgcctttgacctagataatagagaaccattgtaatgaatatttttgcatgtgtctattatacttgagagacttgatgtacacataaaatgatgcccctggattttctttccactttctgtttctgctctaggcatattcctcttttgggctgcattccaaatgctctgccctcattcacttgttataggtaaggccagcatgggacacaggatggtaggaacaagtgtgtgattcccctcctgtaagtaggcatgtaggcagtgagaaaagagaagaggtacacaatccatcgggcaccaaagccactttggccaaggggaacatgcaaaaggtatttggatcaaggcctgaaaatagctggcaagaggacagggtacaataatagcccagactgcagggcaggagtcccatactctgaacctcagctccagggttctcttccagcctcttcacagagtcccagactgagcccactgtaggatctcaagaaacacttcttgacatgattccaaaatccattccacaaattccactcttgtctttcctctgcctgtccagcatctatcttgtttatctgtatcctatcttatcccctctccttccatactttctctctttgatcatcttggatccagctggtcatataagcagagataagtttgttcatttatttattcattcttttatctattcattttacaattatgtattaagtgctcactgtgtattggcctttgtggtaagcactaaggagaaaacatataaaaagatatcctgtctgccattaaggaactcataatccagtgagggaaacagatgtctacataggactctagtgctagaaaaaaataagtgcccaagtkttgtctttagaaataaacaggctgggcgtggtggctcacgcctgcaatcctagcactttgggaggccaaggcgggcggatcacttgaggtcaagagcctggccaacatggtgaaaccctgtctctactaaaaatataaaaattagcctgtggtggcgggggcctgtagtcccagctactcgggaggctgagacataagaattgcttgaacccgggaggcggaggttgcagtgagccgagatagcaccactgcactccagcctgggcaacagagctagactgtctcaaaaaaaggaaaaaaaaaaatagaaagaggcaagaatgaatgaatgaatagtgcttaatctttctaatgaatgaatagttacaacctttctggaaaggaaggtttgtaaagatgtctgtattttccaaattaatctgtacatttattgcaattccaatcaaaattgcaattatattttttattgagatataatttataccatataattcacccatttaaagtatacaattcatatttttaatatatttgcaaaggtgtacaactttcaattttagaaaattttcatcacccccaaaagaagtgcaatactcattagcagtcatttttcattttcccccaacttcttcncctccagctctaggcaaccactaatctactttctgtctctaaggctctgccttattctggatgtttcatataaatggaatcatataacacgtggccctttgtgtctggtttctttcactaagcataatgttttcaaggttcatccatgttataggccggatgcagtggctcatgtctgtaatcccagcactttgggaggctgaggtgggtggatcacctgaggttggtggatcacctgagcttggcagtttgagaccagcctggccaacatggtgaaaccccatctctactaaaaatataaaaattagccggccatggtggtgcatgcttgtaattccaggtacttgggaggctgaggcaggagaattgcttgaacccaggagacggaggttgcagtgagccaagatcatgccaccacactccagcctgggcaacaaagtgagactgtcttaaaaaaaaaaaagttcatccatgttataccatatatcagtacttcatccttttacattgctgaataatgttgcattgtataactgtatcacattgtgtccggaattggtgggttcttggtctcactgacttcaagaatgaagccgtggaccctcacggtgagtgttacagctcttaaggtggcacgtctggagtttgttccttctgatgttcggatgtgttcggagtttcttccttctggtgggtttgtggtctcgctggctcaggagtgaacctgcagaccttcacagtgagtgttacagctcataaargcagtgtggacccaaagagtgagcagcagcaagatttattgcaaagagcaaaagaacaaagcttccacagtgtggaaggggacctgagcgggttaccactgctggctsrggcagcctgcttttattctcttatctggccccacccacatcctgctgattggtagagccaagtggtctgttttgacagggtgccgattggtgcgtttacaatccctgagctagacacaaaggttctccacatctccaccagattagctagatacagagtgccaacacaaaggttctccaagtccccaccagagtagctagatacagagtgtcaattggtgcattcacaaaccctgagctagacacagggtgctgattggtgtgttcacaaaccttgagctagatacagagtgccgattggtgtatttacaatccctgagctagacataaaggttctccaaggccccaccagagtagctagatacagagtgtccattggtgcattcacaaaccctgagctagacagagggtgcagattggtgtatttacaatcccttagctagacttagaggttctccacttccccaccagactcaggagcccagctggcttcacccagtggatcccgcactggggctgcaggtggagctgcctgccagtcctgcgccrtgtgcctgcactcctcagcccttgggtggccgatgggactgggtgccgtgagcagggggcggtgctcgtcgggggggctcgggccgcacaggagcccacggtgggggtgggggaggctcaggcatggcgggctgcaggtcccgagccctgccccgcgggaaggcagctaaggcctggcgagaaatggagcgcagtgctggtgggctggcactgctggggtacccagtacaccctccgcagctgctggcccgggtgctaagcccctcattgcccggggccggcagggccggccggctgctccgagtgcggggcctgccaagcccacgcccactcggaactccagctggcccgcaagctccgtgcgcagccccggttcccgctcgggcctctccctccgcacctccctgcaagctgagggagccagctccggccttggccagcccagaaaggggctcccacagtgcagcggtgggctgaagggctcctcaagtgccgccaaagtgggagcccaggcagaggaggcgccgagagcgagcaagggctgtgaggactgccagcacgctgtcacctctcaacgttatcacatttttttctttctttctttctttccttctttctttctttctttctttctctttcyttccttccttccttccttccttccttccttccttccttcctttctctttcttttctttcttttttgtttttttttgagatggagtcttgctcttgtcgcccaggctggagtgcaatggcatgatctcggctcactgcaacctccgcctcccgggttcaagcgattctcccacctcagcctcccgagcagctgaggtacaggcactggccaccacgcccggctaatttttgtatttttagtagagacggggtttcaccatgttggccaggctggtcttgaacacctgaccttgtgatccacccgccccagcctcccaaagtgctgggattacaggcatgagtcaccacacctggccccacatttttctttattcattcctcaattggtggacatttgggttgtttacactttctgatgtcatgaataacgctactacaaacctttgggtacatgtttttgtgtagatgtatgttttcaattctcttgggtatatagctaggagtttaattgctgagtcatatggtaagtctatatttaacctattgaggaactgccagactgttttccaaagtagctgaaccattttatattcccggcaatgtatgaggtttccaatttctgcacatgcttgtcagcacttgttactgtctgtttgtttgattatggccatcttagtgagtgtgaagtgggatctgattgttattttgatttgtatctccttgaccatgcctgaccttttttttttttttttttttttgagactgagtctcgctctgtcrcccaggctggagtgcagtggcacaattttggctgattacgacctctgcctcccaggttcaagagattctcatgtgcagcctcccaagtagctgcgactacaggtgcgtgccaccatgcccggctaaatttttttttttttttttagtagagatggggtttggccatgttggccaggctggtgtcgaacttctgacctcaggtgatcctcccaccttggcctcccaaaatgttgggattacaggcatgtgctactgcacctggcccattaactgccttttgaagactggccggtacagtcctggctccctcaataggtgaggaatcaatgtttagggagaaatttcataaatagtccactgattgaggctatttactctagtttcatcagttttgagttggtgaaaagcccgtccaaatttgggtgataggatgacagttgattccagtttttgaatcaggagctgagtgaggctgcattagggtctacaagttagatatcatttgaaaccagaaatctgtggtgttttcaaaaggaactttttctaaggaactaagggaaaaccaaacagaatgatgaatttctgttaagtacactaaaattccatccttggtagttgtcaacctcacagttctcagagttcctacatttttatttttttccttatgctaattctgaatttggaaacaataccccccttttggaggccatgtcatttaggaggagaaggccctgaactagacatttagactcaagaaytgtgctatccaacatggaagccactagctacatgtaactattgatatttatagtaattaaaattaagtaaaataaataatccagttcttccgccacatttctagtgtttgatagctatatgtggctagtgactaccattttggacaacagtgctttagaatagtgttgctactaatttgtaagtaaccttgaggtcatcactttctatttctgtgccataggtttctcaatggtaaataagagtggtgagtctcaaaagtaccatcctcttctggaattctttctttttctcttttcttttctttctttttttgacaggatcttgctttgttgtccagtctagtctctaactcctagcttcaagtgatcctcccacctcggcccctaaagtgttgggattacaggcatgagccaccatatctggccctcctctggcattctgagtaatctgtggttcagtttttggggtgtgcctccatctacctcctccttcagcccttcttgatacttactgcagctagggcagaagcacccagagggaacattaggctgctaattagtcaaggtacattgctcccattccctggtgaaagggaaattgacttgtgggtatacttatatcttgagtgctccacaattgtgcagtgctttatggatcacagaactctttcacattgttttttcattttatagaatcaaagaatctcaaagttggaagggctgtaaaggtcatctcaaacttcaataaccatgaattatatggggagcttatgcaatgaaaatttcaaggccccactccctggagaataatctagtagaagtaggtgtcagggttaccctggcccaacctgaacaatcctgtgctgcatgggaacttggtactgcattattaacactatctgaccactctttgagaaacactggtcttgcttggtccccagccatattgtggaggctgctctttggtatcgctacaaatcccagattcaacatgatatctccagggtcaggaaactcctgaaggagtgccttccatctttggacatctctaacagaaaggttttttttttaatatggagctctcccaattgatgtagattttccatttatagttatactacattagtctacttttccccataatgatcctttagattcatgcattcattcagcaaaaatttactgaacacctattatatacaaggttctgtacgagacaatgagggattcagcagtgaacaagaccaacttggcctctgccttcagaaactgtcttctgtctagtagggaagataggaaattagcaaaaataataataagtaaacaagtaatattaattctattaataatattaacaataacaataagtaaacaaataacaaaagaagtatagtttgagaaaaatgctgtgaagaaaataagcagtgttatgatgaataacaagaagagctgatctacttagggtggtcagggaaagcttcactaggaagtgacatttaagctgagatttgaaacacaagaagagttggggaaagatagttaaagaatatggcatgttctatcagtcagaaggccagcatgtttggagcctagtaggcagaataggagaatggcacaagatgaagttggggaggatacaaggcatagcaggagtgcggattttcttctatatgcagtggaagctgttaaagggttttaagcaggaggtgatatgatctgatttgtggtttgttttattgttgtttaattaattaattaattaattaattaattttgagacaaggtctggctctattgccctggctggagtgcagtggcaacatctcagctcactgtaatctccacctcctgggctcaagtgatcctcccacctcagcctcctgagtagctgaaactataggcatgtgccaccacacctggctatttttttttttttttttttttagtagagagagcatttcgctatgttgcccagtctggtctcgaactcttgggctcaagcaatcctcccaccttggcttcccaaaatgctgggattacaggcatgagccaccatgcctggccaatttatgtttttaatagatcattctgtggccgggtgcagtggctcatgcttgtaatcccagcactttgggagccaaggcaggcaaatcacttgaggtcaggagttcgagaccagactggctaacatggtaaaacttcatctctactaaaaatacaaaaattagccaggcatggtggcatgcacctgtggtcccagctacttgggaggctgaggcaggagaatcatttgaacccggcaggcagaggttgcagtaagtcaagatcacaccactgcattccagcctgggtgacagactgagactctctcaaaaaaaaaaaaaaaaaagatcacagatcatgctgggtgatgtgtggactggaagggaacaagagtgaagtgggaaaccagttaggtgggcattgtggtcatccaggcaagagatgaaggtagcttgaccggggtggagacaatgaagatacagatttttgagacttgctatcacatctctcaatatcttctcttccacaaaataaacagttcagtgttcctctcatctcctctcataacaggtttggtgtctcttctcacctgggtgtttctcctcctgtttctcctccatctgattcctctgtaaagaactcagtctttccctcagctgtttcttcctatcctgtgccttgcttgtagttctagggaattaaaatcttcaattcaatgactatcgttctcatataaagaggggagctgggtgcagtggtgcatgcctgtagtcccaactactctggaggctgaggtgggagaatcatttgagcccgagagtttaagaccagcctgggcaacatagtgagacattgtctcaaaaaaaaaaaaaaaaaaaaaagttgkggggtagcaccagtcttccctgtcattagtcaattaccagtctttcaattattcaaccatgaccctcgaatacctattgtgccaattgtgcttggaggagacagagaagaagacatgatctctgccctccaagagctcagggtataatgggaaagataaggcccaaataaatataataaaagctagaaaaacagatcacaaagaaagtgagataaagggctttgggaggaagaaagaacttttagcttttgggtaggtgagaaaaagagaaactaacaaaaatttcatggaaaatgttaattcagagaacctggggctggagaggagcgcagggagtatttttttttttttaatgtggtgatcaaagataaccttactgagaagccaacatttgagcaacgactcaaagatagggaataagtcatgtggctatctagggaaagaacattccaagtagagggcaaaggctctgaggttaaatgttcttggtgcttttgccaaacactggggaggccgtttggctggagcagagggaaagggagaggaagagagaatagttgtatgtgaggacagagaggaaatgagggactagatcatgtaggccattgtgaggactttgacttttactcaaaatgaaatgggaagtgatctgagcattctgagcagaagggtgacataatctgaactacctaatggtagttttggactaggatggtagaaatagatgtgaagagaggtagtctaattctaaatggattttgaatcaataatgggttaaagtaaatttcgagagtgtgagaatgaagtagttggagaagactcyttggaggaggttccctaggggaagaagatgagaaggactagtgactgtgtaccatgggttgtcacaccaaccatatggcctccaggtgaaggaaaagtagtttggtttataccaagggttccccatgttatcccaccagctaaatttctcattaatagttttgtttgattcacagtgtttaaaccttttttttttttttttttttttggtaggcaggggcgagacagggtctctgttgctaggctagagtatagtagcatcaacgtggctcactgcagccttgacctcccgggcttatgtgatcctcctattttagcctctcgagtagctgggaccataggcattagctaccatgcttggctaattataaaattttttgtagagacaagttctcaccatgttgcccaggccagtcttgaactcctgtcctcaaacagtcctcctgctttgccctcccagagtgctggtattatggcatgaaccactgcaactggccttaaagctttaaaaaaattagtggtcaacacatataaattcagaagttttttttttttttttgagacggagtctcgctcggtcgcccaggctggagtgcagagtgcagtgcagtagtgtgatcttggctcactgcaagctccacctcctgggttcacgccatcctcctgcctcagcctcccgagtagctgggactacaggcgcccgccaccacccccggctaattttttgtatttttagtagagatggggtttcaccgtcctctcgatctcctgacctcatgatccgcccgcctcagcctcccagagtgctgggattacaggcgtgagccaccgtgcctggccaattcaaaagttttgacaaaaatagattccaggctgctattgaaaaatcgaaaaaattgacaacattgagccctgattcctagcaagcaaaagctgacaggaaccaagtttaggtactagatgcctccttttgccagagcatgcatttgccagttttcctgtccttccccttccctattgttcccctgaaactgaggctaaggtttattatacatgtgctgctgttttcttatagggaagtggaaagggaactatttcttatctttatcatatattttctttcatgtggtccacttatttacattccgtgcctagatcctgccaatttttgagcttgcagctcctggtgtagaggaaagaggcctggaccttaagtcgtggtccctgctctgctgtggtaacccaccctgtgatgccaagcatagctaatagcctctttggatctcagagttaagagactaaattggatgttcttttaagagttctgatatcctggccgggcgcggtggctcacrcctgtaatcccagcactttgggaggccgaggcgggtggatcacaaggtcaagagattgagaccatcctggctaacacggtgaaaccccgtctctactaaatatacaaaaaattagctgagcgtggtggcaggcgcctgtggtcccagctactcgggaggctgaggcaggagaatggcgtgaacctaggaagcacagcttgcagtgagccgagactgcggcactgcactccagcctgggtaacagagcaagactccgtctcaaaaaaaaaaaaaaaaaagagttctgatatcctagagggcttgggattttgcagtaggccaataccctgcccctcacctttcccaaccagccaggggccccagcctggtgtgtatgtcagagaaagaagacactggaatgagtaaggtgcttatatcaataatgtataacttgagcccatagccaaggagaggaatgcacactgtggtgtgtgtgtgtgtgtgtgtttcacggttggaagtgggctcaaataagttgtacttgcataggttgtgcttatttcttcttgtgcactctctatgtactaggctgtacttgaggtgctagggatgtagcagtgaagaaaacaaataagatctctgctgtcagctgggtgcagtggctcacgcctgtaatcccagcactttgggaggccgaggcaggcggatcacctgaggtcaggggtgtgagaccagcctggccaacatcttgaaaccccgtctctactaaaaatacaaaaattagccaggtgtgatggtgggtgcctgtaatcccaactacctgggaggctgaggcagggagaattgcttgaaccctggaggcggaggttgcagtgagccgagatcgcactattgcactccagcctgggtgacagagcgagactccatctcaaaaaaaaaaaaaaaaaaaaagatctctgctatcatggagcttatattccagtgaagaaaacagataatatataagtaattaacatacatgagataatttcaaataatggaacgtttcatgaaaaaaataaaacagaatgtgttttttttttttgagacagtcttgccctgtcacccagggtggagtgcaatggcgcaatctcagctcactgcaacctccatctcctgggctcaggtgatcctcccaccacagcctcctgagtagctgggtttacaggcatgcgccaccatgcccggctaatttttgtctttttagtagagttggggcttcgccatgttggccaggccggtctcaaactcctggcctcaagtgatctacccacctcagcctcccaaagtgtgggattacatgtgtggcacctggcaaaacagaatgatttgatagagagtttctgaaggggcacactgtgcacataggtggctacatgtatatggtggttgtacttgcagatacagataagtccatgtttgaatcctgggtgcatatatttatccttgtttgtgcctatgtgtgcagatgggcagcttttatgcctagaatgtttgtatatttatatgtgattttatacaagtgagcgcacataggtgagttggtatgtggtttgcatatggggacacatgtgcttgggtatgtatatgttggcattcagccataaccggagatgttctgaagttcctgtggcacttgtcagtgagccagttaaggaaatggcttttctgcctctggcattcagggccgtttgccagcttcctctctccctgttctttcccactttagtaagctccctgtgtttggcttctctcatccctaggagggttaaagcctactgactcatcgagccaggaactggaaaaaggctgataatcttctgtgtgacctctgttagtaagaaaaggcctggcttccctgccagtccctgtccttcacactatgagggagagtcctgacttgaaatcagaagacctgagcatctattcttggctctgccacttattattgtgtgaccaataatctctctaggtttcagttacctccttcataagtgctctgtgcagtaaggaaggagaggggaagcaatggtctgtggtgctaagggagagccagatggtgctggtgtctgaaggaggagggagaatattctgagcaggggcaatgatgtggccaaaagcgtggaggtggacctgaacttgccaagggaaaccagggatccacttacagtaaaattcaaacttcttactattgcctacaaggctctacgtgatttggctgctgcctacctctcattcttacccaacttcttgctcactgaaatctagccataytgtctttctttctttctttgaaaaggtctcagtgccttttcacttgatgctccttttccccagaatactcttcccaagaattagtatgattgcctacctctcattattcaggtcttggctcaaatatcacctctccagagagaggccttccaggaccatcttatttaaagtagttgttccctaatatttatcaatatttaaaatgcacacatcagccaggcacggtggctcacgcctgtaatcccagtactttgggaggccagggcaggtggatcacctgacgtcaggagttcaagaccaacctgaccaacatggtgaaaccccatctctactaaaatgcaaaaattagccaggtgtggtggtgcacgcctgtaatcccagctactcaggagtctgaggcagaagaattgcctgaacccaggaggcggaggttgcagtgagccaagatcgcgccattttactccagcctgggcaacaggagcaaaactccatcttgggaaaaaaaaaaaaaaaaagcacacatctcttgaaccaacaggtccacttctggtaattcatcctacagatatacttgcaggtgagtaaagtgacataaaaataaaaatattcattgaagcatttatttgttaaataaattacagtacatacaaatagtggaatattttgcagctgagaaagataatgaaatagctctttaagcttggcaccgtggctcacacctgtaatcccaacactttggaaggaaggctgaggcaggaggattggaggatcacttgaggccaggagttccagactagcctgagcaacatagtaggatcctgtctttgcaaaaaaaaaaaaaaaaaaaaaaaggtagccagacatggtgactctggcctgtagtcccaactgctcaagaggcagaggtgggaggatcacttgagtctgggaggttgaggctgtagtgagctgtgatggtgccactgcaccccagcctgagtgacagagtgagaccctgtctcaaaaacaacaacaacaacaaataaaaaagagaaatagttctttaagtcttggtgaagaatgatatcaaggtatattgttaaatttgaaaaatcaagatgatcaatttctacacataagatttgtgcattttattgaatgcatataataattaacaaaagatacagaatagtgtgtattgtatgccatcatttgtgtagaaaaaatgagactatgtaaacaaatgcatgtagtatatatgcttgtctgacagacctgtcccttaagtagagcagttcttcctacccctgttaccctgtgcttgactggggactatgaggtgttcatctcttttctgaacaacattaaaatccttttttttttttttttgagacaaagtcttactctgtttcccaggctggagtgcagtggtgtgatcgccgctcgctgtagccttcaccttctgggttcaaatgatcctcccgccttagcctcccaagtagctgggactacaggcgtgcaccaccatgcccggctaatttttgtatttttagtagagatggggttttgccatgttggccaggctggtctcaaactcctgaccccaggtgatctgcctgccttggcctcccaaagtgctgggaatacaggtgtgagcctctgtgcctggccaaatttttttttttttttttttttaaacagagtttcactcttgtcgcctaggctggagtgcgatggcacggtctcagcttgctgcaacctccatttcccggattcaagcgattctcctgcttcagcctcctgtaaaattcagttttttaacattcaattttcaaattttggtcttcaatgatatctcaagggtcttattaaagatcataatgatacagacttcttgcaaagtaattattttggtcattccacactagttgaattaccctagccctgtgtcctacaaagaatggtcctgtctgaatattgattgtttctggaaagtcacacagaatattggtaactgttttgccctgggcatggtggctcacgcctgtaatcccagcactttgagaggctgaagcagttttgcttgaggccaggagtttggagaccaccctggacaatatatcgagactctgcctctatgaaaaattttaaaataaaaaaattagccaggtgtggtagcatgtgcccgtagtcccagctactcaggaggctgaagtaagaggattgcttgagcccaggagttggaggctgcagtgagctatgattgtgcctctgtactccagcctatcaatagagtgagaccctgtctctaaaaaacaaatcacaaaacccaaactgtggtttgccagtaggcagggtgattgggagataggagtggggagaacacttctcattatgtatctttttatgtagtcccacttgtatgtattacttattcaaaaaaatcataaaattggaaaaaaaccactaagggaaacatttatttatttattttttgagacagggactcactctgttgtccaggctggagttcagtgacatgattacagctcactgcaggcttgacctccagggtacaagcgatcttcctgcctcaacctcctgagtagctgagactacaggtgtgcaccaccatgctcagctaattgaaaacgatttttttttttttagcaatgaggttttgctgtgttgctcagattggtcttgaactcctggtctcaggtgatcctcctgccttggcctcccaaagtgttgggattacaggcatgagccaagagatcttcccatctcatctttctgagtggctgggactataggtgcatgacaccacactcagctaaaattttttttttttttttttgagacagagtttcattcttgttgcccaggctggagtacagtggcrcaatcttggcccactgcaacttccgcctcccagattcaagtgattctcctgcctcagcctcccgagtagctggcattacaagcatgcactaccacacccagctgatttttgtatttttagtagagacggggtttctccatgttggtcaggctggtcttgagctcctgacctcacgtgatccacctgcctcggcctcccaaagtgctgggattacaggtatgagccaccgtgcccagccggatccagctcaatgtttttagagatgcggtcttgctatgttgccaggctggtcttgaactcttggcctcaatagatgggcccactttggcctcctaaagtgttagaattacaggtgtgagccaccgtgcctgacccaagatagtatattttttaaaagtatttctccctagtcactcatttttatatcattctgctctatttataatgcttatcataatctgaaattatcctggttatatttgttatttgtttattacccacactatcattggaatataagctccatgatatcaggtatcttacttatgttgttcattggtgccttatttcttcttttttttgtttgtttgagacggagtcttactctgtcgcccaggctggagtgcagtggcgtgatcttggctcaccacaacctccacctcccttcaagctattctcctgcctcagcctcccaagtagctgggattacaggcgtgtgccaccacacccagctaatttttgtatttttagtagaggcatggtttcaccacattggccaggctggtctcaaactcctgacttcaggtcatctacctgcctcagtctcctagtgtgttgggattacaggaaagagccaccacgccccgcccattggtgccttatttctatacatgtagatagcacatagtagttgttgaataagcaaatgaatgcatgaaggaatgactgaagtaaaccaggctaaagcctaggaaggagtgggaggcaaggctgaggaggtagacagaaatcacctgataaaggatggcgattctcaaactttatttatttattcaagatggaaactcactctgtcatccagactggagtgcagtagtgtgatctcagctcactgcaacctctgcctcctgggttcaagggattctcgtgcctcagcctccccagtagctgggattacaggcacacaccaccamacccagctaatttttgtatttttagtagagacgcggtttcaccatgttggccaggctggtctcaaactcctgacctttgatctgtccaccttggccttccaaagtgctgggattacaggcgtgagccaccgcrcctggccaattctcaagaatcccctactaattccttgtaccatcttgtaataaagaagcagatccttggaccctgtgattctaattcagtatgtttgagctggggcccaggaatctacaaatcctctagatgatttaggcacaagtgatctggagaccctactctgaataatgcagtcttgatgcctcatcagaaggaatcacatctgtgatttcacttctccttaatacattactaggatggaagagaaggggccgtcactccatttcatcaaggatcagagatggacagtgcattttctaatgacatacaacatgtgtataaaatatcttgaatggccaaagtatctgacccgtcagctcaagattggtgatggcaagattgatggtgggcagatagctcatcctcatagaacagttccaggccttagtgtcactgaatggattttatgactctgcctgtttcttgtttggggaagaagttatacccctaatcactggttctttctggtatgtctcagggagggcaatgagccaggggagaccactcagatcacataccatcagcttctggtccaagtgtgtcagttcagcaatgttctccgaaaacagggtgagtgtgggggtgtgggaaaggactgggggtctggccttggggtatctgagtatctgagacttatggggagagggcaagggatggaaagaatttggtaacagaggaagagaacaggtcagctgggagggaggccagctggatgggagggagcaagtagcagcaagaagggttcatggttcatattctgtgcttttacctgcaggcattcagaagggggaccgagtggccatctacatgcctatgatcccagagcttgtggtggccatgctggcatgtgcccgcattggggctttgcactccattgtggtaggagtttgggctggtgaaaaggggcaggcgggggggtggggctctggagaagtaggttgggcctagatgatggagggtcttaaataacaaactaaggagcttagaaggtttgtgtcatagrtccatattagttattcagtttcttctagraccctggcttagagatcctgaaagttccatgagcaacccctttcttcattcactcaatccctggggctttcttctctccctcagactttcttcccttccctagtttgcaggcttctcttcagagtctctatgtgaacggatcttggattccagctgcagtcttctcatcactacaggtgactaattctctcacctcttctccagaaccccccatacctcaagccttggtctccaatcagctcattggtatttggggctactcagcatagagggtagagactgcctgccttttctctcctggtcccacctcagctgaccctctgtcagctcraatcagctggaagagccagagttaagaggcctactcaggaagggccctatggacattgtgcccactaggcagcatggggcttactaaggcctggaatgtctgttgctccccaaagatgccttctacaggggggaaaagcttgtgaacctgaaggagctggctgacgaggccctgcagaagtgtcaggagaagtaagtgtgtttggctactgtctgagttgactgagcctttccccagtgccaggttccctttgtcccctctaccctaaatggacatgggtgggtcttgccaagttccctttgagccaacaaggctaccactttaggcttttctcttctccaggggtttcccagtaagatgctgcattgtggtcaagcacctggggcgggcagagctcggcatgggtgactccaccagccagtcccccccaattaanaggtcatgcccagatgtgcaggtgagtctggcactgctatgcctttctccaggctcaaattccttcacttttcctgcctagaaaattcttgatgtccttctttgcctgctcatcagtatactgaggatccaggagcaattctaggaatgcctcctctagcagggctaggtgggaactggaagactttgaccttgactgtgggtagagaggcccttgtaccttgagaacatagcacaagcgattgtaagggagactcctatgctggttggggtatccttgtgggcacaggggatcctcagggcctaggcttgtgttagaaatgtctaacttgagtgacaatatatagtcatctccattactaggctgtgatgtggggtgggctatctttgtggcctaagggatgcccaccttggaaggaccagagtccagccctcacaatatggcctttgttagctttggacccccaggcttctggtgggaatggtagaaatgcccagtgatggcctccaggctgagcagcatgagggatcaaagttctggggttgagtaagagtctgtgacttgaggctccctgaggggtcttagggctagagaggctgtagtctagtttagggaagttggaaagcccaatcagtgttaggggttttacatatataggggctggaatcaggatcaggaaaatggaagctgggaggaccagtgagaagggagtttggggtttatgacacactgaccctttcctcccactccctgtatacttggaccctcctcactacccttttcatcctgggctcttaacagggtaaactgaaagagaaatccaagcgtgttcagccccaggtatccatttctgcactgccgtgggcaccgcttctctgtttgcttgtctgtgtgctcatctgccctttgcctgtttgccccattgaggtggctgccagacctaacctccttccccttgcccctgggcaacttgacatctaagccactgaagggtggtgaaattaaatgtccgttactgcctctgtgaattggtatagagtatggatcttagagaggtaacagcagaacacattttatcctgatactcaggacctttgtgggagaggggacaaggtaacctgtcagaaaacatttactgtgcaggtagctggagcagagccgagagacaggaggaggaggaggtggaggaggttcagaccctgactttgggaattcactgtcaagttggggagttagacatgtattattaatacaaaggaaaatctaagttttatacaggacagcagaggagattcctaaatacatttatatagtgctttgggatttataaactgcatataactttgtaatatgattaagtgctaaactgaacaaaagtcatattgtaggtggttctaagaagggagatccataagggggtgctcaaagcagattagtatcgaggaaagagtgggcctgaagtccagagaccaatttttagctgtatgaccttgagtaagtcaattctcccctctgggattcagtttccttatcagtaatggagagatgataacacatgttataaaaggaaacagcttcccttcctaaaacaacacataaagctcactattcctctggattttaccatcttcacagggtgtcttactctaaatctgctatgattaacctcttaggccaatggtagatataagccccttttctctattctcattagcatggcggagacagatctgattcctagggcatactgctttccttttaaaactcaggcaggacctacaccctttcttttgaaagaggtgacaaacttagtggcttaaattgtaatctctggagccagattacttgggttcaaatcctggctctgccatctgctgctgtgtaaacttgaacaaattacttaagctctctcgcttgtttctccatctgtaagataaggataataattatacctatgttatcgggttttgtcaatatatgtaaggtgtttggcacatagtaactactcaataaatgttagctgttttttccttccccttaatgcaacagacagattggcatttctaaaacagagaccagaaaagaaataacaaactcttgtaattcttaataccagagaccttcaggccaaaggctactggatttttgtttcttggaggtgaaaataaccagtttccaaaataccaaagagcataaaaataggcttaaaaagtccaggttgttggtctgagaattgcagtcaaagctgcaaaaatctttctgacaatgggccccatatttaaaaattaaaaaatagttttcaaaagagctgcaaaaatcctggcagggctccaaacccctttatccttaaacaatcttccagggagatcctggcagggtttgcagggaccctcctcaaccatatcgtctatgagctccctcatattcctctcccgtacatggcagctgccctccttgagactatcctggtccaaggacaaaggccaactcctcaattcttattttagaaaattcagaccttttcctggtgcagagcctggggcctcataggcacacacctaattcacaatcaaaggttgctttgctaattgagttcactctgcttcctggtgctagttatcagttccacacctggagtactctgacccctccacctctatatacacacccacccacaaaagaaataataagattataagagtgccctcattgcagagccacagttgtaactatgccttgtccttacatgtacttagtgcctgttctgtggcagttcacagtgctgtagaccagcaccatttgtccaaagcagtattgatacttctggttgaataccttagtgcccccatctcaagtgatcatttggcaggaaaaaaagtacccatgtgacaatgtatgtgtagatgcatatggatagaccaaatcaggtgtgttcttatgttttctaaccgtaggcagctttctctctcttcttcctttttctaggcttgtcgtttttatgatgttgataatccagaaatttcaaattctctaccataaggggcaggtggtacagaaagaacggagtggttagagagtcattttctaatttatcaagctatatatctaacactccagaagtttttttaaccaaatatgcacacaacaaattagcatatatccttataatgggagaatggcatttatcttacaccatcatgtctacctgccagccagggccattgaacatacaagaatctaattaatatgaaaggactttgtgacagctaaagcaaaccccaaacagttcctatcatcacactcttaagtttttgtgggttttttttgttgtttttgtttttgtttttgttttttgagatggagtctcactctgtcgctcaggctgaagtacagtggtacgatctcggcttactgcaacttctgcttcctggtttcaagtgattctcctgcctcaccctcccaagtagctgggattacaggtgtctaccaccacgcctggctactttttgtatttttagtagagatgaggtttcaccatgttggccaggctggtcttgaactcactcctcacctcaggtgatctgcccactttggcctcccaaagtgctgggattacaggcgtgagccaccgcgcccagccccacactcttaagtttaactcccagtagtcactgaactaacctctgtctctcctgacattcatcagtcttcctcatcycaccccaacctctacccttggggcaatccaaggcttgatgtttactagataatacttttytcttttggtgtttaccacatcctgtgagtctgttaaggcaagaatgactgtcctcatttgtaaaaggagagacttaaggtaaagtgatttgcccaaggtcatatagctaggaagtggcagaactggtattgaagtacactgaagattttggacaaattcaagggatctaacttcattcagcagatggtagactcaaaattggtgttcaaagaggtgatatagacagaaaagtaaaacagtttcaaaggagaatttagagaagtttcaggatgacagatccagaagtaattatcaaaggcatagggggacatccttctactgggagaagtccaccttggtccttcttcaccaacttgaagcaaagcttcctgctgaatggaacctgtcccctcaagcaaaagtstctatgggaaaccctattggtaccagtggtgtaaaggcaggagcagagctagggtaggaaacmcgcagatgtggattgggtctggacatgtaggcaaaagtgcttggaccaagatctgttgacttattttactactaacagggtcaggtgcccacctcacctgtaagctctgactaattttgcatttctgaattgtgtggtgtccgcatccctgctaatgagcctagtcccataagtacatatgtatgtatgtagacctgtgtgtgcatagtcattcatccaacaaaaattgactgagtgccaggcactttgctaggtgttgggagatatggcaggggtcgggaggaaagacatttcacctccttcatagatgtcgctatctagatggggagacagtaatcaagtagacaactaaacaaaataacaggaaatatgtactgtgtgggaaagaaacatggtgttgtgatcaataataatagcagggttgggggtagcaatctatcagatactgttcaggtaaaggctttccaagaaggtgacatttcagctcagaattgaaggatrggaagggaccagccaagggttcctcctcagcctgaggccaggtgagaggagttctggggtagagatgggggtaggatggcagggtggttggagtactcagtwagcttgggttctgctcctgttctttctgttccattccatccttgaagggccttctctcccttcctgtactcctacctgcctgtcccacctcattccctccaggggcaaggtacgggtgtatcttgtccccatcttgagctgttcacagttcttccctgcccatccctgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaaggcaagtgtgtgtgtgtgtgtgtgtgtgtgtgtgtgtgtgtgtgtgkattatgtaggggtaagaagtaagtttctgaggaaacaagtaatgaaattatttttttcctacaaccctgagttttggaaatgtagcattgtcttttctaaatcaaattaagacataaatcctcaatctataggtggtgaggcccagggtgagacagttcaggtggagggttttcatacagctgacatggatgttctttccctatgcacccatggtttggttgaaggagagctattctgttaactcaaggccaagggtgggcacagagatccctctcaggcttctaagaccataactcttagagttcaattccttccacctggcacactattaacatgtagtcctctgccagcacacaccatgggagccggaaacacttaagaaaactgtttcttccattgacttgaaagctatgtcactctaccttctgcccactccacccctaaattatctccatatgctttggaatatccctcaataagtctttagaaacacaattttggcctctctttcatagagatgggggtagggatggaataagcaaagggaattatcttttttttcccactcactctgatggtgtgtaattgagtgtgtgggcacaaatacacaacagagggactattatgagtgtgctatgagtgctcatgtgtgagtgatgtgggtggctctgaaataccatctgagggtgctggtatgaatgatggcctgatagacatatgtgkcatcaggagtgtgataaaggagatgagatgggagcatggagaaaaggagatggaagggagatggatgctgtgaaaagggtgctggcagggctggaatccctgaggaggatcttcctccagctctgcccagcctccatttggtggtcagtaggggtgggcataagaccctaacctgttccccattcttcccacagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttggtgagaagggagccacctggcctagctgggggatggacaagattatcctgggtgactacctcccaaggctgcttgntctagagggagggggacttatacaatcatctgttttctggagaaasagaagtcctgagggggttgcgtatcctgactaggatggtatcttggcttgtctggccagggagtgaagatatggttggtcagaaagggcaaaatactgaacctgagggaatggtagggggatgaatagaaggactattaggaaagactgggaatgaccagccttcatgggtcagtttgaggggattcccacrtatccggacgtgaaccgcctgtggagcattgtggacaaatacaaggtgaccaagttctacacagcacccacagccatccgtctgctcatgaagtttggagatgagcctgtcaccaagtgagacctcttcccagttgctgccctgtgggtatccctcagagctgggtgctggcctttgtacagtctcttcttttccattgtcccaactctctgacctggaatagaggatggggcaagagaaaagcctgggtatgtgtgtcttccagtagtactcagagccttcctctctcccattcccctgccccaggcatagccgggcatccttgcaggtgttaggcacagtgggtgaacccatcaaccctgaggcctggctatggtaccaccgggtggtaggtgcccagcgctgccccatcgtggacaccttctggcaaacagagacagtgagtgaarggtacagaaggctggggcccagggacaatgtgggaagattgactcaaatttctcatctctgacttccccagggtggccacatgttgactccccttcctggtgccacacccatgaaacccggttctgctgtgagtgatgcttccctggctggtcttgggctaggcagggatggtgtcttggggcacttggcctagttagatagtggagaactggactgacatgtgtgaagaatttggggttctggggcyccttgggagttgagtcagagttgcctcattcctcttcttgggttctgtctcccgtttgcttctagactttcccattctttggtgtagctcctgcaatcctgaatgagtccggggaagagttggaaggtgaagctgaaggttatctggtgaggccctggcccttgggagtctttaaggagagagggaaagggtctgccaagggtactttgctttagagttaataacctaatctctcctggtagctgcttaggactgaaacttcatggttggaggtttgctcactgagagaccctggaggggaccctcgatactttgcctgcatctcttccttttgggccataagtctcctaagggcgttttaagagttgctcagattcctgatggtacctttttgggtctggaagactaagtcccatcttcttttgacaaagattctacagaaaggaggctttataacatagtagaaaatcacgtaggatctggagtcaccctgcctgggttcgaatcctagctctgcctcttctgtgacctcagataagttatttaacacctctgaatctacattttctaatttgtaaaatagggttaaagtggtgnctctggccgggcacggtggctcacacctgtaatcctagcactttgggaggctgaggtgggcggatcacctgaggccaggagtgcaagaccagcctggccaacatggtgaaaccccgtctttaccaaaaatacaaaaagtaactgggcgtggtggtggacgtctgtaatcccagctacacgggaggctgagacaggagaatcacttgaaccggggaggtggaggttgtattgagccgaaattgtgccattgcacttcatcctgggcaacaagagcaaaattccgtctcagaaaaaaataatgcctttgtctcctatggttgcttgcttgattgagttagataatccacatgaaggggttagcagagaaactaacaattagtacttgataaacattagctgttgtgattattgtattcatacttgcaggagcctcacctgtcccttcaaccccaccccatttcactttcccaagagcaagttagtaacagggacagggcttacatccaggccttctgactcagcctagaattccatccattccrtcgatctgctgccaaagaatgttactgattgggcaataattatttacttggtgtgtgggcaccactgttttttaaatgagtgttttcatttgtatcaaactggacctgctttcctcaaggattgcccaaaaggagacacaaatttactaaacacttatcaataayagaacaccgtgctaggcaatttccatatactattaatttaatcctcacaataactttggaagacagaaagtattttctctgatttacagatgaggatcctgaagctcagaggggtaaagttacttctctgaggtcacctagctagtaagtggtagagctgggattccaagccaggatcctctgtctccaaagcctgtacttcattcaggacactttcccccacatttagaaaagctgtaattatcttccagtgagacagcatagcaaatgtgatcactgtcccttcctcactccccaggtgttcaagcagccctggccagggatcatgcgcacagtctatgggaaccacgaacgctttgagacaacctactttaagaagtttcctggatactatgttacaggagatggtgagccttagctatccccctcttgcacctcccactaagacatgtaccttccacttccattttcaggaagagttggtgtgttgctataaaataatacctgagactgggtgatttataaagaaaagaggtttattttggatcatcattcttcaggctgtgcaggaagcatggtgctggcatctgcctatggtgaggcctcaggtagcttccaatcacggcagaaagcaaagggaaagccagtgtttgacatggcaagagaggaagcaagggagagagggaggagataccagcctcttttaaacaaccagatcttacatgaactcatagagttactgcaagtacagcaccaagccattcatgagggatctgtcccccccgccccccccacctccccggccttgaccaaaacacctcccaccaggccccacctctaacactggggatcatatttcaacatgagatttggaagggacaaacatccaaactatatcagttggttaggggtaaagaaaattagagaagaatgtgtcctacatgtcagtatctggtttctacgcagagctacaaagactgtaagggcaggaatgagtatagcaggaggggtctcagaatggtgccatccgaactttgatgtatgaggaaagatggacaatgtatgctcctgtgttgaaagagatggggcatgtggcagtgcatgactattatgtcatgtttgtctttatgtctggagtctgtgtttctccatctatccatctaccaatccattcatccataagatctgagcactgtgatcctgtgcccaggcactgatcatgaataatgtagtcaaaatctcctccctcatggggattctagtaaggggagacagacaaacccaacaaacataaataagcttatcttagatagagataaatgctgttaagaaaaataaacagggtagcatgatagtgtgtgcagggatggctactgtacacaggatcgtcggagaagacttctctgaaktgacatttgagcagaggcctgaagggtgagaaggaaacaggcatgggaaaatctagagtaagagtgttttgtgcagagggacacagcttgagatgtctgaagaatggactgaagcctgtgtggctggagcgtagcaagcaaagggaagaatattacatgacgttggagaygtacataatacagggagggtcttgtgggccatggtgaggagtttgaattttattcaaagkacagtgggaaacctttttttkgttgttgttgttgttgtttgtttttttttgagacagaatctcactctgtcacccaggctggagtgcggtggcacgacctcagctcactgcaacctccacctcccgggttcaagcaattctcctgcctcagcttctcaagtagctgggattacaggcgggtgccaccatgcctggctaatttttgtatttttagtagagacggggtttcaccatgttggccatgttggtctcgaactcctgatccacccaccttggcctcccaaagtgctgggattacaggcatgagccaccatgcctggccaccttttggggttttaagcaggggagtgctaagaattgatttactgtttagaaaataactttgctggatttatggagaatagagtttaggtgagtatactattggcatggaacaaattatcccaaaagttggcagcttaaaataacaaatattatctcacacagtttctgaggatcaggagtctgtgaacagtttcactgggtagttctcattctgggtctcttgtgagtttcagtcaagctgttggtagggcctgtagtcatctgaaggtttgagtgagcctggaggacctacgttcatgcttactcgcatggttgttagcaggaatcctcagttcctcacctcaccataggactactcaatacatggcagctagcttaccctacagcaaatgatctgagacaatgcaaccgagacaagctaggtgtcttctacaacctaatctcagaagtgacatcctatcacttctgccaaatcctatgatgacacagactaaccctagtacaatgagaaagaggactgcagggctatgaataccaagaggcagagatcagtggtgccctcttggaggctggctactacagtgggcaagagtggaagcaggaagacttgttagaaggctattgcagaaggtgtagcagtttggtaatgtggatcaggtatcctaccgtagggtttttatttattaggttttgcatttcttcccaggctgccagcgggaccaggatggctattactggatcactggcaggattgatgacatgctcaatgtatctggtgagggccaggggccaccttcccatcttattaactctgctcctctgacaacacccagccgaagccttccgcaagagcccaggagtgtcctttggccagaccatgtactaagtgtagcattcagttctgggcccaggttttagaggagtaatgaacactggaatgtgcctagagtaggggaacttggatggtggggtgactgaaagcatgtcatctgaggagtgaatgaagggtcttctccatttggccagaccaggactgccccatgggtacagatggagcatgggctggggcagagcctgggatctctctcatggcacttcctttcccttgacaaggacacctgctgagtacagcagaggtggagtcagcacttgtggaacatgaggctgttgcagaggcagctgtggtggsccaccctcatcctgtgaagggtgaatgcctctactgctttgtcaccttgtgtgatggccacaccttcagccccaagctcacygaggagctcaagaagcagagtaaggagcctccctgggcagggactatagggtctgtcttggaggcccagttatcactgcaagttgttggggaggggctagagcaagctgctccccaaaccacaaacagattccagggggccccatgggctgattgccctcttcctgttcagtctccactagtctcccactaggataataataatagccaacatttctagaatactttgtgccaccgctaggctaagtgctttaaatgaattaccccacttaatccctagagtcacctccatgaaacagatcttattgttaccttcatgctaaagatgatgaaactgagactcatggaagttaaatcacttgcccaaggccacactgctagaaaggtggcatttaaactcnagcaggctcattctacagcctgagttccataagataaaatgagagagtaaagagacaagtgtgttgagagcaagagaagcagtgaacctgaggctgtctctgtgggcagggacttgaggaggaaacaggtggggaacaaagccatctctactttgatttttgaaaagtctggctaagggtgctgaagaaatgcttgatgatttgttggttacagttagagaaaagattggccccattgccacaccagactacatccagaatgcacctggcttgcctaaaacccgctcaggtatgttcagaggcctccatggattgggatgggctgaggcctggtggtggtggggtgtgcgtggatgaaagcctttggcagggctagggtgggtcagtgctttcaccaagtaactagaggtctgtggttccccagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaayaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaagtggtgacttgttttcttaggtatctgtgccctgaggctgtatattcattagtggctctgatttgtgtggcagatgggaagggaggggtatttcctaggactatccccaatatcttccttctagaacttttggtttgggcagagcgaaggaggcttcactgacagggcctttgacaagcccctgagctaagcaggaaagtgactgaagccagttcacaactgttatgtatgtcccatcttggttgccttccctcctgggctcctgccagggactctcattcctccctgtgatccagtaagagcattagtgggtggctaaggattgaaacttcagggttccacctgtagagactggtctagggggaccctgattacagaccagtcacttccctgctctaatacatcttaagtgggctaacgtagattacagctcccgcctcccctctatgcacgaagtaaggaatcatcactgaatcagcaatgcagttttatttaaggcagaattagggaaaggctatgcccctccactccccctcctcctaccactcagtcctatcccaagtcaggcactggaacctgctgaaaaggctgatgaggggctgacaggagtggggcagggttcatggacctttacctcagagcagcttaccctgagctatacccacatctcaaggatttgggggcgtctagatctcatctaagggagacacaacttttctggtcctcagatggaaagctgggggaaggtaccagtatttacccttccataaaaactttggaggtctttaggaggatacccctcaggagggctaggagaggaatgacaaatacagaggatagaaggtcccgtggcctggttgtgccctcacacagggtatgggttgtccaggactgccactcccgctgccacaccaccatctgcatgctcgatggctttggttcgaagtagatgccccacgtgcttgttcatcacgagtgtcttttcctgcctatagaaatggaggcaggggacacacatcacctggactcagccccaaacccaggaccttccctggacccagctgagcagtacctgggtaactgtctataccaagaaagtgctaggattttagagtctctatgcctctctggagtctccttctagtcctaggttgtcaaaccatgtgttctgagtcctcttggtgctatttggagtttccttcacggttgcaaaggacttctcatcagggcttcatctgataccctggtaaggtgggcaggtcttgggtccttggcctcatttaatagataaagaaacaggtaataaagctagtgattggcagagctggcaccgaagcccaggattcctgactctttccagtgttcccctctaggctggctcacttggctggcactcttgcaagcaggtagtggaaagagcttctcctgattggctcacctgacatagaccccaaagatgcccagctctgaaatgcactggaccactcgggcagggctgccaggccgtagcaggcaattctcaaaaggctcaggttcgatcttctccatgaggatgtaggaggccctctcctcactgtccttcagctgtttcagggcctgtaccatttcctccccatataggttgttacctgcaatgaaactggccagtcaccctggaccctctgcctacctcctccatcccatgccctcacttttggggccacatgggcaagtcagcagcctcagttcctggcacccgctcagtgaagccagggcatatctggcttctcaggagggaagctcactttgacaggagagcccttactcatgcagtgaacacatcttccactacactgttctgccctggttctcctcctacctacagctgttccttctcaagctccattgctggctccttctcttaaatgctggggtcccaggggaattggtcctccacgcttgctctctcccccatgtacattttcccaaggagatctctcctattcctgagtctccatctataccctaaaaattgttaacttccggccgggcatggtggctcacgcctgtaatcccagcactttgggaggccgaggcaggcagatcatgaggtcaagagattgagaccatcctggccaatatgatgaaaccccatctctactaaaaatacaaaaattagctgggtgtggtggcgcacacctgtagtcccagctactcaggaggctgaggcaggagaatcgcttgaacctgggaggcagtggttgcagtgagccaagatcatgccactgcactccagcctggtgacagagcgagaatccgtctcaaaaaaaaaaaaaaaattgttaacttccaaatatttaatgcaggctccctgcttagacatcatatgactggcccccaaacaaactcaacttgtccaagcagaacttattacttctgcctgaacctgcccctcctggaccttcctactcccaatcaggcaaaaggtacccctgagtcatatttaactcctcccttccactaccctctcactatctaggacatgtctctccagttggccccatagtcatagccctagcccaggcctctacgttgctcttctgaacaactgtatcagcctcttccacggtctttctgcttccagtgtctcccctcattccaggacatcttctacaatgcagaaactgtaagttttgcaagttcccaccactgctaaccacttgagtcctggatcaatgtgtcccttcctggcttaaaactccctaatggcttcccactgcccttaagataaaatccaatttctcagtatatattcaaggccctttataatcaggatgcaaaccatttttccagcctaaatccctgtcccctcccagctccccctccagcctcaccagtttctcattaacctccaaacatctcacactttcatggcccggtgccttggcttgaggttgtcccttttgtatggaacactcttcctcctttccacctgggaaattcctacccacctcttaagacaaagattaaaaaaatcctctcctctggagaggcagacatgacccctgacctcaaggagtttcaaactagaaaggaaaacagacatgtattctctccagtctcctaatatgaccctactctacttcccaacaatctacccacaggcacctcaggtaaaacttgtccaaacccttcaatgctggttaatcagattcccctgtgctcccggacttggtcacagggtcttaggggacactgtccaacatgtggcctgtgtcagttccaatagtttcccccatgcccgggactgtgcccagagtaagtgccaatgagcactggccacagcctgctagtccctctcattgaggagccctgcaaagggagatccacctacctccaccctctctctggggctttagcacaaaccggctaggggcagcaagggcctcggcgatggcctggtccccttcttcaccctggcaggaggcagaaagcagttatcaaaagtttaaaggctaaagaggcaagaagcttaggtccagctggttatgcagagcagcatcagaggaagagcaggagggagaacagccacaaattccttcaggcaggatgctactatctggatgacactcccaacaaaccccctgcagcagccgatgcaatgagaacaggcctttctttagcaacagctcagggctctgcagcaggcagcctgatacacttctcaattcttgccacctgccttagtcccttccctctggttgccatcctcatctctacctttgctgagggagcttacaatggattccagcccccatccttccattatgaggctgcccttctgctcagagttctaggggttctccagagcatcaccaaccttgccagctccaccttccccttgtcacaatgccagctccaccctccccaacacattgggctgtaggtctctgccacctaggaggcctgtggtaggagaaacaggctgcccacgtaccacatccagtgagtagaggccagcaaaggtggcgcggaggcgggccacagcctcagrctggccagggagcaacatctccagcatgcccggcctgcttagctcctgctgcaccttcttagtcccagccagctgggtggcaatgtctgggcacttggcagcatgtgacctctccagcagtagacgtgcttcccaattctgcagagggaagaagacaaaaggaattcgactttattttacttcagctgacgtttactgaacatccatccattaggtgccaggtatcatgatttgtatcttcaccctcattatcacccaggatcattctaacatccttgtgagccaggtgtgatatgttgtagttatgtatcattgtgccagactgtgagcccctgcaaaggcaagaatcccccaatctgtgggaaacaatagaaggtgtaagggtagaacatttgtctacgtgctcagcttcccactgtgttccatactccctaccatggccttcaagatccttcaggagctggctcctgtctactttttcaaccttgtaccatccctgactcctagtctctgccattctactcacacaggcctgtcattcctcaaatcacaaagctctttccctcctcagggcctgcactgcttttccctcaacctgaaacccccttcctttcggcttttcccatgcatagctggatccttaccatccttacatctcagctcaatgtcaccttttcagagaaggcttccctgtccactctatttaatgtggatttcccataattctctttttacccagttgtttcattgaaagcagttacctgagactaaaacacacacatgcacacatacacgcacacgcacacaaacatacacacacaaatcccaatttttttttcctatttttgtttactttttttttcttttgagacgtgggtcttgctctgtcacccagactggagtgcaacagcgcaatcttggctcactgcaacttctacctcctgggctcaagtgatcctccctcctcagcctcccaagtagctgggactacaggtgcaygccamcacacccagctaatttttgtattatttgtagagatggggttttgccatgttgcccaggctggtcttgaactcctgagctcatgcaatccacctacctaggcctcccaaagtgctgggattacaggtacgagccacagtaaatggccatatttttgtttactttctgatgcccatttctctgaccagactgtgagctccatagcacagggctcttatcattttcctcattttctgttgtatctccagtgtctaacacagttcctggcactttgtagttgctcaataaatatttgttgttgttgctgaataagttgaaatttgagtggggttctgaaggacaggtagagcctgacaagtgagactcaatagggaagggatactcaggctaagagaataatatgaacacaggtctcaagtggatgatcacaggatgaatggtttattaccacaagagctgagggtataaaaggcaaggaaacagcaggggatcatgcctcccaactctggttcccattctcatgcaatggggagacagtctgtccttggctccagaccactgcaaactgcacacagcaggatcaggtctctcctgtgacccccacccaatgctgtccttcctttgatactactggtccacctgtagcaccttgacctgatcttcatcaataaccccaggaacccaactactagtctggcattccacgcagaatcacacgtgaccagaacatcagaaataaacccagagaaataccccattatggtagaagcaggaaagcaaaaccaaagataagcaaggacttgcccagggtcatctagtaagtcactaagccttctagatctctctccatgtctaaacctgctctgagctgctcagttccctaaaaatgtctacctcttggccaggtgtggtggctaacacctgtaatcccagcactttgggaggccaaggtgggtggatcgta

SEQ ID NO: 10736 - DNA, 24900 bp, Homo sapiens
  misc_feature (1)...(24900): n = A,T,C or G, or insertion/deletion polymorphism (see Tables 1-2)
aaggtacacataatggctggtttcttctttttggtgaaaactctcttattttttaaagatggtttaaattgaagtctcagaatggttaagaggtagagtcaagttagtgggagagtcaagactgaaacctcagacttttgagtctcagtctctacctctttcattatatcatgttactatcaaaaaaagcttgctaagtgactagaacatagcaggtggtctattcggcattgcataagacatggttgcaccattcacaaaattatccaagccagaaatccagaagtcatcctaggcttctccacctctcttacttctactaagtcctactgactgtatctattttacatcactctcatttgttccctcctcaccactcccactgtcactacattatttcagactttattgttgatttattggaccactatgattagcctttgtaagctgcccttctccataacaatcttgccttcttcagtcactgctgccttgttaacaaaagatttttccagctgaaaatctgaatatgttatttttctcagttttcatgatggagttcatactccttagtgtgacagacaggtccctccatcatctggctttgcctatctgaccaacttcatgtgtcactactttcactcacaatattccagtctattgaattattgaagttttctgggtctgccagcaagaatatgtagtgattaaaatgtgggctctaaaattagacatacttgactttgatccttgaatttccccatttactagttgtgcaatacaaggcatacttaccagcactgtgtctcatatacctcacctctgtaatgggaataatctcaaagaattgttttctatgtgtacgaagaatgaaagaaatagtgcaggtgaagaattcgcatgtgagccctcgctcagtaaatacagggtggtgttgttatgtggtttcatatgcctttataacctttgaacacattcctaataatgtttctctcctccttcttgacaacctctccttcttgacaagctagcaaattcttactcttgtgtaagggcccagctccactgctcttttgccaattagtagtaaacctctctcattccatagcgcctcggaaccttgtagatatttaagttactgtatcccatggctatatgtctatctgccttgcacaactgttaaatttttagatagaaaccatatttttttgtttttcttctcatattctatatcatggtatggctcagtgaaaagctctataatttaaggttactgcatcccatggctatatgtctatctgccttgcacaactgtgaaatttttagacagaaatcatttttttttgtttttcttctcatatcttatatcatagtatggttcagtgaaaagctctataattcaaggtttggtaaattaaactaaattgatggggttgaattaaattgaaagagtgtatccaacttctctttttatgagtctgtattttccaagtaacttttatgaaagaaaagatgacttatccaaagaatctaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcacccaaaccgctcaactacatggaaactgaacaacctgctcctgaatgactactgggtacataatgaaatgaaggcagaaataaagatgttctttgaaaccaatgagaacaaagacacaacataccagaatctctaggacgcattcaaagcagtgtgtagagggaaatttatagcactaaatgcccacaaaagaaagcaggaaagatccaaaattgacaccctaacgtcacaattaaaagaactagaaaagcaagagcaaacacattcaaaagctagcagaaggcaaaaaataactaaaatcagagcagaactgaaggaaatagagacacaaaaaactcttcaaaaaattaatgaatccaggagctggttttttgaaaggatcaacaaaattgatagaccgctagcaagactaataaagaagaaaagagagaagaatcaaatagacgcaataaaaaatgataaaggggatatcaccaacgatcccacagaaatacaaactaccatcagagaatactacaaacacctctatgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactctttttatgaggccagcatcattctgataccaaagcctggcagagacacaaccaaaaaagagaattttagaccaatatccttgatgaacattgatgcaaaaatcctcaataaaatactggcaaaccgaacccagcagcacatcaaaaagcttatccaccatgatcaagtcgacttcatccctgggatgcaaggctggttcaatatacgcaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctctttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatgctcatggtaggaagaatcaatatcgtgaaaatagccatactgcccaaggtaatttacagattcaatgccatccccatcaagctaccaatgcctttcttcacagaattggaaaaaactactttcaagttcatatggaaccaaaaaagagcccgcatcaccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaaggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacttgaacagacccttctcaaaagaagacatttatgcagccaaaaaacacatgaaaaaatgctcaccatcactggccatcagagaaatgcaaatcaaaaccactatgagataccatctcacaccagttagaatggcaatcattaaaaagtcaggaaacaacaggtgctggagaggatgtggagaaataggaacacttttacgctgttggtgggactgtaaactagttcaaccattgtggaagtcagtgtggcaattcctcagggatctagaactagaaataccatttgacccagcaatcccattactgggtatatacccaaaggactataaatcatgctgctataaagacacatgcacacgtatgtttattgcggcattattcacaatagcaaagacttggaaccaacccaaatgtccaacaatgatagattggattaagaaaatgtggcacatatacaccatggaatactatgcagccataaaaaatgatgagttcatgtcctttgtggggacatgtatgaaattggaaaccatcattctcagtaaactatcacaagaacaaaaaaccaaacaccacatattctcactcataggtgggaattgaacaatgagatcacatggacacaggaaggggaacatcacactctggggactgttgtggggtggggggagtggggagggatagcattgggagatatacctaatgctagatgatgagttagtgggtgcagcacaccagcatggcacatgtatacgtatgtaactaacctgcacaatgtgcacatgtaccctaaaacttaaagtataataataaaaaaaattaagagaaaaaaagaaaaaaaatgatattcattaatttttgatttctcaagcagacttcgcaactggaggaagaataaaatgactagactaggagaatatgcaaactattaagctagatttccctttgtaaattaaaaaattagtactttagtttatcaatccattctttgtggtgttggtttcatgaatcatttcaaaaacaatggatcactcctgctagctctagtcattttgttattctcataggaaaaaaattaaatatgaaaatgaatagaaaagatatatatagaagcccaaggaaaaaatgagctgacctcacatgcacgacaggaagggccacataaatggacaatatacagagatttaatttacaaaacaaaatataaaatctgcctctcagtggtatgattctcaaaagttctaacttttatactcagcatcatgttttagcaactatatcttacaaagtctgaccgacttaatcatatcaactttaatttatgagtcaatgaagtatatttcaggaggaaacatcaaatgatattaaaatattgatggttcatctgctcctttcccttattatttagtttttctttctttttttagctaaactaatgtaaaattatatctaatgacagcaagctttcctttctttcgacatagtgaaaacttgtrtaattatgaaatttttaaaaggttaaagcctttgttatttattttaattcaaatccagtatattattatacatattcggagcccaaactatkcatcttcatctaaaccttcaattaaattccacaatgcaaacctcttggctctagaatcacgtttcttgtttattcaactgagcctgtgtcttgaaaaagtgttgaagtttgggggttttctggtgagaatccacgttctgacatcaccttggtcgtgacagtgattggctgttggaaggcaaagaagagtttatagccagcaagagcaagtgaatgagtgagtgagagggmagaggaaatactcaatstgtgccactcactgccttgagcctgcttcctcactccaggactgccagagggtaagatttaatagaacaacttcattatcataaaattagacactccatagtttacatctctgaacttggctttgaatttttcatttaaatgatgttattgcattgtacatggtttaataattatttatcattaaactggcacttcagattttaaattctttccaaaaggctaaacttattaacctaagcatgtaaataagttcttaatactatgcacataaactacattatgcttcttactttcattctctgcaaatcatagcttaactgtttgttttctcattctgatgcattcaagataacctgattgaaatactattttgcatttgcaaatctggctagatatatgcatatttctctacaaattatacctagtctgtacttcaagtacatatgttgtcttttcaacatattaaacattaggttttgatgtttcctatagctctaaagtcagaacagaaaatatattgtactaactagagaaataaatactcttggtagtttatcatacccttcccaataaaacttgaaattaaatcctcaaaattctcctttaagaatgtttgaattgttgtctgggttagtagtggtcactatagaggtcttggctttttgttgactcacaaagtaaataaaattagatttatataggcagccaatcctgactacaagaactacttggttctttgtattgttattattattatttatgccatcttttcatctggttatttttattgttatgagaaatttgtgtaatcaaaactatttctataattctatgtatctaagcttttagctctttaaaatattataaatattccgacccttctcacaaagtggcaaagcaataatctttctgttttgctgatgggcttggtcacggctggcaaagttcaaagcattatttagaccaccccgatagaaatcagtgctgcttaaaaagatgggctccttcaggagcaaagcctgtttattcccaaggggccatcaagancttttactaagataggactgtgagaaactgtctgggcaccaaaayccaaagactcactctgacacacaaaaagagtgtgacttaggacccaagacagtatctccaggacttagtgtcagatactcagtaaggatgcaataaatcttggctgatgatgacacaatacacaatttaccagcaggtttcaatatatgacattggtttgcacattttaagtattattttcaaaatgtattcatgggaaattgccatcaccactacattttgcttccaaaatattgccaaagctgtgactgtgtatgagaaggtgctaacagttaaatgtgtatgtaaatgtaaatggctgagtgttagtaggctttcagctaagcttgcccaacttctattatgatataattttaaatacaattttattaaatagaataaaattaagataggatagcatttcactatctccttttactcatgaggaatttatgtggaactgaggctctttttatggctgcaatccccaagattattcaggccctattcccactttgagagctgcatcttcgattgttccatagaattgaaattttcatccatgtctgtcaccctaaccctggagagcccctaatccatcccagtacagtctcatacactagcagatggaaagcttaaatggagctggagagcaaattaatttgaggaaatctgcccccgatatctcaaggcgaaactctgaagaactcctcatggaagcatccttagcggagttgctgttgcgtgctacatgatgtcagtgtgatatttcatatattatggatcctctctgtctctctgtctctgtctctcatccacccacccatacacacacacacacacacacacacacacacacacgcatatacacacacacacacaccaattattccaagatgttcagaggaaaattgctcctactttccattttacaaataaatttttagcccaaaacctatatagaagctggaaaccgcctatagggtatcagtgatttttgcttttttgttttatttttgagacaggatctcactctgttgcccagggtggagtacagtggtatgaacacggctcactgcaaccttggcctcccaggctcagcctctcgagtaactaggcctactggtgtgcaccaccatgccaagctaatttctgcactgtttgtagaggacaagtttcaccatgttgcccaggctcatctcaaactcttggactcaagcgatctgcccaccttggcctcccaaagtactggttttagaggcatgagccaccatacctggtcgagtttttaattgtaaacaaacaaacagggcacacaactacactaacaattcaattcacttagctgacactccatgtcaatattaagagggccattacgccagtgtgaagtaccctaagtattcaaaatctcttgcagtaatgaaaaggtcttccattgagaaatcacaaaaaataggttaaaaccaagtatggaactcaagattatttaaacggatgggttaagtcagtcttatattacttaaatggaaggaataatttgaaaataaaaggaataatttagttttaattagtcaaagtgataattacacagaaatgaaaacaaattaaatacttcatctttgaatatgagtaaaaaagttatgctcttagttttaatattttattaaccttaccacttcattaattccagaagcaatcaccaaaatgaagactgctttaattttgctcagcattttgggaatggcctgtgctttctcagtaagttctttatcaaaacccacagttattttcagttttgtctttttatgtaaaagaaaaattatgcaataattaaatgttctttaaaacagatgaaaaatttgcatcgaagagtcaaaatagaggattctgaagaaaatggggtaattaattttagcatacttccttggcctgattatacttgctgtatatttattgcatattaaacatgaatatatcatttattttgtttttgcaggtctttaagtacaggccacgatattatctttacaagcatgcctacttttatcctcatttaaaacgatttccagttcaggtaaatatagaaattcatttttcttcagtttaatttctattataatttaaaggagatcaaattttaactataaaacacctaaattcaactctcactgaaattcagtcaaaaagactgcttactataagaagtttgtttttagggaaataaggtttatttctaagttctcttttaaggcagacatatacacagagtaaaatcatttggatcatttgggtacagtctagaatgatataataaaaacaaacactgtagcacattgagctctggtatttttgctaactcacagacaaaagtggacagttttatcasttgttgaccaattccatcagtgataaggtcactggctgtcctattacagctgattcaatactgtcagatagctgtttacatgtggcactgcagagtcctttaattggtaggggaaaatttgacttcataaacatcagaggccattgtttttaaaaaaccttgataatcaatggtaatttctgaagattttctgcaccttaacctgtgtgggtcactagagcaatatgtcatacactggagcataatcataatggtaaaactgcagaggaaaaagagaaattcatgacgtgcaccaaaaaagcttgtgagaaaaacaaaccatcccttaaatttgtaaacaaaaaggaaaataactaaaaaaaaaataagagtttccaattttgccgggttacctgtgaagagtgmctttgaaaaccagagggtgtggtgttgattttaaatatacaacaaaccaggattgcactatttttagtaccatacagtttgggttcaggacaccaattatgcaccacttgacccaggacttttgagacactaaaagcagtcaggatgctgaaaacgatgcctcagcacagtggcttggcattgcatcttaccatatgttgggctaatccatctctaacccctacaatgataggaaatgatcattttaaagtatttctagcaccagcataattatggggaatttgtgtggccacaaaaatatgagcatgaatgaaacaagagttgtgggttttcagaattgtattcccttctttggttcacctcagayccataaataaacagtgctcatttgaaagtttgctttgttctcttttttaaactaaatggaaatgataataaattcaagtctctgactagctcctaaacttttctgaaatattaggtacatagagatattcattcccatctggatatttttatagatatgtatgtatgggcccattaaaatgtccatagtgaagcaatattaggaggcattacatttctcaatattgatagacctgaggtttgtagatcaaggagatctttaatatacaagttttttcacaaattatatgcagataggcccatctcaactaatgtagaacttgtaagataattgtttttaaataaaattatatacaatatatctcccaatcctactgtctgacctagtattcatgacccattcttctactttacaaaatttgattttctttaagtgtattgttaggtgtttagtgcccatgttgtcaccccaaaacacattaatctgtattggctttgaaattcatgtttccatcaaacaaatctgcatttatatacaatcatttctaaattaccaagttacaatgacatatgttatttggattgcaaagtgatcagcaagctatctattgtggcttatatatctgctagactatagaaatgaaagtttaagtaaacttaacatcctaagcttctttattgagaaaattgtcattttgtgattcaaatgatattttattagttgaactcatagaaggtaagaatttaatcttatatttcctttatcggactcatctcagctatgacaagagttgtgggttttcagaattgtcttcaatttcagaactctttcatctatctgtgtagacaaatgaaagacttcttggagaatcaattggacttagcaacaaattggtaataatgcataaatgaaagataggaaaatgccaaagcttcaaggcatttcatacagcttttaaagtgttctcactgcagacactaatcgaagagtgatgtggttgagctagggagaaagccagaggtgaaggagcatgtgaagtgattgaaatacccccactgagagaaacagttctgattgcataaatatactgtcctctataattaagttaactaacaaatagaaatcgtccaaatataatactctattcaccctctgggctagggaaggcacaaccattaaggtcatggcagtggaagaacaggtttaattattctcttttycacctgaggttattcctggctcgaggtgacaagcattccctttccttgggtggatgatgtggccatctgaagaatgagccagcagggacagtcccacaggacctggacatgaatgttgtctcacatttgatttctaacccagaagttagagatccttctgcagctatattttctaaatgcaagacattaactgggtcatcagaatcaaagctaaatattgcagggaaggaaatgacagaatcttagattggaatttacatttcctttcaaaaagtagcaaaactctttagcttataattatatttttatatacaaaatcttaatttattctcattcaacactgaacttgttagagggatattactctacacaacctcccaaataattaaatgaataagtcataaganttttacttcacatgtataaattaacctcattttaggaactggctttaatcaaatttaaagatactaaaaattatatgcaaattaaatgctattaaattaagtgcyaatttaaattcaacaggagagctcactatgtaagagaatcatctataacaacttttatagtaagctgaatgatttctttcatgttttctaaataaaattttaaaatgtgaactatatcttagcccaaggtctgccttgaacctgctggagaagtcacaacttttttaggccgctgattcattctccataaaatttaaaaattggaccagttaattcacttgttctctcaaagttaaacaattctgtgattcattgccctagtttttacatacaaaatgtttcaatatattgtcaatgctttggaagttgacaaatgggacatccaattcatatcttgatcatagtaaaatgcctatttttctctaacttcattttgcatgtctaatctcctatctttctcacatcagtatgcaatctgttcttagtaaacaagtcagtcaagatggtaatactaattagattgagtaaatatttgtgtgtattttattgtgattcaattagcaggaaatttaaattgctgttgaatatatttgtacacagataagagtatacatacatgtgtatatatttttagggcagtagtgactcatccgaagaaaatggagatgacagttcagaagaggaggaggaagaagaggtaaggaattttgcaatcttttcgtaataaagcagacagcacaagaaacaaataggaaactagtctattgcattctggactcagcaaatagccattgtcactttactaactgcccataatatcctattttggataagcagaattttatttaaattaggatccactaacatgacctgtttaaaacactattgcagtttggggttgaaattacttacaaatggtgctcaaaaccaaaaatctctcccttttaagtagaagtagtataaaatctgataaaaagcaacagaagtagtataaaatctgataaaaagtaacagatagcattacttctatttaggtggatagaacatgatgttagaagacaagtgaatagtaatcctaaactcagtgcaagacttgttttaaggactgaactttacaatttaatttaccaagagggtaatatgtaaaaacccgtatatctcctctacaatattattgtgattcatcagcctttcataacccacaaagtagggttattctttttaaaaaaatttcaggcttgttgtggtggctcatgcctgtaattccaacactctgagaggccaaggcggccagatcacttgaggtcaggagtttgagaccagcctagccaacatggtgaaaccctgtctctactaaacatacaaaaattagccaggtgtggtggcatacacctgtaattcctgtcactcgggaagctgagacatgagaatcacttgaacccggaaggtggaggttgcagtgagccaagatcctgtcactgcactccagtctgcgcaacagagcaagactctgtcacagaaaaaaaaaacaaaaacaacaaaaaaaaatcatacgtctttttgggtagtaataaaattcataggtatataaatatcttcccatatagttttacagattagtgtagtcctgggctaagaatcatctacatgtcttggaaattgtgctaccatgtttataactgatactcttgcctaaggaaacataccaattaggatgcatctttcccgcatagtcaattatagctaccactggtttaggaaccttttaaattcagcttttctcaggtgctatttatgaatggacaatgatattcaaaaatggatcatgtattaacagctgtcttgaaaacaaaatggtgtgggaacttgaaaggtgacgaatcattagtttggtatatttttaactataaaagtaacatttcccgtatcataatttatactaacatcttgaaggaaggccttacaagaatgttaagccagtaccaggaaaaatgccacccactaaatcccacaacatttctgctggagttccacatagcaatcttacacaagaactaggctaaggttatccatttagttatagctatttgctgtacagtgattgtaaaattgccttgtcaactacatttcccaactagattgcataacttttgggagtggctcttcgtttgttgttgtggtggttgaggactgaggaagactaggacttctttggggactctgatgaaatcaagtacacacaaaattttgccaaggatctctgamcatttaaggtcttcccagaacgtgtctgcagacacctcatgaccataggttaaaatccctgctttggggaagagccatgctactcagttttatatctcttcatgctgcctagcataatttcttatacatatatggtgcccagtacatatctggtggtttggttttgaaacttcagaggaataaatgcaacaaacttcattcattaaaagtagtaatggaaaagcgggtaaacaaaaccagaagtctttcatcctgaagagattctgaaacatcttttttcctcattctctaaaatgttattagcaatttaggttaaatatagagtccccagggattgtatttgtatgaggagaatacttaggcatattttctatttggtgatcacacatttcctttttccactcctaaactatttagtctcataaaataaactttttttttttttttgagacggagtctcgctctgtttcccaggctggagttcagtggcttaatctcagctcactacaagctgcacctcccaggttcacgccattctcctgcctcagcctcccaagtagctgggactacaggcaccggccaccatgcctggctaattttttgtatttttagtagagatggggtttcaccatgttagccaggatggtcttgatctcctgacctcgtgatccgcccgcctcggcctcccaaagtgctgggattacaggagtgagccaccgcgcccagacataaaagaaacttttattgaaatatacataataaaattatcctaattatacatctcattgaaatttcagaaattgaacacgtaagtgaaactagcactcatatcaaaaagcagtgcgtgccttgtgttccattccactcattaacaaacccctaccaaaggcaagcagtattttgactcttaatagattgactttggcctgtttttgtatattatgaatgtaggatcatacatgatttactctttgtgtgtcacttcttcactctcaaatttagagattyatccatgttgttctgtagttgtagatcatttattctcattgttagtatttcattacgtgaatgtaccaaaatgtgttattcttctgttgatgggcacttaagtagtttccaagtttgggtgattacaaagtgctgctatgaactttctagaacttattctggtgaacatatacatattcatttctcgaggccatttcacctaaaagtgaaatttcggagtcgaaatctactgaggcatatatattcaaccttagtagatggcaaccagctttccaaaacagacgtactcaggtaaacyctcaccatccgtgtatgagggttccggttgctccacattctcaccaacacttgcttctttcagtcttgttagccaawctagtgagttgataatatctttgtaagcgcaaattagtgctatttttctatccaataaaatttgtgaagcctcatacccatcaacagtaacctattttcctatgtaactcatgtgcagcggaacatccttaaataaagtatctgggaaaagaaaaggtgtaagagaaaatataaaagttgggatattgggcctttagttgtgaccctaccaccaataaactgctatctatttgacctcatatgagtcatataagccaatcagatttttcaactgcaaatagtatattcttctactctggggatctttctaaggatggtagaataaatttctccttctacctctgaaacatctgttggaataaagcataaacataaaacaataaacaaacacatggtgttttggggatatttgacacaattagcttggagactgtttggggtatactctggtggtattgcaacccttcactgaaatagtgaaatttacaaatttgatgaaacaaacatgtggtgctttagtcactttgttttaataataggctaaatatttgtttgtttgttttaaactttaaaagttatcacaatctcttaaaatgtattgaagtgaattcaattttccagtatttgtttaaaataaataaattgtatatataggaaaccttgactttttatattagctacaaattacactgagatcaactcaattaaaaaacaattgcctcacgatatgatataaaggctaaaagattaaatattaaagattataatagacattcatttgaagagtattaattttttaaaacaccttcatgcagactgggcgcggtggctcatgcctgtaatcccagcactttgggaggttgaggcgggcagatcacaacgtcaagatcacatcctggccaacacggtgaaacgccgtttctactaaaaatacaaaaattagctgggtgtggtggcatgtgcctgtagtctcagttgctggggaggctgagacaggagaatcgcttgaacccaggaggcagaggttgcagtgagccaagatcacaccactgcactccagcctggcaacagagcatgactctgtgcaaaaacaaaacaaaacaaaaacaaaaaaccttcatgcaataatatatcactaagaatttcttagagtgtttagtttcttctttgtgcagaaaaaaaatgatgtgtcaaatgcctgaaacacaagtattttttaattgataaaatacaaagcagaaatatctaaaacatatagtgtggagtaaggaggattcaataacttggagttgagctcttggaagtgagaagtgcaaatggcataggggaaggcaggctttgagtgatcagccagctgagggatgcaaagtttttccaaataataaaccttcaataaatgattcacagctccagtaaatcttgaactatcttccaggtaaaataatttttcttactatgaatatttttaacaggagacttcaaatgaaggagaaaacaatgaagaatcgaatgaagatgaagactctgaggctgagaataccacactttctgctacaacactgggctatggagaggacgccacgcctggcacagggtatacagggttagctgcaatccagcttcccaagaaggtaacaatggaattattcctccaaaatraaattattaccattaataataatggtaatgttcaatcttttttaaactttttaactggagtctaagggtatcctaacactacacacatagtattttatactatcttcattaactcgctgaagtgagagcagatacaattttcctatttacaaataagaaaatatcttctcccaggcaagttctcctaccatgttattacactgacttttacattataacagaagactaagaacacaccactaggcatggataaaaggtcctgagagataccatgacattccagggaagagaattccaagacagagaaagtgagtagcaaaacgataggaagactctcccccaggaaaggcattatctttaaataatggcacactttccccatcaaaacccatgacaaaggggtttatcctgaagttttaaagcccccaatcattttgtaaattaaagtggccttaattcaaataagacgcctagaataaggctgtcagtattgtgttgcatgaaatgatggccttaaattttacatttttcacagctagatttgggttctttcaaacgtttccttacaggctggggatataacaaayaaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggagragacaatggagaagaaggggaagaagaaagtgtcactggagccaatgcagaagrcaccacagagaccggarggcagggcaagggcacctcgaagacaacaacctctccaaatggtgggtttgaacctacaaccccaccacaagtctatagaaccacttccccaccttttgggaaaaccaccrccgttgaatacgagggggagtacgaatacacgggcgncaatgawtacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctgggakgaattcatccattctggctttgcatccggctaccattttcgaagttcaactcaggaaggtgcaatataacaaatgtgcatattataatgaggaatggtactaccgttccagattttctgtaattgcttctgcaragtaataggcttcttgtcccttttttttctggcatgttatggaatgatcattgtaaatcaggaccatttatcaagcagtacaccaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatctacgagttttatcacaaataaaaatgcaatccttcaaatgtgttataattaagaagagaagtgagagattcataatggaaaaggtgaaacaaatggaagacaatttcactaaaggagaaaagcttatttccactatagtttaaaactaagaggcactgtaaacattttcttttggctaaatcaacataactaagactttgccatgcttgtgggcagggttagccatacacgtcaggggaatgaatggctcttactagagttaccagatataacaaatatataggatgcctattaaatttgaatttcagataaacaatgaataatttttagtataagtataccccatgcaatatttggcctttgtgaaatattttggacatacttatactaaataaatgattcactacctatctaatactcaactttattatatatttatgttttgagacagagtctcactctatcacccaggctggagtgcagtggcgccatctcggctcactacaacctctgcctcctgggttcaagccattctcctacctaagcctcccgagtacctaggattacaggcacacaccaccacacctggctaaatttttgtattttgagtagagacagggtttcaccatgttggccaggcggctggtcttgaactcctgacctcaagtaatccatccacctcggcctcccaaagtgctaggattacaggtgtgaggcaccactcccggccctgatactcaactttaactgagtgcttcgtttatctggcaatcctacttctacttggcttaattttagctggacaaggggtggaatgaggtagaaaaaaactcttacacaacacatacgcacaaaggagggctgatatacaaagacttaacagcaagtcacaccttaatataaacctgaaagccatttaaaatgggagtaaagaaggaaagtagatagaaagagcaaaaagaacaaaaatgcattcatcttttaatttattaattgataagatgtactgaacatctacagagccagacaatgttcacacattgagcatatgaaaatgaagaatactgtgtttggggtaattttagtctgttagttaccagttatgagactgtccatgcatcataacattcattttttcaaactttttgtcttattatatctttattccaaaattcgtttctcaaatattcaaaccacaaatttaaaaaatttggttttaaataaatatatattttttcccataagttattagggtacaggtggtattcggttacatgagtaagttctttagtggtgatttgtgagattttggtgtacccatcacccgagcactatacactgcacctcgtttgtagtctttccctcaccccttctcactcttccccccaagtccccaaagtccactgtatcattcttatgcctttgcatcctcatagcttagctcccacatatcagtgagaacatacgatatttggttttccaatcctgagttattccacttagaataatagtctccaatctcatccaggtcactgcaaatgctgttaattcattcctttttatggctgcatagtattccatcatatatatatatatatatatatatatatatatatatatatatatatatatatataccacagtttctttatccactcattgattgatggacacttgggttggttccacgattttgcaattgtgaattgtgctgctataaatatacatgtgttcaaatatgcaataaatatacatgtgttcaaataatgacttcttttcctctgggtagatatccagtggtgggattgctggatcaaatggtagctctactttcagttctttaaggaatctctacactgttttccatagtggctgtagtagtttacattcccaccagcagtgtagaagcattccatgttcaccacatacatgccaacatctactgttttttttgatttttttgatttgggcattcttgcaggagtaaggtagtacagcattgcagttttgatttgcatttccctgatcattaatgatgttaagcattttttcatggtttttagccatttgtacatcttcttttgagaattgtctattcatatccttagctcactttttgatgggattgtttttttcttactgatttgtttgaattcgttgtagattctggatattagtcctttgtcagatgtatagattgtgaagattttctcccacttcatggcttatctgtttactctgctgactgttctttttgtcatgcaaaagctctttagtttaattaggtcccagctatttatctttgtttttattgaatttgcttttgggttcttgatcatgaaatccttgcctaagccaatgtctaaaagagtttttccaatgttatcttctagaatttttatagtttcaggtcttagatttaagtccttaatccatcttgagttgatttttgtataaggtgagagatgaggatctagtatcattctcctacatagggcttgccaattatcccaggaccatttgttgaaaagggtgccctatccccactttatgtttttgttttctttgtcaaagatcaattggctgtaagtatttggtttatttctgggttctctattctgttctattggtctatgtgcctatttttatattggtaccatgctgttttggtaattatggccttatagcatagtttgaaatcaggtagtgtgatgcttccagatttgatctttttgcttagtcttgctttgactatgtgagctcttttttggttccatatgaatattagaattgttttttctaattctgtgaagaatgatggtggttttttgatggggattgcattgaatttgtagattgcttttggcaatatgttcattttcacaatattgattctacccatccatgagcatgggatgtgtcctatttatatgtgtcgtctatgatttctttcagcagtgttctgtagttttccttatagaggtctttccactcctttgttaagtatattcctaagttgtttgtttttttttttttgttttgttttttttagctattgtgaaaggggttgagttcttgatttgattctctgcttgatcactgttggtatatagaagagctactgatttgtgtacattaatcttgtaggcagaaactttgctgaattcttttatgagttctaggagctttctggagggatccttagggttttcagagtaaacaatcatacctcagcaaacagtgacagtttgactttcgctttaccaatttggatgccctttatttctttctcctagctctgactaggacttccagtactatgttgaagaggagtagtgagagagctcatccttgtcttgttccagttctcagagggaatgctttcaacttttccccattcagtactgtgttggctgtgggtttgttgtagatggcttttataacattaaggtatgtcccttgtatgccaattttgctgagagttttaatcataaagggatgctggattttttcaaatgttttttctgcatctattgaaataatcatgtgatttttgtttttaattctgtttatgtggtgtatcacatttattgacttgtgtatgttaaccacccctgcatccctggtataaaacccacttgatcatgatagattatcttttggatatattgttggattcaattagctagtattttgttaaggattttagcatctatgttcattaaggatatcagtctgtagttttcttttttggttgtgtcctttcctggttttggtactagggtggtgctggcttcatagaataaattaagaagggctccttttttctctgtcttgtggaatagtgtcaaaagattggcaccaattctttgaatgtctggtagaattctgctgtgaatctgtctggtcctggactttatttttgttggtaatttcttaattacaatgtcaatctcgctgcttgttattggtttgttcagggtatctaattcttcctgatttaagctaggagggttgtatttttccaagaatttatccgtctcttctaggttttctagtttatgtgtgtaaaggtgttgctagtagtcttgaatgatcttttgtatttcagtggtgtcagttgtaatttctgttttgtttcttggtgaggttatttggattttctctcttcttttcttggttaatcttactaatggtctatcaattttatttatcttttcaaagaaccagctttttgtttcatttatcttttgtattttttgtttgtttgtttcaatttcatttagttctgctctgatcttggttattctctttcttctgctgggcttgggtttggtttgttcttgtttttctatgtccttgaggtgtgaccttggattgtctatttgtgctctttcagactttttgatgtagacatatagggctatgaactttccccttagcagtgcctttgctgtgtcccaaaggttttgataggttgtgtcattattgtcctgttaataggttgtgtcatccttgtcttgttccagttctcagagggaatgctttaaaataattttttaatttccatcttgatttcatttttgacccaatgctcattcaggatcagattatttaatttscatgtatttgcatggttttgaaggttccttttggagttgctttccagttttattccactgtggcctgagagagtgtttgatgtaatttcaattttcttaaatttatgaggctcattttatggcctatcatatggtctatcttggagaaatttccatgcactgttgaatagaatgtgtattctgtggctgttggatgaaatgttttgtatgtatctgttaagtccgtttgttccatggtatagtttaaatccattgtttctttgttgactttctgtcttcatgacctgtctagtgctgtcagtggagtattgaagtcccccactattattgttttgctgtctatctcatttctttggtctattagtaattattttataaatttgggagctccagtgttaggttcatatatgtttaggattgtgatatttttctgttagacaaagccttttaccattatattatgtccctctttgtctcttttaaccactgttacattaaagtttgttttgtctaatataagaatagctacccctgctcacttttggtgtccatttgcatgaaatgtctttttccacccctttactttaagtttatgtgagtccttatgtgttaagtgagtctcctgaaggtagcagatagtttgttggtgagttcttatccattccgcagttctgtgtcttttaagtggaggatttaggccatttacattcaatgttaatattgaaatgtgaggtaccatttcattcatcatgctctttgttgcctgtgtactttcgtttttgttttgttttgctttttgcatttgctttttaacttgtatttttgttttatagattctgtgtgatttatgctttaaagaggttctgttttgatgtgtttccaggatttgtttcaagatttagagctccttttagcagttcttgtagtggtggcttggtaatggtgaattctcccagcatttgtttgtctgaaaacaactgtatctttccttcatatatgatgcttagttttgttgtatacaaaattcttggctcataattgttttgtttgaggaggctgaagatagggctccaatcccttctagcttgtagggtttctgctgataattctgctgttaatctgataggttttcctttataggttacctggtgmttctgactcacagctcttaacattctttccttcatcttaactttggataacctgatgacaatgtgcttaggtgaagatctttttgcaatgaatttcccaggtgttctttgtgcatcttgtatttgcagcctaggtatctagcaagagtggggaagttttcctggattattctcccagttatgtcttccaagcttttaggattttcttcttcctcaggaacaccgattattcttaggtttggtcgttaacataatcccagacttcttggagtcttttt

SEQ ID NO: 10737 - DNA, 72069 bp, Homo sapiens
  misc_feature (1)...(72069): n = A,T,C or G, or insertion/deletion polymorphism (see Tables 1-2)
agagatctagaaagccttggtgtaactggatccagccattcaaaggatggcatcaggaacctcttgttctagccctgagctctgctttgctctgtgtggcctcattttcaggccagcattgcccaaatggctaccagcagtgccagtctcatgtcctactgcttgctccatagtgccagcaaaagtcccagagctgaccttcaagggctcaggtggggtcacatgccatcaagaaccaaccgtggaagctgcagggctgaaaactgttggcgaaggttggctcctgtgctcacccaggcgtagtcaacctgtggaaccatgtggaatgggggctctgcgagggcctcccaagggaatatccagagacaggacctctggatacacccagccaccacttccctccagctcctttccatggctcaccttgttctgagaggcagcagcctcctgctcccccagccctgccttgtcccctgaaccctgggccagaggccctgacccttctccctatccccagctatgagatcatgcagaagtgctgggaagagaagtttgagattcggccccccttctcccagctggtgctgcttctcgagagactgttgggcgaaggttacaaaaaggtatgttgaggcagggtaggggtggagcacggagagctctggtgcagaagtcagacaccgagtacaaggctctgcgtgatgggctggcatttaggggaccaccctttgtcctctctgggcctcagtttccctgctggttctaggaggggatgggctggcgctgtgagtttattttagcagcagagagctttatgaaatggaatcctacatggaagctgatcgattagatgcagggagggggcctagagcactgtctgtcctgctgcctccctcaggcctttacctccataccgaaccgtggggctccttcagaagtgtgaataaccccaggttacatgaccatgaaccgcctgaccacttggatcctgtcacaggattgtccaaggcccaaagagccagtagggccctgaaaccctgccccgtccaacaacacgggtccaagtgaggaggaaatacacatggcctttgacacagaggcagctccttctttgggtccatttctcacccccactgccccccggggatggtcccagggacctgggagatggagtaaggtcatcaccacttcacagcaaaggaaactgaggccctgaagaaggacgctgaggcagcatgagagcctgtgcctgtctgctctgaagtgggggaagagttagagtcctgggtgctggtctgataactgcccctccctgggtggtcctgagctcaccatgccttgtaagattctatgtgaggtaggagggcagctcaaccatgtggcttgggcaaatccctttcccctctgagcagcgggggtcttatttatacaaagggggatgggctcggttagaagatccctgaaggcatttctggcctgaccatccctgtttctttggttctccctgccccgggagcagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccaggtaaccaccctggcctggggccaaggaaattgtgcacagtgtgtgtgtgtgtgtgtgtgtgtgtgtgtgtgtgtgcgcgcgcgcgcgcgcgctgccaggtttgcctcagaggtaagttacgtagggtaagtacttatccctaccaatgaatagaagacagaatggaactcatttgaactttgatgccctgaggtggaaagggcaggctagtaaaaacaaaagtatgggctgggacttacttgcaaggtagctatttcctttaagggagcccccagaggttatctatactctcttatctctaggtcctgtcctagccccaaaaagaagaagcaaacctacttagcatccccagcaccccagctgttactcatggccagcctgaggcctatgttctgttcttcagcaccacgccctggggccagagggagcctgcttggttgtaggagtcagaggtgcctaaaggaattcaggacagaattcagactgggaaggagattcgtggttttcttttgccttgggaagtggtgaagttacagcccagagggggctttataggaggaccctgctgttgtgtggacttgatgtccacgcaggatctccccttaactggagagaagggctccccatgaggccacgcccacctccaaagcgagatccagcccaaggtgaagtggctggagccccaggctggggtactgtcccaactctgccactagccgctgagacctgggaaggcttctcctctgcgagcctcagtttctccatatgtgccaggagtgcacaccggccttagaaggctccgaaggccctcattgctctaactgttgaagaggccaaccatccaagagtcccagtggatggtgcagaggagtgaagtgcagcgctcacacagcttgaggtgtgaatgctcaccctgttttgtgccctcagacaagctgcttcactgtctaaacattggtgtcctcttctttttttttttattatttttattcatttatttatttatttttgagatggagtttcgctcttgttgcccaggctggagtgcaatggcgcgatctcggctcactgcaacctccacctcccaggttcaagcaattctcctgcctcagcctcccgagtagctggaattacaggcatgcagcaccacgcctggctaattttgtatttttagtagagatggggtttctccatgttgagactggtctcaacctcctgacctcaggtgatccgcctgcctcggcctcccaaagtgctgggattacagatgtgagccaccacgcccggccagtgtcttcttctgtaaaatacaaacagtaaaagtacttctattaggcggtcattgcaaggattaaatgagatagcatacacctttaggagtgcagaggagggagatgctggtgggtgagaaatgagctttggagccagctgaccctgctccgaagttccagctcctgcacttccctgctgtgtgaagtggggcagtgatataacctctctgagccacactttcctcacggtgcaggccttgcatagttttcacaagagttaaatgagccggagtgtgtgaagcctacggtgcaggggtggacacaccgaaggctcttcatgactgctgctggaatcctcctgggctccttcctagcccctcactcactgcctctttcctctagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaratatttttaggactcacgttaactcacatttatacagcagaaatgctattttgtatgctgttnagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcatttcattcatctgtaaagtggggattttcgctctcccacccctcgctggaagctggggggcctagaccttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccagggtaaggacaggggagggaatagggtggcgaccaggctgtggctttgagggcagagaggtgtagacctggcaggacccagacccctcacggctgcagcatctcaggggttgtggggccggcatgagtcataggctctcctgccgagcccaggcctgtgggaccccggcagcaacacagggccaggggcaatagggttgctgggggcaggggacagagtgctagggccctcccacctgggcccagagtcctgtacttggctcacttgaggtggaccagytgtcagcctcagatccatcactgtgtgtccttagcccctcccttgctctctctgagctggggaaacggcatcttcatttgagtgggtgcgggaaggacctcattttggaaccacaggcctccctggactgcctccaggagtctggggctgtggcttcaagtggggaaaagaatggagccatgggacagctctgactcacaggcccagccgccaactcaggggcagctgagccacaccagggaaaatacccgacggctataaggcctggccatacaaagcccaccatcccagggatcctggcttcagaaaacacccagagcctgtgacttctcttctagctgtggcaggagttgaatgaggtgatacccggatctgccttgtaaagaaaataactagcccacattccagacagggattatctttgctgntgcaaaagcctctgtctggaggtcagaagatctcagctccctgtgtctcaggcctgctccttwtgggaacttgagtggattacaccacatcaggcctcagtttccccagggrtaaatggagctagatgccacactaagacaaargttgataaaaatctgactaccactatccaacagttactatgccccagggctgtctggttgcttcacacacattagctcattttaccctcccaaaagcccagtgacctgagtcctactattatcccatgttacagatgagacaccagtccaagctgttgttgttttgtttgtttttgtttttctagttaaagaagtttattcaagggcaaagtgtgagggtagtcgtcaggaaacaggaaaaccagagaatggtgatcagtgcttccctgtgtggggcaaggtgaggatggtttatatagccagaaacgggtgggtaacacaattacattttccatacaaaggttaacgtagagctacaagatttgattggctactattgactacactttaagggggctgcttaacactcatttgtaaagaggtaatgatcaccagcgtgtcatttagtccaggtttgaataaagaatggggagcccggttaaagtataacattctcaacacaaaaatcaagaggcaatggtcagagagcagtcctgtgatgtgactcagtttccagggcttaacttttcccattggcataatgaattggggagctcctgaaattttattttattttcacaattttgatttgcattcaaaccaaatcaaatgtgcattcagggaggttttgaagtgacttgcccaagatcatctggtcagtgtggcagggatgggagaggagcccaggtcagactgactcccaagtcagcactcagggaggtaaagcacccacccaaatttgcagagctagggactggggaagcctgcgacaaaactcctatcttctgtctccagaccttctggtactgtgtttccccaagagaaaggataggaaaggactggatgagaaaggaaagctaacatcatctgagagctagagaaaaataataaaaactcatttgtgggagggcttgggcctctcaggcccctgtgcagagggcaggcagggtctggggtaaccacaggtcagcccctgctgggctcctgcctcccagtctctcccctcaggcgggcccagggaagacgggtgagctgggattttcctcccagacagatgagccacttggactgcacaattcttccgccaccccactcacggccggggttcttgttcctggaaaaagagggaaagactgaaaggagctatttctgccggggccctgacctgcagctgatgagggtctcacagctcccattcacgtcccttcttctttgaatcagggcaccgtctctaacaggccccttttattttagttataatgttcggttttgcaattaaaaattatttttaatgggcatcaggatatttccttctgtctttgaatatgccttttgtttctaatttgtgcaactataacttcacgtgaacctcatggattctggcttaggcaagtggcttctatgtaattagcagtgattccatcttaataaggtcctgtgatctgacaaaaaaaaaaaaactacttgatacaagtatttatgtcatatatgcctgtatttaaaaatccattaccaaaatacataatatagaaagagaaggtcttctttgagtatttttatatgttaaatgcagtaacattttaaatctttattctctttattcagcaactctgtggtacaaatttatcttgttgaaattctgcctctcactataaatagtttagttatatttttcaaagttgttttctttatatccatactaatatttgtatctgtacctatctacatagaatatagctataatcttcaacaaaactcccatttgtcattgtgcaactttttgtttttcacttaacaatatatcatgggcatactcataggtccatgggaaatacagatattaatgcattcattttgagagatgcacatagtttaaaagcaagcctgtgccagacattatttaaccaatgtcagaaatgcaaaatgcttgttccccagtgccacaaagaaatagcactcgaacataaatttaatttcctcagcaaggcaatttttactttctgcagagagggtgctcctggcagatggaacaatggcgagagcacaccttgacaggggaggggaagaggttcttattcctgacacaggcagcctctactgctgcattgttcccctattggctagggttggaccgcatagtctaagctaattccaattggctatttgaaaaaaaagagcaggagcatgagctggagtgccggggtgagtagtttggtgggaaaggtggatacgaacaggtggctcaggatgagtcaggatggagcaggtgactcaggtcaaagcaggtgaccaggggaacagatgtgaactgattaggactggtgggaaagttgtttactgaaaccagaagcaagggggcgaagagatccaggaagttaaactttaaaatggagaatcaaagaataagagagctgaacatattgacatactgattctttgaagagaaacttggggttcactatatttaacaccaatctcctactgaggggcatttggactatttcccattttttagagttataagttatgctacaatggccattatttataaaatatgtttgtttttgcatatttaagtatttgtttccatagcataaattcctagacattgagttgttgagtaaagagaataaacatttaaaatgtcactgaagtctaaaaattcccttttaagtacatatagtgccctgggcggctgagaaaatcaaacatacaaacaacagaaacaacgttatttaattctagctaagtactcyggactggtygaggaagtatggaccctctttggtttattgagaaaagtcataagtgggtgacagagaagarttgaagacagaaatgcgccaagctgaaacattctccttggcataaccagaaacacccagaggacttggcaaggcaggaagcttcccacagtgccattcagtgctgctgcagctctactaatccatcatcccacatctagacagggcatcccacccgtcgggaaacccagccttccctcaccgccctgctctgccccagtccctcatggtgtagggtgtgctcctaccagtggtcccatcggatcctcacgattagcctgtgagaggagcctccagatgaggaggttgaggctcagagccatcaagtggcttggctacagtcactgcagggaggctcttgccttccagcctccctgctcctaccttccccgggggtgtctaggtccagttccagatctcagagtggccagcaggctgagccctggggtcaggggccagctgcctacacagaatgtggctcctggaatttcttgggtggtggggggggggcgggcttctccttgggatggggttctggggccgctctgggccatgaaagtttcccacagcttggaagaaaatctgccaccactgtgtaggggtctggcgagggaccattggcctggggcagggacctggggacatcacagaagccgaactgtctccctgtaccaccccctcccagctggctcttccctcacccacatgttcttggcatacaggtctgccctctccagcagctcccaccccccacctgctcagggctcctcgccttctcctgcagggcttcacagcaggctgcccttgcccagctcccctttgcagatccacagtctctggttttagattttgtgggtcttcactgcaggaactagaaaagtcacaaacatggggaagtaacacagtttctggaaaatcacagaattctaagtcccttttttcccctctgaagagacaagagggaagcttccacatctgaaaatttttctttttcattcttgatcttcctgaagcatagtgatggtcttggtgttcccttgctcaaacatcttcagtggctccccgtggcccagcaaagtcgagactccttcatggaatctttaaggccctccctgatctgattccaacctctcctactgcctctcccacatctgccctccaaggtccatccaccttgtgtgggccactagnttcctgacctctgcccctttttttggtgctnccgtcaccacctagaatgcccagtcttttatagctgaaggtcaaagtcttgctcaagcttccagcccagcaaaagctactttctccaagaagctttcctcattcttcagctgaaaatgatttctcttcgcattcctttgtctgtgcctcttatgggccctcayatctgttcagcattcttagcctcccataccctgtgcactcttacgcctccaggcctttactgtgctgtttctccttcttggaacattccttcctcctccctgtatctctcccccaactcctcacccttctcacttcctctcaactcagatagggccttccttgactcttctctccggtgatcccaggacatcttgcaactcccccagtggcctggttcctctcctggctctgacaataggctgtgagttgcagaagggagggaccacagcngacctgttcaccaccatgtccccagggccagggacagtgattgagaaatatctgttgcatgcccttcacctgcattattgtctcactggatctgagtcaatagccccttccccattttacataatgaagaaacaaggccttgaaaggccggggacctggctgtggttaggagtggggaatgaattcctggtctatctggctccaaagcctaggctgttcccctttaccctcgatcctcctgagagcccctgccattgatgaaagacagtggttgaacatgtgggctctggctctgggttccagggtttaaaacccagctctgccacttagctgtttaactccaggcaggttacttaccatctttgagcctgtctttcttcatctgtaacatggagtaattacagctttcccctaaggtggctgggagaatcaatgagatgatctgtgcaaatagctcagtccagagactggcatgaagagtgtgcccaatggatcaaccagaacagtccttcttcatgcccctgtgttaatgcaattattaatagcaccccttccagtctcaaaggttccaaattggatgacaaatcatgttaatgtccatagatgtcagatattatcagctgcactgtataacaccacttagctacttgccttacctcccaccaggcggtgaggtccctgcatgcaggaaagtgctctgagccttggccttcctgggcccagaacaaggcctgacacatgaagcatttgctgaataaattgcttttggagggtggagagcttctccttgctcttcatttattcattcattcattggattgtttatacatttcttcatgcatctggcattgactgagcactcatctgccaggcagggccaggtgtagagggtataaagaagaccggaagggagactggccctaccaggaaactcctgctgcagaacaaaggggtcagaatgacatcacaccaataaccactctcataactgtgcttctgttgacagcgagaagtgccaggaaactcagggagccacgagagactataagacagggactcagtcaggcaaagggaggcttatgggccaggtggaagcagaagtatgtggaacaggaagaaggagtgtgggggtgtatgcaggagctgcaagtgttcagtacagcagggagggtggatggagagagaagaggcagagatcagattgcaaaggcccctgtaagccctgctacagggtatggccttgatctgctctatggagctgsaatagtaatgggagcaaataccccatagtactccaattcagacactagagctcaatcctcaggcctagagataggtgtggtcgaacctttgtggtccagggtcaaagaggaaccagttgccaaattgccattattctgtctgggtccctggctcctagcttgggcccactccactctctggtggggaacctcctgggtcccagggcatgggctgcagttggggttaactgggcaggagggtgggggctaagctgtccttgacctggggtctggaggttccagggtccaggagtcaggcagggagatgaaaactaggctctcagtatgtgaagtgtgacatggcccacacatttcttcagagtttcctaatccttgggctgtcatgcaaactcctctcaaagttcctctgccacaggaaggggtaatgtcaatctgggattcctgtttgtcaccttcccggcagcatcaccaaggcttcctcagtcagggcttaccccactgagtcccatggcacttccccactctgtgtccactagcggtcagcacacccactgctgggggaggtcaggatcgccctgtgcagtgtgctggtcattagcgtaggctctgcagccaggctgcctgcttccagtctcagctctgtcattccctggctctgggactttgggcaagtgaactaacctctctgagccttggtttcctcatcggcaaaatggcgtaattaatagaatcagcctcatgtgttaaaagcactaaattagataaatatggaaagagcctgctgtggtgcctggcacataaacagcactcagaaaatattagggagtccagtgtggtggctcacacatgtaatctcagccctttgggaagccaaggcaggaggatcgcttgatgccaggaggagtttgagaccagctggagcaacacagtgagaccctgtctcaacaaaaagaaatagaaaattagtcaagtgggcggtgtgtgcctgtagtcctaactactcaggaggctgaggcaggaggattgcttgagcccaggagtttgaggcttcagtgagctgtaactctgacactgtactctagcctggcaacagaatgagacttgcctataaaaaaagggaaaaagaaaaaaaagaggccaggtgtagtggctcacgcctgtaaccccagcattttgggaagccaaaacgggcagatcacttgaggtcaggagttcgagatcagcctcgccaacatggtaaccccgcctctattaaaaaaaaaaaaatatatatatatatatatatatttttttttttttttttgagacagagtctctctctgtcacccaggctggagtgcagtggcacaatgttggctcactgcaacctccgcctcctgggttcaagtgattctcctgcctcagcctcctgagcagctgggactacagccacgtgccaccacgcctggctgatgttttgtatttttaggagagacagggtttcactgtgttagccaggctggtctccatctcctgatctcgtgatccacctgcctgggcctcccaaagtgctgggattataggtgtgagccactgcacccagcctctgtcaaaaatattaaaaaattagctgggcgtggtggtgggtgcctatagtcccagctactcaggaggctgaggcaagagaatcacttgaacccaggaggtggaggttgcagtgagctgagatcacgccactgcactccagcctgggtgacagaatgaaactccatctcaaaaaaaaaaagaacaaatgaacaaaagagwaaggattaggcctctaaatgccattttttccaggaggacagagtaccttcctactcacggggctttggcatacagcattcattcattaattcattcactcttcatacatctaaaatcagtggatcagaatggtcaggtatacctgtaccataggaggcagaaatgccctcaccagctgtgtgatcttgggaaagtgacttaacttctctgagccttggtttgctcttcagtaaaacaaggataataaccacacctacctctagagttgaggattcaatgagaaaattccaaagagcactgggcgtgctgcctttcacatagtgagcacctgataaacctttgaagcctgccatgcaaggaaaatgctgggatgcggttgagcccaaaaggcctgggatgcataataaggatacctgcccatctggcaggaacagggaggcttccaggaggcagcgagtctgaaggagctataggaattagctggatggatagaaatgacaggacaagcagcatcctttgatcrtggggacagagacaggtcctgccaaggtggcctaggccatccctcaggactactgtagcctccacccctcttgctggttatacccctcctccacctaaacatgttccaccagagaggggtctctgccagcctgggtcagggactyggtgagaattgcatgaaagctgggcaagatcacacacaaactttgcatccgtgttaggggtgcccaggtttcctcaaggccatccagggactytcaaaggcagtggcctcagccagagggagcatgagaatccgctagagagcttgttacctgtgcaggtacccccctcccacccctaagtcagcaggcctgggatggtcctggagtcttcattttaacagttacccctgtgattctgaggctggggtccctgaactgcacttggaggtgcacccctctagaggcctccaggccattaaggacccatggcctataggatcaagccctggcaccstgccaggttgtcaggtactcttagtacttggacctcaccccctttctactcccatctccactccattccttcacactctggttggccccagagagtcctgatttttcaccctctctgcccctatgctattccctctcctgggatttcctttctgcytgaagggttgctgctcctccttcaaggcccagctccaatgccactgctctggaaggcctcacagactctccatcttctgttccccagcgccatctgattgtgcttatgttacaacacttaggggcttgcytccaaatgtgttggactttaagaagttaatgtcacattgatgaccttgcatgttgttgatctgatgagagtaagggaggccagatgtgcttggagaccatgtcccaggaaagactactaagaaaccagagtgctcaccctggagaagtagtacctccggggaccacaagtgctgtctgcatcactggaggcctgtcgagggacagggaacagagctgcctgagggtccagagcaacaggtgggtgtcacagngaggcagatctgggccagatagggaagcatgggctaactgcttcccacaacagatggatgcaggtgacctgtcagaaatgcgccaaggggcacagggaatggtattggccagacaatccaagtagtggggagtggcgcccagctacctaggccttcgactcagaaaattcggattctggctctgagtcttccccaaagtagctgtgtgagctgagataagtcacaaaccctccttgaccttcctttttcttatctatgcaatagagctatgcacttcactgattgcctgtgacccaggcctgtatgagaaaatggaaatgaaagtgcctcgtaaacaataaatggctcagccttcctaaacaaaacatgaaacccagaagtcagaaatgaaaagacaacagatttgactacacacagtaaaaacttctgtgtgaatacacaaaccaaaagaacattagcagagaagtggcaaactgatggaaaatattttcagcatttctgataattgggttagcagacataatacagataacgaatagttcaataagctgggtgcagtggctcatgcctataatcccagcactttgggagaccaaggcatgcagatcacttgaggtctggagttcgagaccagcctggtcaacatggtgaaaccccacttctagtaaaaatacaaaaattaattggccgtggtggtgggcgcctgtaatcccagctactcgggaggctgaggcaggagaatcgcttgaacctgggagtcagaggttgcagtgagccaagactgcgccactgcactccagcctgcgtgatagagcgagactcggtctcaaaaataaagaaataaatagtccaatgaatcaataaagacaaaaaaacggacaaaggatatctgtagaagaaataccaatagccaatacacacatggaaaaaatgtttatttcatcactcatacagaaaatgcacatgaaacctcaacgaattaacattttttcctaccagactgcgaataattttaaagatcagtgatatcccatgtcagcaagtgtacggtgatgctgcatttctcacacactgttggtgagaatgcacatcctcacggccttcttagggnaacaatttaacaatatctccatgttttaacgtacctaccctttgacccggcgatcccacttctatgaatggatcctgctccaatgagagtgtatttacacaacgattcatgtgcaaggatgtccactgagcattgtttgcaatggagaaaaattagaaggaactagagtgtccatttgttagaggaatggtgagataaattatggtacatccatacgatgagatacagtgaagcaattttaaraatatggtaaatctctatgaactaatatggaaagatttctaagatgtgttgaatgattaaatagcataggatactatttttaaaactataaagtagggatgggatggatgggtggacagatggatgagctcgtctgtgcccaggcaaatgctaggaagagtatacacacactcttacaagcagttgaggcggggagagaggctgtgattaggwgaataagggtttggggggccttccatttatggggacagtgtatctctttatggatgaatatcttacagtgaccactagtattaaaaaaaaaaaaaaaagaaggcaaggaaagcaagcaaggagtgggaggggattgccagcaccgccactctctgcctgggtcccgtgacggctggtggcagactggtggacctgctgattgcctttgctgttcatttcttttcagatgcccttctttctcttccctgcctctgcctggcaaaatccaaccttcccaggcctacctcttcccttagctcactctatcagttagctgttgttgcatagcaaacaaccctacaaagctgcagtgacatataccaataaacacgtatttctctctcatctacagtattcagctgatctggctggattgctagggttttctcatgcatctggggcagctggggactctgctttaatctagccttggctaggataccttagccatgccagctgaggcgcgtctttctcatagtgatgttagcagcatccgcaggcaaggagaaacatgcaatgcctcttgtggcctaggcttgaaactggaacaccctcacttccatctcattctataggccaaagcagcacctgcacgaccaagcccagattcaaggggtggagaaataggtatcaccttttttttttttttctgagagcaactgctaagtcacatggcaaagagatcgggtactgaaaggaatgaagaattgggaccattcatgcgatctcctttggataccataaagaggggagagacaaaccacagaatgggagaaggcatttgccaccatgtaaccaagcatgcgtataattgtgcgtagctgtatttcacttgtttatttggtttatattatactattatataaatactactttttactattctattattgatggatatttcatttttttttccagtttgagctattatgacaaatgctgctatgtatcttagtacacttgtgcacacatttctattgcacgtatgcctgccagggagtagaatttgttggatggtaagatattgcattttcgtcaatctaagtaaataatgctaaactgttttcccaagtggttgtatcaatttatacccttaccagcagtgtatgagatttcctgttgctccaaatcttagccaacacttggtaagggagttcatttctgtatatgttgtatagccggaaatgaacagtacttttaaaaaataatggttagccacacggtgaaagcccgtctccactaaaaatacaagaaattagctgggcgtggtggcgggtgcctttagtcccagctactcgggaggctgaggcaggagaatggcgtgaacccgggaggcggaggttgcagtgagccgagattgggccactgtactccaacctgggtgacagagcaagactccgtctcaraaaaaaaaaaaaaaaaaaaaaaagkttagccaatgatcttaggttcacttaaaactgtctttccctcccccatccccactggttctatcatctgtcaagtgtccatatgatccatatctaggaatttttttttaagagatgggctctcactatgttgtccaggctggactcgaacttctgggctcaagggatcctcctgcctcagcctcctggataactggcacgggtgygtcccacagtgcccagatactacgatctttattttgtaccaccagtctatttgtctatctgtgagccaacatcaaactgtcttaactatctttataatatttcttgatatctattatagaaagacttcccttttttcattttctttaagactgtcttggttattcctggccctttacatttttttcccattgttttatgaaaatttaatttacacacaataaaatggaccctttttagtctacaattctgctacttttgacaaatgtatatagtcatgtttatcattgtcacaatgaagctatatttccatcaccaaaaaattccccaaccccccacccccctgccggttctttgaagccctccctccatctccagcccctggcagccaatgatctattttctatctgtttacaagagtgtcatatgagtaagatcaaagagtatgaagccttttgaatctggcttctttcacttagcataaagaatttgagagtcatccacatcgttgtgtacatcagaagtttgttccacttaattgctgagtagcgttctattgtatggatataccacagtttatttatccatttaacagctaagggacatttgagttgtttccagtttgagctgattacaaataaagccactaaaacatttgcttagagggccttttgtgaacatcaatttccattttacttggaatgcctaggagtaggattactcaattatggtaggagttttctttttaaagttatgaattatggtaaaagtttcctttttaactttataagatactgccagactgatttccaaagtggtggctcttttgcatcctgactaccaatacatatatgagagttctattaatagttgttcgtggccaggcacggtggctcacgcctgtaatcccagcactttgggaggccgaggtgggcagatcatctgaggtcaagagtttgagatcagcttggccaacatggtgaaacatgtttctcctaaaaatacaaaaaaaaaaaaaaaaaattagctgggtgtggtggcgggcacctgcaatcccagctacttgggaggttgaggcaggagaatcgcttgaacctgggaggtggaggttgcagtgagccaagatcatcccactgcactatagcctgggtgacaagagcaagactctatctcaaaaaaaaaaaaaaaaaaaagttgtttgtattctcatccttatcagcacttgaaactgtcaggttttctgatttttggttttagccatttaattaagtatgtagtggtatttcattgtggttttagtttgtattttcctaacaaatattgatattgagcatcttttatatggcaaattatcttatcatttatatatattatttgttcaatgttttccttgtttttactgaatcatttattttcatattgagtattgaaagttctttatatactcttgatataagtcctttataagatatgcaatgttgaatattctctcttggtctgtattttgtcttttaaccatctatttaaaagagtagaagttttaaatgttgatgaagtccaatttatagatttactttttaaggtaagccaagtgaaacagtgggagtggagaaggaacaaagaaacctgtaactggttgtgatcaatttgttgtaaacaccactgcactcagacagcctatttttttttcttttatggattatatggatctttttaaatgttgtgtttaagaaatctttccataaccctcaaggtcacaaagattttctctatttcttgtaatagttgtatggttttgcatttaggtctttgatccattttgagataattttgtataaggcttaagttagagatcaatgttttctatgtttgtttgatttttatttttttctttttgcatgtggatagccagttgttccagtaccactttttggaatgcctattctttattcatttaattacttttgcaactttgtcaaaaatcaattggccacatatgtgcagttctatttctggactctattctgttccattgatgtacatgtctatcctttcaccagtactatattatagctttatagagtctgtcaaccaggtagtatgagggcttcaactttgttcttttcctaaattattttggctaatctaattcctttatgcttccatataaattttagaatcagcttgtcaatttacacaaaacttcttgcagagattttgattggcactttgttgaatctgtaggttaacctggagaagaatcagcatgctcaaaaatattgagtcttcaaacccacaaacattgtatatctaaccatttatttaggtctcattcattttcttttctcagtgttttgtacacagtatgcagatcttgcacatatttagtaagatttatacctaagtgtttcatgtttttttcagtgctattgtaaatagtatttgtaaaaaataaatttcacttttaatctgatttttgatattgaccttgtattctgtgatcttgctaagtttacttacagttctagtaacttttttgtagattctttggcattttctatgaagacaatcatttcatctccaaacagagaccattatatttcttcttttgaactctttttctttcactttctttcttttttctttcttcttcttttctttctttcttttttctttctttcttcttctttcctttcttttccttctttccttctctttctctctcttcctccttccctacctcccttcctcccttctccttccccttccccttcccctttccctttcccttcccttctccttctccttccttccttccttccttctttccctttctttttttgagactgagtgtcactttgtcacccaggctagagtgcagtggcatagtccctgctcattgtaggctagacatcctgagctcaagtgatcagccttccaagtagctaggactataggtgtgcatcaccatgctaggttctttttaaatttttttgtagagacagggtctgcctatgttgcccaggctggtctcaaactcctggactcaggtgatcctcctacgttggccccccaaagtgctgagcttacattgtgagtcaccacacctggtctatttctttttttgccttactacagtgtctaggatctccagtacactgttgaatagttcagtataatgttgaacagacatccttgccttgtttctcatcttagagggaaaatatacaatctttcaccactaagtttaatgttagtggtagggtttttacagatgccctttaccatattgaagaaatttcctttagaaatgaacattgaattttgtcaaagcattattctgcagctattaagaagcctatgtgatttttaaaatcttgatatggtaaattatagtgcttgatttttgagtgttgaacgtttcaacctttaactcttataataaataccacttggacatgatgcattatcctttttatatatacttaaatttgatttgctaagattttcttcagaatttttgcatctattttcataagggatattggtctataattttattttcttgcaatatctttgtgtggtcatgatattgggatactgctggtatcatacaatgaattaaaaagtcatctctcctatgctatattcttaaacagtttttgtagaattggtattctctctttctttctttctttcttttgagatggagtttcagtcttgttgcccaggctggagtgcaatggcacgatctcagctcacagcaacctctgcctcccgggttcaagcaattctcctacctcagcctcccaagtagctgggattacaggtgcctgccaccatgcttggctaatttttgtatttttagtagagatggggtttcaccatgttggccaggctggtctcgaacttctgacctcacatgatccgcccgcctcggtctcccaaagtgctgggattacaggcatgagccactgggccaggtcagtattatttatttcttaattgtttggtagaatttgccagtaaaaccacttgaacctgaagagtttttttgtttgtttttggttagaaggtttttaactacaagtttagtttttaaaaatagatacaggactgttcatgttatctatttcttcttaagagaattttagcagtttgtacctttcaaataatttgtccattttatgcaacttagtgaatttgttggcatagagtagttcatagtattcccttattattcttttagtgttggtagggttggtattgatgtccactttccattcttgatatttgcaatttgtgtttttcttgttttttttttttttctcggtaaatgttattacttttttttccagtgaaaaagcttttggttttattaattttccctaactcttttgttctggattttattgatttctgctcgtgtctttatttccttcctacggtcaatttggatttaatttgttcttctttttctagtttcttaaggtggtagccttagaccattgttttcttatccaattcaaaatattttctaatttttcatgtgacttcttctttgactcttgggttgtttataagtgtgtttaatttccaaatattttcaatttcccagatacctttttgttaataatttcaagtttgattctgttgtgatgcaagaaatactttgcataacttatttaaacttttaaagatgtatcttaagtgatagaatatggtatatcttggtgaatgttctatatgcccttgagatgaatgtgtattctgcaattgttaggtggataaaaatcaattaggtcaatcatttacgattttattcaggttttctataaccttgctgatttgctctctacttgtaccacctacaactgggagaagggtgttacaagagatttttatatctctcctttcgggtctatcagttttgtttcatgtagtttgaagctctgttctttttttttttttttttttttccaatttgagagcaggtactgtttattaaccaaccagcttagaaaaataatcatggtagacaccttagttcattcttctaataagcctgttgatctggtcctccctgttgccagcatctccaccttctacaaaatgggtggtctttttcttcattccacctcgtggagaagacaatttgaagggccacaggaagttatttgcctctttgaagcgttttccaacagtatagatctcatgaatcaaatcctccatgcagatgatgccgtatttaccaagagatcgagcaatcaaagcgttatctgtcaaagcaattcgcttcttattgattttgccataaccacgcttgtagattagttcatttactgacttcagattggggtacccccatgcaatatatggctctacaatcctcagcatgttaatcgaagccttgttgagcttcacaaaggttccattgaagatttgacgaaggcgaagaagctgcaacacctttcgaacctttgggctcactccattgatacctctgattctgatgacaaacgccaatttgggttctgcaggtacatagaagttgccagcttttcttgccatcctcgccattcgaatttcagtcctgtacatctgcctatattccttgtgatagtgctttgctttttcatagataagcttcctccttgcctttcgaagcatcttttgggcaaacttctttctcaggcgcttcatcttcagctctgcgaaattccttcgctttttcttaagggtttctggcacagcaggaacctccttcttcttctcttctacaccctccatggttccagccggaaaaaaaaactgaagctctgttctaaagtgcatatacacccaggattgttatgtcttcttgtaaaattgattctgtcttcactatgtaatgtccctcattatgcctggaaatatttcttgttctgaagtctattttgtctgatattaatacagctactccaggtttcttcaagttttattttatttttgattgacacataataattgtacttttttttttttttttgagatggaatttcactcttgttgcccaggctaaagtgcaatggcttgatcttgggtcactgcaacctctgcctcccaggtttaagcacttctcctgcctcagcctcccaagtagmtgggattacaggcacctgccaccacacccagctaattttatacttttagtaaagacagggttttgccatgttggtcaggctagtctcgaactcctgacctcaggtgacctgcccaccttggcctcccaaagtgctgggattacaggcgtgagccactgtgcccggcctcaataattgtacatgtttatggagtacaatatgatgttttgatacatgtgtatattgtgtaatgatcacatcagggtaattagcatgtctattgccttaaacatttatgatttcttatggtgagaacattcaaaatcctctcttctaccatcttgttagatgttttctattcattctatctggtcttctttctttccatctttgtcttcctttggattgagtatgtattatgtctccatttcatttccactattggcttataatttatacctcttcaaaaatttttaagttattaaaaagagagaaaaatttttagggagtgtcctgggttttacaacttacatcgtaaattaatcaaagtctacctttaaatgataaaatgttactttaaatatagcatgagggccggtgctgtggctcacacckgtaatcccagcactttgggaggccgaagcaggcagatgacctgaagtcaggaattcgagaccagcttagccaacatggtgaaaccctgtctctactaaaaatgcaaaaattagccagacacggtggcaggtgtctgtaatcccagctacttgggaggctgacgcgtgagaatcgcttgaacctgggaggtggaagttgcagtgagccaagatcacgccactgccctccagcctgggtgacagagtgagactccatctcaaaaaacaaacaagaaaaataaatatagcatgaggacctgacaagagtagactgcacaccctttcttcccgtttttcatagtgcagtagttcccccttattggcaatttcagttacttgtgatcaatccatgtccaaaaatatgaaggtactttgagagagagagagagactacattcacgtggcttttatcacagtgtagtgttataattgtcttattgtattattagttattattgttgatctcttactttgcctaactgataaactttatcataggtatgtaggtgatatggtttggctgtgtccccacccaattctcaccttgaattgtaataattcccacatgtcaagggtggggccaggtggagataattgaatcatgggggcagttttccccatactgttctcgtggtagtgattaagtctcacgagatctgatggttttataaatgggagttcccctgcatatactcttttgcctgccatcatgttggatgtgattctgctcctcctttgccttccactatgattctgaggcctcctcagccatgctgaactgtgagtcaattaaacctcctttcctttagaaatcacccagtctcgggtatgtctttattagcagtatgagaacagactaatacagtaggtataggaaaaaaacatggcatatacagggtttagtactatctgcagtttcaggcatacaccagggttactggaatgtatcccctgtggagattgctgtaaatgcatatgtgaaagtgaaatgtatgacaacaatatgtttcacttttaatctgctataaatatacaatgcattgctactacttttgctttaaatcagagattggcaaactatagcctgtggaccaaatgtagcctgcctcctgtttttgtaaataaggtatgattggaacatagcgtgctcaatagtttatgtattggctatggctgcttttgcactgcaatggcagaattaagcagttgccccaaagaccgtatggccacaaaacctaaaatacttactatttggtccttgacaggaaaaaaatttttcaatgtctgttttaaatagttatcttttcaagcatttaaaaagcaatcatattttttatgcttacctttattccatttccagcactttttattttttaatgtatatccaactttctagctggtatcatactccttttacctaaagaacttcccttaggatttttttttttttttttttttttttggtagtatgggtctgctggcaatgaattctcttagtttttgtttgtcaaagataatctttatcccttctctttttttgagataaaattcacataacataaaattaaacattaaccattttaaggtgtacaayggcatttaggacaaatacaatgctgggcagccatcacctttatctagttccaagacatttcatcaccccaaaacaaaaccacctcctcataagcaatcactccccattctcccttgccacatcccctggtaaccactcgtcaaccgtctgcctctacaggtttacctgttctggatgtttcatatagatggagtcgtatgacattttgctactggcttcattgacttaacacagtgttttcaaggttcatccacagtgtagcaggtaccagtatttcattccctttatagctgaataatattcaattgtatggacacaccacattttgtttagctgtcaactgtttccaccttttggctactgtaaattgtgctgcgttgaatatttgcgtgcatgtatttatttgggtccctgttttccattcttttggttttacctagaagtgatatttctggatcatatgacaattctatgtttaactttttgaggaattgtcaaactgattaccatagcagctgcaccatttttcattttcaccaacattgtacaaaggttccaatttctccacatcctcaccaacacttgttatccgattttttttattatgatgatcctagtagatatgaagtggtatctcaaggtggttctgatttgcacttccctaatgactaatgatattgagtattttttcatgtgctctggagaaatatctattcaatgttttgcctgttttttaaaaaaattattttagactcgggagtagatgtgcatgtttattacatgggtacattgcataatggtgaatttggcttccagtgtacccagtacccaaatactgaacactgtacccaataggtaatttttcacttcctttttgccctttcccctttccttctatccttccacttttggagtctattctttccatctttatatccgtgtggaccctttgtttggcttccacttataagtgaggacatgcaatatttgaatttgcctatttttaaatttaattgtttttttgttgttgtaggcaacactacaactttcattcttttttaaaatttattttcccataaatatttattaattgtgagggacaatagagtggctttagctacatattgcgtgattctacatacattctttagctacacactgtatgattccatttatatgacattatcctgtaaagcacaaagacattgtggaaaaggcaaaactgcagggatggagaacagatccgtggttgtttggtgtaaggggtttggggagggctttactataaaggagcagcatgagaaacattttctagagtgatggagctgttctatatcttgactacagtggtggttacattgttatatatatttgtcaaaactcatagaactatgcaccaagagtgatttttgctgaggaaacactacaactttcattctgtatatattctggatatatttatttattgtggatataaatattcattctgtgtgtttttattctcttgacagtgtcctttgatgcacaaaaatgtttaatttttattatgtccaatttttctttggttgcttgtgcttttagaaacatatctgagaaatcatttccaattccaaggtcatgaatattacctttatggtttcttttaaggttttaataattttagcttttatatttaggtctttaattcattttgagttaatttttatatgtgatgtaaaataaggattcaacttcattcttctgcatgtgactatctagttcttttagcacctatgttgaaaaaactggtcattctccattggatggtcctgccacccttgttgaatatcagttgtccatgaatgtgagagtttacttcctgactctcaattttattctattgatccatatagttattcttatgctgataccacactattttgatttctgtagttttatagtaggttttgaaattgaaaagtgtgactcctccaagattgttttgcatattcaatgtccctcgagattccatatgaatttgagaatcagcttttccatttctgcagaaaaaggctgttgggattttgatagggattatattgaccctataaatcagtctcactttgagagtaccgctgtcttattaaatcctccaacttatgaaaacaaggtggtttttcatttattaaggtcttctaaatttctttcaacagtgttttgtagttttcattgtaaagtcatgcatctccttagtttattccaaaatattttatttttgatactattgcaaattaaattgttttcttaatttccttattggagtattatcagtactatagagttacgtatgttgatcttgtatcctgcaggtttgctgaatttgtatattaactctaatagttgctttttgtagatcttttaggatttatctatatataggatcatgtcatctgtgaacagagatagttttacttcttcttttttaatttggatgccttctgtttctttttcttcctgattgctctggctaggacttccagtactatgttgaacagaagtggcgagaacaggcatctttgtcttgttcctgatgtaaagggaccagctctcagtcttttaccattgaattagttgtgctttttcacatgtgcccttaatcacgttgaggctgttcccttttattgctagtttgttgggtgggttttgttttgttttgtttttaatgaaagcatgttgggttttacagttacatcaagtgacatgatcatatgaggatwtttttcattctattaatgtgatgtattaccctgattttcatgtgttaaaccactgttgtatttcttggacaaatcccacttcatcatggtatataatcattttaatatgctgttagatttggtttgctggtggctgggtgcagtggctcacgcctgtaatcccaacactttgggaggccaagatgggcagactgcttgaggtcaggagttcaagactagcctggccaacatggtgaaaccctgtctctactaaaaatacaaaaattagctgggcatggtggcgcatgcctgtaatcccagctactcgggagtttgaggcacgagaatagcttgaacgcgggaggcagaggttgcagtgagccgagattgctccactgcactccagcctgagtgacagagtgagaccctgtctcaaaaaagaaagaaagaaagaaaaaaaaaaaaagatttggtttgctagtacatttttgaaaatttttgctttctatattcatgcatttgtattggtctgtagttatcttttctggcaatgtcttggtctagctttggtaccagaaaaatgctggcttcatagaatgagttgaaaaggattggtattaattcttctttaaatgtttgggagaattcaccagtgaagccatctggtcctgggctttgctttgtcgggaggtttttgattactgattaaatttcttttcttgttataggtttatttggattttctttttcttcttgagtcagctttgattgacattcatgattgctaaaggttcaaaacacttttctgaaaaagaaagtacatatatacactcataaatatacatacaaacacacacatacacaccacacacacacctgagtacaygggaatgatcattttcctggatcaatgttatatcaggatttttcaatttcaagaaggaactttaggctgggtatagtggctcatacctataatcccagtactttgggaagccaaggtatgcgaatcacttgagctcaggggtttgagaccagcctggacaacatggtgaaaccccatgtctaccaaaaatacagaaatttgctaggaatggtggcacatgcccctgtagtcccaactactcaggaggatgaggtaggaggatggcttgagtccgggaggtggaggttgcagtgagccgagatcacactactgcactccagcctgggtgacagaaccaaaccctgtctcagaaaaaaaaaaagaaaaaaagaagaagaaatgaccatgttctttagagataagaagtaaaatactaagcgaatcaactaaaagaggtaaaagcaattgcctccaggaaaagagggagcaaaggaatgctatatattttaagaattatgcagaacaattagattctttgtaaaaataaataaacaatgtaagtaacgcacaaaagatagttttataaccagactgctgggatccaaatcctatctccaccatttggtagctgtttgactatggacaagcttaaggcatttgatctctctgagctttagttttcccatctgtgaaatgagaatgacaatagtacttacctacataaagttttgcagtactaaaggagacagtgaatgtaaaaggtttggctagtaaatgtcctgtaaaaggaagcttattgccaatattatcaggctctcccagaccaacctgtatacaggaagaaaacaaactccgtttctcctatagtctcacaacacaaaatacttctgaccccagatgtagaggatggggcatatttccccatacaccaagcaatcaaccaattgttcagattctgcagcagacacgaatctggtgccctccgattcaatttgaacactatatttacctagagataacgtcagatctcacagcttgaaggcttgagccaggagtttgaggctgcagtgagctatgatcgagccacagagctccagcctgggcaacagagtgaaactgcgtctctaaaataataataataaatttttaaaagatatgcattactttggagattccaaggattttaggagttgtaagccaggacatcagggtaaagaaaaaatatatatgtcacaatatcatgcaacctaacttctctttgggatctgccagagccacctgatcactctgaagaccctcatttgtgctactgactaacggtctggctgctcttggacatgtctcttctcccaagaccccttgaagatggctttagaagggccccaaacttagctagctccccccaagctcaggctggccctgccccagactgcgacccctccctcttggrttcaaggctttgttttcttcttaaagacccaagatttccaaactctgtggttgccttgcctagctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtaagagcagaacggggggtgggggactttgttggggtgtgatggagaagacccctgtgaaaggattcagtccttgcccctcactgggtgtcctcaggctgttttagtctccccaacactggactgcaggcttgtgggtatctgctttggagaggtagtggggtgaaaagagatgggtgtggtggaactggtccacctggtgctgtggatctgtcccagctctgccagcgactcactgtgtgtcctgagcaagcctctgatactcttgaggcttcagtgtccacttctattcaattgcaggtgttgggggcagggggacagtgatagactagaccagagcagtgcttttcatactttcctgtgcatacaagttacctgaggattttgttacaatgcagattcagactcagtcggtctcaggtgcgacctgagattctgtatatccaacacactcctgggagatgtgagatgccggcactgctggtccagacctacactgagttgggaggacctggagagctcctgatggctctggcagctctgccagcctgtgattcgatgattctatgcaagatctgatttggaagggcctgataggggtggtggttcttccttgggtggcttgtgtaaggggtcagaggggagagacaagaggttggcctctctggcccagggctcaggagaggggaattcggggtgaaataggtatagggctagaggagggattgggaagaggccagtgagggtctcctggaccagagccctcccagacacaggctgccaagtctcaggaggtccccaggctgtagcagttctgcagaatttccatctgggagggaacatgactagaggtgaggggctgctgtgcttggcttgttggcccaacaaacacatttctattgcctgcttattcaaagggaccttgggggaggatggggattgaaggggagaaaggacagcctcatactggcctcttcacagaaggaccctaaggccgtggcgcttctggtccctgatgaggaggagatggcccactgaccatccttctctggcccaggcaatcacactgagcttgagtatttgggttttttttttttttttcctgagacagagtctctctctgtcaccaggctggagtacagtggcacaatctcggctcactgcaacctccacctcccgggttcaagtgtttctcctgtctcagcctcccaagctgggattacaggcatacaccatcatgactggctaatttttgtatttttagtagagatgggatttcaccatgttggccaagctggtctcgaactcctgacctcaggtgatccacctgccttggcctcccaaagtgttgggattactggtgtgagtcacggcgcccggcctggacttcttattttgcaatgtaacttacatgcagtagaaagcacaggttcttaagttcaatgaggtctgacaaatgcacacacagtgtacccgccacccccttcatctcagagagtcccacaggtttgatttcactgccttgtcctatccttacacccacaacctgcctgtggggcaaaaacggaaaagtatctgagccaggtctcaatttaattttattttttttattgagatggagtcttgtggccaggcatggtggctcacacctgtaatcccagcactctgggaggccgaggcgggtggatcacaagatcaggagtttcagaccagcctcgccaatatggtgaagccccctctctactaaaaaatacaaaaattagccgggtgtggtggtgggttcctgtagttccagctactcaggaggctgaggtgggagaatcacttgaacccgggaggcagaggttgcagtgagctgagatcatgccactgcactccagcctaggcgacagagcaagactccatctccttcctttctttcttccttccttccttccttccttccttccttccttccttccttccttccttccttccttccttctttctttctttctttctttctttctttctttctttctttctttcttttttctatctttttgagaccgagtcttgctctgttgcccaggctggagtgcaatggcatggatctcggctcactgcaacctccgcctccggggttcaagcaattctgccactcctgagtagctgtgattactggtgcctgccaccacacccagctaatttttttatttttggtagagacagggttttatcatgctggccatgctggtctcgaactcctgaactcaagcgatccccctgccttggcstcccaaagtgctgggattacaggcatgagccactgtgcctggcttcaatcaatttagaagtttattttgccaaggttaaggacatgctggcgagaaaaaaacatggagtcacaaaaacattctgtggtctgtgccattctggatgaattcgagggctttaatatttaaaggggaaagtgggctggaggggaaaaggggaggttgtggtaatccacatgttgcaaaagaaaagcagcaggtaggggaacagtcaattatctcggttcagtaaattggctctttacatagggaaagtgaacatagaggagctgcctgtgggatattttaccttttatctgtcgctatctgcttaggaataaaaggcaaggcagcttcttgcatgactcagtttccagcttgatttttccttttggcagagtgaattagggtcccragtttttattttcccttcacaggggcatggtgtgtgggaggggggccagatggttttccagggtccagtcccaagagaaagaagagatggggaggctggaaacctaagttttcagcccaacagaccaatgatgagtggatgaggggccactgtgaggagactggggatggtattggaggaccctagagagagaggggggctctctcttcattactgcgatgagatcctgggctgaagaggggctgtgtccagccttagtgtgcaktgtgtgtgtgtgtgtgtgtgtgtgtgtgtgtgtgtgtgtgtgtgtgtgtgttgggagagaagagtagagattggggcacattctggaagtgatgagggaggggcttccaggcaagtgggagctagtggagaggtgtggggcatggggagaattggggagtggagatgagaggggggaagaatggacaggcacagaaggggacctcagttaatgttcataagcccatgcccccaccccgaggaggatgggggccaagccggcttccttccctgctagccaagccagcaggggaagttggctgcggaagttgcgggtatcagccttatcctgcgtgaatacctgggacaataggataggacaaaatagggcagacaccgctccctgaccacatttcctggaggccaaggcagggtctagagagacaggctgggggaagggatgggagaagcccactgtaaggtgtgaggcaggtgtaaaaaaggaacaaatggaatcacagaatccaaggttaaaatcttgagcgatcagagttggcccagaagggacattagaaatgtagcaattaaagcaggtgcccagggcaggagtagttctatacatcatctcactcaaccttcagctgaagtttttggggtgggagctgggattattcccatcagacagaagaatagcctgaggctcaaagaggttaagaaactaacccagctggtaagggaagaaccaagatccaaacccaagttggtgtgagcccacactccaagctgtttcctgctataaaaccccggcctgggggccctagattgctgcagcagtgatagggcagccccagctctgttgagatttgctaaaaaggctgctagaaatgacacttgtccctcttcctggcagttgcactgcataggagggctacaaccccaggtggcaggcttggcagtattcacaattcactcaatcncgtttgctgatcagagtcttggggagaagggatgcacattctgatgaatacaaaatcaaaacgtgaattaagccatcctgaaaggacttgagagaggaaacctttccaattctgggctctatggtggggcagggggaatttccatttcaagggggtttgcagagaacaatggagataccctgaattcaccgaaagccctcggggctggcctgtcattgtgcccccatcactgggaagaggaagggccagagctgaggagttggatggccagggtcagccagtgggtcagcgtcagagcccagcctcacagctgccccgcaagtggcactccctctccctgcctggagagaggagagtggctaggaggctggggaagcagaagtgagaacatccctgtagaagggccacaggctgagcggaaaccgggggctgagcctgacgccaacaatgtgtttccgcccacacaggctgggggkcgcctggcagcccctcggaggcttgaatcagctctcacttccctcctttgcccctattttaggccctggaaaaatgctgacgctgcagaggcaacgggccttcttcccggacagcctgataggggtttcaagttctcttttctccttcaagaaaattttccttaaaagagattggcttcccagtaaacacagatgtgtgggggtgccggggtgagctgctgggtgtagactaggtaataaacatagtgactaactcttactgagccatttatttggtgacaggtgatgttctaaagtcttcccatgcatttaaaatgcctaacataccaatgagtgggtacgatgattgtccctgttttataggtggggaaactgaggcatggcacctccccatcccactgtgctgcagaccagatgtccattggtgggagcgggcacaccaggagattcttgggacctctctaactctgctgggctaagatcctacatctctttttttttctttcccatatgaattaagctgaggacttggccgtgaacattccattcatttgtttcttcattcggtggtagaaatacntccactttgtacacagggttaaaagagtcyattcctggggagtagaaagatggcatcacagcagggaagactgaggcaggaggctgaggaccccagggggacagaggcctgggtgagaggctgagcaagctgcaagccccctttctcagaggagggacctcctggacatcagagacatcagtctgtccctgagcaggttgagggttaggagctgagcaaatgaccagggggcaggggctcgttcaaggtggtcccttgatggcacagcaccatccctgccaagctaccacccatctcagagtcaggacggcccaaggggcgcatcytagacctcacttctgtctgctgtccctctctcccaccaggtcagggaatcccagtgatagagcccagtgtcccygagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccayctctatgtcaaaggtgaggagtctgagcctcctcccaagaggcctgacccggcaggccccactacaatgggccctaaaattaacaatcgtaacaattcagctctgcatttactgagtgctggctatgagcaaggacctggaagagctgctaatgtaatgcagtcctyacaacaaccctgcaagtcgggtctatgatgatgcattttctagaagtgcagggaggttatccraggtcacacagcctcacatagtgggactagactggagcccaggtgcgcctgactctggagccaccacgctgaagcatccrctgaactgtcctggcgtggtgtgacctcagatgaatgatcagcctctctgagcttccttgtcacctatgtccaggtactccttggcccagtggagggagggcagttgtaaccctgtgccctcctctactctagaccctgcccggccctggaacgtgctagcacaggaggtggtcgtgttcgaggaccaggacgcactactgccctgtctgctcacagacccggtgctggaagcaggcgtctcrctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaaggtgcgtggggcatggggaccggcagccaggcctgaagagtrgggacagagagccggcggccacatgggtggtgactggggactgggtgtgatggggggcagtgggatgtcctctttctttcacttcttcccctcaatggttccacgatcatctatggggcaggactgacaaggtgtcggggcagggagacaaaccacatgtgagcaaataactcagtgggcaaggtcatctcaygtcattggacatgctacaaaaataaacattcaacatggtagctgaataaggagtgtgtagggcggggagcctcactgagaaggaaacactttattagagcggaaatctgaatgacatgaagaaggtggctgtgcaaagatctgcttcagcagggggacagtgagtaccaagtggtgaggtggggacaggctctgaatgttctaggtatggaaagaggacggaagctcagcctcagacatggatttcccactgggggcctgcctaaggccargtgctggrcatgtgtaggagggatgctgagccaagaggcagggaggagatggtgggtgcgtgtgatggctctcgcggtggccaggtaacagtggaggtggagtctcaccctgctgggatggcaggcaggattctggtttctgggaggactggtgagagcaagcaggaccccagcctgaggacctgggcttgagacagcaatcagtccctgtaacragggccagggtcagagtgaagcagctagcccaatgccactgggatctgaagccactaaacctgccyagggggtcaaaggaccccagctgtgtgggcagaggaggccattagggctctttcctggcatttcatcctgcagagccctgggctggccaagagccaaaggtcctgggccctagttctgccttgacnccccctcagggaccttgggtgagtcctttcatgtccctgggccttaggaatctggattagattatctttcaacagcagcaatgggcataaatatgaattcaaggcctactgtgcatcaggcatcttgctggctgctggaatattcctgtcacggatttgacattcgactagagtctaactattaaatagaaagtaaatacaaatgtgatgagcaagaaaccaagctggggagtggcgggcatggaggtgctggggaggctaattcatatcagctggtcacagangccttgctgaggaatttttgagctaaagatctgaaggatgagaacagcctcccatttgaagtgtgggaggaaaggcattccaggagggaaaggtgggtgcaaaggccctgtggtaggaaagaggtccagcgggctgcagtgcagtgaacaaggggtggggttatcagggcggtcagaaacaggttgggctgtggaaggactttgacttcttttctgagagtaatgggaagccccaaatgtttacagaggagagaggcatggtcccatttatatttgtaagaggtcactttggtgaagaatctaggtgtggggggcttggagggaggcagggaggtctctgaggaggctggtgcagaagtccagagtggagaatggtgacgggactggggaggggtagaggtgatggagaaagtagactttccaaggtctctttaggacaggccttgcagtggggggactgggagcatcaaggctgcctcccaggatttgggatggggcagtgatggggaccctggcctgtgtgtcctggcccatggcagggaggagagcaatatctctatcatgttcagggagcctgggtgttcaggggtctctcccccggtctcagtcatcccagggcccccagccttgacactggtgcctgcagagctggtgcggattcgaggggaggctgcccagatcgtgtgctcagccagcagcgttgatgttaactttgatgtcttcctccaacacaacaacacyaaggtcagtccctgcagatcacaaggtgaagtctggccatcctcccagcacaccaggtttcccatggtggagtcctgggcccccaactccaaactggctgtcttagctgaaggcacagctcagactccagagaggggtgcagactcacccgagatctcactcccagtcagtagctgacacagaaycaggactcatgcttgtgccgctgaactttgtgggggtgggtggggggaggtggttctctgtcaccttgacacatggcctttgccccagcctttagacaaaagccagaggtgagctcacttctgatttagcaagggtttcctaggccaccattgaagcccaggaatataacagctatttcagaaagacattgggagagagggaggaggagggaggattccaggagggactcacgttgggctgcctctaagagccccctcccttcccactgcacctgccgtgttccagacacagccctaagccacttgcatgcatatctcatttactcctcactacagtcttggggcagggagccagtattagccccattttacaagtgaagcaacaggctcagaggaaaggcagatagtaatccttaaaggctgaggattggaacccagatctttctaatccctaaactaccttggtataacatctccattccttctggctgcagctckcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtaggtaagcatcagggtggtggtggacagtnggtagggatcctgcaggagtgtgagcagaagggttttgwkgaggaagctgatgtcagggaaggagacctgctgaggatatctctgctggagtttgtttatccaaggcctggctaaggagccactctccaggagctttcccttaccctctcctgggatctctctcccatcttggagctcttacagtgcatggctgcattgggtgcaccttagtgccattttttgtttatttggggattggggtccagtagctccctactggacttcatttgttcattctttcatgcattcctttatggaaacatgaaaagacaatgatcacccagtgattatgggggaagcacaaggtgtcctgggaacactgaagagtccccccaacccaggcttcgagaaggtggcctctaaactgggatgggaagaatgaaggtgagttggccgggcagaagggtgggaaaggaaggggaacagcgcttctggcagagggaggaacatatgcaaggctcaaaggcaaagagaacatagatcatttggaacactgaaagaacttgacaacagctgggatgtggagtggtgtgaggagtggccacaggggagcagaggaggtggcagaagccggaggtaaaggtgtcttaaagtgagaaagaataactgcatcttaacctattgggaggtcattgtaaagaggagagtgatggggtcagattgtacagaggaggcacttcgtggtggtcaggagcacacactccagggcagtgttccaacctgagtctgccaaggactagcaggttgctaaccaccctgtgtctcagttttcctacctgtaaaatgaagatattaacagtaactgccttcatagatagaagatagatagattagatagatagatagatagatagatagatagatagatagatagataggaagtacttagaacagggtctgacacaggaaatgctgtccaagtgtgcaccaggagatagtatctgagaaggctcagtctggcaccatgtgggttgggtgggaacctggaggctggagaatgggctgaagatggccagtggtgtgtggaagagtctgagatgcagggatgaggaagagaaaggagataaggatgacctccaggtctctggctatggtgattgggtgcaggcagtggcagtcactggactcagaccctgaagcaaggcagcagctcatcggagtgngagcaggctctgagacatttaggtctggccgtgcctcatgtgttgaatgttatgggagatggaggtggcgaggagcatgagaatcatgagcatcactgcccctagagtatgtgcaaggcactggacttgcagcagattgtgagctctgctgtggaccccaatctgcactgggagctttggcagggtaaaggggaagaagagcaaaagcacaagaattcagttacggcttctaatcctgtctgctttctagtacaggcatacagtcatcactcaagaaatgtttatgttcattcacactttgggccagacactgttctagacatcgaggatacagctgcaagtgaaacagatacaacaacccccgactcatgaagtgtgtgctctagctgggagtgggcaagcaatgagccaagtaaattattaaaaaaacaaattatatagcatttgcagcttcagatagggtgttcaccaaggaagatctcactagaaagctgatatttgagcaaaggcttaaattgctgaaggagcaagccatgcggccattttggagaagggagctccatcctgcagngggactgtgcttgccatgttcaggggacaagtgggccagtgtggctgnggggagagagtgagaaaaaaagtggtctcagatgaggtcagagagctaaagtgggaaggtgagatgaaaggaggctaccgcagtggtccaggctggagctgatggtgggtggactagagtggtaatggtgaaggcagcaggaagttgttggtgtttggatggatgaatggactaatggatggatgaataatagatagatggattgttgagagagacagagaagagaaaagccttgcccccaaaagctcacagactacttggagagagaagaaagctacctggagggagaaccagatgcatgaagcagtgcagatgtggtgcctaatgagtgtgtagtctggaagggcagcaaaagtcgagtggagtgagaggttcctgtgtcctggagcactgagtagagactccctcatgggggtgaatcttaaaggataaaggggcctctataatgaaaaggaggaggatgggatttctggtagaggaaattgcttgagcaaaacctccaaggttggaatgactatggtgtgttcagggatgttagsagacccagatgggtggagcgttgagtgtgtgtgtgtaggaaggaagaggggaggtggctggatgagcacagtgagacctgatttgattgagagccttgaacgccacgctgaataatggaggcaatgggackccatagagggcttttgagtagacatatrtcagtgtagaagggtgaatttcagatttttagacagaatagagtaaggagaggagctcttagaaatcatctagtccagggcttgtggcagagccctgaggttttaagaaggcatgtcaggggctaccatgacaggcacggagaggctgagtgaattggggttcttgccacaattcccttgcctgagattcaacaagagcagctgtattacaatctgtgcaaaatgtcattaggagaaactagttagtagctgggcgtggtggcatgcaactgttgtcccagctactcgggaggctgaggccggagaatcgcttgaacctgggaggcggaggttgcagtgagcagagactgtgccactgcactccagcctggatgacagagcaagactctgtttcaaaaaaaaaaaaaaaaaaaactagtcaggactctttcagatacaagtaatagaaaccaactcaaactggcctaattaaaaggatttttttccttatagctaaaaagctcatggatatcagcttcaggaacacttggatccaggtgttcagctgatgctggaaagaatctatgactccccaactctcagccctgccaggaaggctttccccttgtaggactccgactatccgccttgtagtatctgatccagcaacaccagtaaaatgagggcttctcttttcccagagtcttaacaaaaatcatggaattgagtgttatggactcatggattcatggtaacccaaaccaatcaccgggccagaggggacagagtaccctcactggttggcctgggttacacacctactccagagctatatttggaagccgcattgactratttatgaccagaagaaagggaaatggatgaggacacgtgaaattgtgtgtgtatgtgtgtgtgtgttttcttgctgccaaaaatttttcaaaaacttggaaaatcacagatatattcaatctcttcattacacaaataaggagatggaggcacaaatggggatagggatttgcccaggttctcctagggcttcagtgagaaaagttttgatccagggattctgaagggggtggtgagaagaggggtgtcagaggacctgtcttgggtggtggggactatgtacctgtgacatagctgctcagggactggatcaatgggtggatgacaaaatggacaaataaacaaggacatcttcccactaatgccagatgcttgtgtgttctgctttccagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggtaccacttatcagctcccgtctacacagcccgacaaccagatggggtatgcttcagcaagcatcaggacgcttggctcatgtcccaaccttggtgtatgaccttgagcaagtccctgcccctttctgggcttcgctttccctgacttcatggaatcccaatattggtcatctgtgtttgagatctagatgaaattgacctacctctccatcccacatccttgggatagtcaatgccccacccaaggattctaccatttcttgggagtgtgcattctcattggtccctcaagaaccctcagcctcattcattttcctctcttggggccaatccaaatgcagaaaacagccccactcatagacacactcctgataatgactgcacaagttatctgctacatacaaaagcttggagggaggggaagagggaattaagatcacacaatcacagatacatgaaatgttctttaaaggattgtgatcacccagccccaagaatttctcactggctgctcttctctgtaagctcaaaactcttcccatgaagtgcaatctataataactccacacccctcttcttccgtctctccactcccacaatcctgtgtattccacacacattttagaaatctttttcctgtctgcttgtgaactgtgttcttggggtcttgctttctcatccaaagtggcttaagcaggtaggttctaaataagaaagctttgtgcctaagaggaacactcataccaggtatatcaggtattaactcaggtattaaaatagttccttcttttctttctttttattattttttttagatggagttttgctcttgttgctggagtgcaatggcacaatctcggctcactgcaaactcggcctcccgggttcaagtgattctcctgcctcagcctcccgagtagctgggattacagatgcccaccaccacacccagctaatttttgtatttttagtagagacagagtttcaccatgttggycaggctgrtctcgaactcctgacctcaggtgatctgcctgcctcggcctcccaaggtgctaggattacaggtgtgagccatcgtgcctggcctgaaataatcattcataccctgccctttcagagggagacagtacagcttaagggcagcgaatacgtggtgtgcatgccacactcactctcattcttgtttctgcaactctgttctgcagagtgtagatgcggcctcagagtcctcctcaacacaggtcccaggcagtatttccagcatagttggctcatgagagatctgtttgtcatccctgtgtggatcccttagacaacttcaaaactctttgggattctcgttctagctctggaagcccaaacctcattgattcccacaatcttgcttgtcaattgtcagaagcaacaaggatgttttcttgtcctcatcttcctcctctcagttcccttctggtcctttctggccaggtctctgtcttcctctcatttaaagcagaagttctgaatctggaatgtgtaggccctttggagggggytggtccatggatcggtttaatgggtccataagccacagagacattgaggaaaggaacacgagatcccctaaaacacagtagtctgggcccattcagcacaaggcagacaagcctggacaccaaacagccacagaattttagttcatgtgatgggttgttcataatggtgactttcaattatccaaaaaagtcaaattatttttagttaaaggggttagttatctcaagaagtgacctgggcagaggccttgtatatgcccagggtctggctggatgagactgctctctgaataccatagattttagtctagtagtagctgcagacatttcccaagcaagaactggccatttgctataatttttaaaattttatttattttgacagtgaactgggggactttttaaaaaatgtatttattacytaaacaacacatgttcattatggacaaattgtaaaatagagattaaagaaagaataaaacaaaaaatttcccagaatcagccaaagatgatttttattgttagtttttgctccagggccttttctgtaataaagggtaccattgaattgagtgcccacaaagattcaacttctgtgtcaagcaccctaaaaaggtcctttaatcctcaagccaagcctgtgaattaataaccatcgatatcactctcacagcaaaggaagtgagggatcagagaggttaagtacttgtctaagatcacacagccaagaaacagcagcaccaggacttgaaccccagtctctgcagcaacatggctcagaacccagggccctacatcctgcctcttgtctctttctcagtccctcttggcaaggttggcacttcagggatttgtagcagggattgcagctttcatgaaagcttagtccagtgacagtggtcaacgtaggcgacctgtgataggcctcccagcaccttgaagacatcacctctattaaacctcgggaaaaaaacactttcagataagaaaaccaactaaggaaatgggattggtggtttttgcatgtctcaatggcaccctgtctgagtatctggcttacccaaggccgttgggccctgaatattttaccaaaaataaaataaacccctttaaggctgttatctgactgcaatcctggcaggggccatactaggctrgggctcaccaacaccacctgattctcycctgcaggcrcaccttcaccctctctctgccccgcctgaagccctctgaggctggccgctactccttcctggccagaaacccaggaggctggagagctctgacgtttgagctcacccttcgatgtgagtgctggggccgagcgccacctggggcggaggccctgggactgcctggagggatggggttgactggggcagggcacagggaagtaggtactgggagattgggaggtggcggggaaagtgtgacttggggcctcctcctttcttcctcagaccccccagaggtaagcgtcatatggacattcatcaacggctctggcacccttttgtgtgctgcctctgggtacccccagcccaacgtgacatggctgcagtgcagtggccacactgataggtaagtgggctccactcacctccctcacctgggctcaggggctgggcaccctgtgagtgggagggacatgctggcgctgggaaccctgaagctctgagccacattctgcttttgccaggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggtgagagggagccttcgcacccgcaccgcccccccgcccgccccccgcccctgctcctttaggcggctcctcccccaccccccaccgagggagctggggttggctccacctttggagcagatcctagcagtaccaaggtccacctctctgggccagtccaagcccctcctgcctggcaggtcccccgaagcagtaggacggggtagtctctgagaaagcagagagaaagcagcctgaagaaactggcccccactcttgtccctgcactctaactcatgcatctattcacaagtatgtgcaggcattatgcaccgtgtgccagggacgtgccctatgcagggaagcagtgcctccccagagctcagaggctgatgagggaggcaggcaatgagcaaggaaacagtccatctccagctcggggccagctaaggacggccttctccaactctcccctcttgctccagacacagtctatccatttgaggttgctgtgcaagaggctgccccgggggatgatgcccggccctgtgcacaacacaggctgcctctctgctttacacaaaggctccttaccagctagttctgtgattctcagaggcccacagcatcctcaggcttttgacaaccaggctctggcacccactgtgtgccagaccctggcatctgcctggctcaggggtggtcactcacgtccccagctgctggccttggagcaactgctaccagggtccagctgcaagcaggagcctgcggccgcgctgggcctcactgctggaggttgtatattataataaagccaacattttgttgaaggcttctgctgcgccaggcactgtgttaagctctttgtggggattatctcgattaactcctacaaacctaggaaataaatagaattttccctaggctcaatgtcacacagctcccaagtggcacaggtgaaacttgactgcagatctaagttactgatctgagcaaggaagtggaaattatgttctccaaaacatcrctagaactagtagtatagattctgggaagaggagactcaggggccacaagcctggcttgctagaccctcagaagggctgtatgattccaaaggcatgtggagaagctgcaggggaaatgcaggagaggaaggttgcagtgtgacctccagaaggcctttctgaacgagcttcctggaggtgtagtgcatgcaagccrtggctgggcaccaggccaggccgctgcagagaggtttcttgcactggcagagggtgagactgcatgaccccagaggctccctacccccagccacaggaggctgtgactctggacagggtttggggctgggcatgagcagagctgaagaggccgtcctctctgcctttctyggggagggtgtgcaggagaggctccagaggcttccagtggaggatgcttcattcagtcaacaagcatttattgagcacccactgtgttccaggcagtgtgcaggcctgacctcagggggctcggaggcacccctgcctgctcactgctttgcttcatgccttccaggagcccacacgcatcccccggatgagttcctcttcacaccagtggtggtcgcctgcatgtccatcatggccttgctgctgctgctgctcctgctgctattgtacaagtataagcaggtgagcyggagcrgagtggggctgccaggtgcctgagtgagccagatttggatggtacccccaggctgcatggattcacccttcctcctcctcagtcagtccatcagctaacagctctttagtgggtgcctactgtatgccaacatgagycagctgctgggtggcctctgaggctctgccctaatagcgtttactgtctagtgcgagagacaggtgctaatcaaatagccattaaagcaagggcacacctgtaatcccagctacttgggaggttgaggcagggggattgcttgaggccaggagttagggaccagcctgggtgatacagccagatcccagctcaaaaaacaaacaaaaagccgtgaaagcaagagcatggattatagagtgagaggctatgaggagaggaatggcattctgaggcagcgcagccytgggatcctgtctcagcccaggggtgtcctggcacccagcacggggcagaggaaatggatatacaagcgtggtgtcccctgggccaggcctgagccctgccctaagaagcacatggtctagtgaagacgagggcctgtgaccatcatcctcttcattatttcatgttactgtcctattagccaaagccacaatttagtgcatgttgcgtatagtgtgcttcctgtcactgtctgctcagtatatgacagtgatttgaggggcatttttctatagcatgttacctacatcatctcatttaatgccctcagcaaccactgtatgcagctagcattagtctnttttacagagttgtaaactgaggttctgagaggttgggacagttgcccttgtctacagctggtcaaaggcagagtctggtttttaaccctgaaggaggactcactccaaagcatgtcccaatcattatgtgaaacattgactcatcttattttaccctcacaagaagctggaggcaggaagtatactagtcagtatcttacccatcaggaagctgaggctcagcaaggttaaaaaaaaaaccccaaggggctgagggatagggttggcactgggccccaggggcttctgtccctagagcccatggcctccactgcctgcctgcccacacaaagaccatgtgcaatgtgatcagaagctgagaggaccaggccagagggctgtgggagttcagaggtgkacggacttttcaggctggtgggtaagggagactgcctggaggaggtggcttggcattggtgggacgggctttggaggatgaggatgcagcaggggagatgacactaagggaaagggtayctctgggggagagggcagagtgtgcagaggtgcaggtgagggaaggaccagggtggggytgggggtctgaagggttggaccccaccctgtcggtccaaggccatcagtgggtttgaacaagggagtggtgtgatcaaggactgaatgacccatcttgtgtccccttggctaccttttcttccccacacccccttggggcttttgtgagaagagggcttgaagtgggcagggtgggaaggatgttgggggagccccaggggcacatggatcgggatctctactcctgccagcactcagcatgagaaggctgctctgagggcagccccggtcaatacctccggatctaggtccagctctgacactgttttgccatgtaacctcagctgactcgctgtcctctctgggccttagtttcccctcttataccatgggtctgggtgttctctaacagcccctcctcctctgacatgccaagagcccactggtggtctagtttaagcaccagaaacttggacttcagtgaatctgggtccaaatcctgcctctgccaagctctggctatgggrtgatgagaaagttggtgtgtctgagtctcttctccatttgtaaaatgggatcattaacagcctgttgtgagggattccgtaccacaacgcacatagaggactgagcggggtgctggacgagacagtctctgtgatgggagctgcacactcttgtcccaggaggaagttcgttggggaaccagagttagctcatgcctcttgggatggtggaaggagggggaggtctgaggtcgggcatcatctccttgactacacacccaaagcggttgtttggcccagcccacccacctccagggacaggaccttactcactctcggggccaccrgttccttctctgagcagctccaatgtttgcaaagttcttccttacatggaactgaaaactgcctcgcagtgcccacagagctgccaggacagtcatgcagagattccagagaagrgcctagggccccctgcggccctttctgccttgggctggccagcccccttggctgtggtttaggaactctgtatcccctctccacgggaccatttttggaacatgtcacctccacacttcctgtccaggaaattcagctgcccctggagcccatgcaaggctgcgagaagacttgcagctaccctcctcccctacacccattcacagaccctttagctccaggccgaggtgtccacccatgggagcggagggggcaggatggtcatgcccgtgctaagtgcctgccctcccatcctcctctgccttgccccatgaggttcggagccttgccccttcactggggactcagcccagcctctcctcattgcccaggcctggggaaagaagtggcctgtctgtggggagtgtttgttctgcctcagggctgaatcatcacctttctgtcccccagagtgaccacaaggggggccgtgggggaagagaaaagggcaggagtcagcaggctcccctggaggaggaggcgcacagggaaatggctgaggcagcagggaagggagggtccagggaggctgctggaaagactacgattctgggggctggaactgagctctgaggagcaacaggagggtccccaaagattccactgggaattgttcagatctccaccttcctgggatggagaacatccactcacccagaaccagcaggcctagatggggaggggaccgggactttgtctccatgccccctttggtggggaggatgggaggaagggaagaagtcagggggtgggcctggggcttaggcccattgcaaggaatgaatggggtgatgtgcttcaagcatctagcccagcgccccactcccaggaagagctcaggaagaacccgctgccatcatgacaattacgtccacccttctcagggagcctcgcccatccccacctcttgatctctcactcatagttctttggaagagaggctgcctctgggtagacgcccatgagccctttccagggatggcacaggtgccctgggaggtttacatgcccagcaggggcaggggagggttcctgaggcaggcagaaggcagcttggtccgcttccagaaattaggagcctaggattcagaaatctgagaatccagccaaacctccatcctccttgatcccctccctttcaacagtgccccctgcccagctgggggcagggaggggctgactcagcccagctgcagagggacagaggaacaagaagtggtaagaaaaaacagtcttagccacagaggctcctagagatggaagtggccaggagaggctgaagaatcccctcctngccttgttgctgtcttttgggctgggaaggcacccacgggcaggatttggatcctcagaggcttgggaagttcttctccctgggtcccgtttcagactctctcccaagctataacgcagaggctctgaagttcacctgcagtccgcccttccraatcagagcctggaagttagttccttctcatttctaattgcagtcttttctctctaactaccagctagaagttcttcctgatggttagctggaagctttctccctgtctctctctttaaaaatgtccacattttatttttgattcaggggatagacgtacaggtttgttgcatgcgtatgtttcgtgatgctgagctttggaatatggatcccatcacctgctactgagcatagctcccatagtttttcaaccctcgcccgcttccaccctccctgctctagtagcccccagtgtctgttggtgccatctttatgcccatgcayactcaatatttagctcccacttataagtgagaacatgcggtatgtaggttttctgtttcggtgttaatttgcttaggataatggccttcagctgcaccacgttgctgcaaaggacatgactggaatcttctctctcaaccaggacttgcagctaaaggccagcctcctccctagcaccggtccacacttcctttaagtttctagctcgggtgcccagggaaggagcccagctgcaggcacagccaagcttgtcccatccccaaggcctggccggaaagagttgctctgctgacccagggcctcagtgtcctccaccgccccagcccagcttccactttccccctcaacttggtcttccatcagcatttcttrtgggcaacccttagcatggtactccccstcagcagctgacccctgggcaagaaacaggggcagccattcctcctccccacatcccagggcttgcctcccctggctgggtggtaacagcatggagagcctaaggaaggaaatcaggtctttccaaaggtgctggtcctccagaatctatctagtgggcagcgtctctctttctctctcaaaaaggtaaagtcaaggctgggtgcgatggctcacgcctataatcccagcactttgagaggccaaggcagaaggattgcttgagcccaggagtttgagcctagtgagctatgatcgtgccactgcactccggcatgagtgaaggagcaagactctgtctcaaaaaaaaaaagtcagatggcgactcacctgtgtcaaactctcagggtctctcactgcccggccaggcatggtagctcatgcctgtaatcccagcactttgagagaccgaggcaggcaaactgcttgagctcacgagttcaagaccagcckaggctgcgacaaagccccgtctctacaaaaattagccaggtgtggtgccacatgcttgtagtcccggctgcttgggagactgaggtgggaggattgcttgaacctcgggggtcgaggctgtagtgagccaagactgcccccactgcatgccagtctgggggacagagatcctgtcttggaaaaaaaaaaatcccaaaagggaacccactcaccttatcatagccctcaagrccttcctgtttctggaatctgccccccacttccctcaagccatgatggctgccttcctatagctcaaacttgccaggatcattcccatgtcaagcatacagcatttccatgcactgttcctggaaaattcttcctctgatggtcacatggtgggctctttaggggccttccctgacttatcttactttattttcttcatagcaccacttgagaatctcctagatacatgtttatttgcgtttaatgcctctctcagccactagaatgcaaactccatggaggggcagggactttgtcctgttcaactctgaatcagcggtgcctgacacaaatagatgttcaagaaagtatgtggatgggctactattattcagccttaaaaaggaagggaattctgacctgtgctgcagcatgaatgaaccttgaagacattatgctgggtgaaatraggcaatctcaatagacacatgctgtgtgagtccactgaggtgcagtgcctagagcagtgcaattcacagagacagcagaatcatggttgccaggggctggaggagggaaaggggagttgctttttaacaggaacagaatttcagttttgcaagatgaaaagagctctggaaactggttgcacaaggtagaatgtaatttacttaatactactgaaccatacacttaaaaatggttgaaatggtaaatttcatgtatgttttatcacaattaaaatatatrtatatatttggatgggaggttgggtgggtggatggatgggtagatggatggacagatgaacggatggataagatctcaagttccaccctccctcctggctcaggaattaccagattatcagagatatcagggccctcagaggttgtcttgtccaaggtcttcaatacacaaatagtgaaacaggcttggagaagggaaggtcacacaayaaggcagagtcaagcaggaacatgctctcagtgctatgttcatgagacgacctctctcagcccagagcaggccttgccctgccttctcccactgggcgccttgggactgcccacacccctgctcttgggggtcagaaacaaggtccaggaactgcctgccagccccgactgccaygtgctcccttcctcttctgcagaagcccaagtaccaggtccgctggaagatcatcgagagctatgagggcaacagttatactttcatcgaccccacgcagctgccttacaacgagaagtgggagttcccccggaacaacctgcagtttggtgagatggcagctcatcactccacagcttcctatcacagggcctgtgggggttgcagggagcccatgggcccttggacagaggccctttggtgcccagggacttaagggacctgtgtgcgtggcaggtaagaccctcggagctggagcctttgggaaggtggtggaggccacggcctttggtctgggcaaggaggatgctgtcctgaaggtggctgtgaagatgctgaagtgtgagtgaggggaggggatgagggaagggatgggggtggtagatgctgggggtgggctggccctggtgtcacaagaggcatcacacacatttcaacctgttgaagcctgggggacagagctcaggggtgaggacttgggttttcttgtgagctccaggcaccctctgactcccggctccaagaaggtctaggtcaccctttagttgtgaaggggctcctgactgagctccaaaaagtctgggggtgcagaaaggccacctatggccatggcctggccacagtttggcttcctgtcacctgaagaccagctcagtgacaggctcatccctyctctctctctctctgccatctgtgtgtctgcatttttccttctccttcttttggcttctggtcactccgggtcttggrrtatgccctgctttctcccctgggtctctgcatttggtccccatgtatctgtgtggtgctctctgtcctgccctctccctgtctttgggactgtggttcttcctcccagccacggcccatgctgatgagaaggaggccctcatgtccgagctgaagatcatgagccacctgggccagcacgagaacatcgtcaaccttctgggagcctgtacccatggaggtaagggccttggggttcctggggccaaggtcttggggcctctggggaatctcagggccccagggctaccttgttccgtcttctccttctyaggatcctactgctccaagtgtcagggggatcccggtcacagcatcccttaaactcctgggcccatctcctggaatagtcaggagctgcacgggcagcttgaggtataaagagagactgatagggagcatcggagcccttggaggaggagatgaatgtgcaagctcctaggccctgcttccagggagccggatcctctgggtctggagtgaagccccccrcctacctcttatgaagcttccattcaaggatgcttggacactctccccagggcccccaaaggtgccccrggctttgctgggactccaagtgccccacatcctcttcactgatagcagstctgacctacagtgagccgccatagctttcctttgaagaaataattcttgggctacattttttttaaggttgtcttttttttttcattttttgttttttttttcttgagacggagcctcactctgtcacccaggctggagtgcagtggtgcgatctcggctcactgcaacctctgcctcccaggttcaagcaattctcctgcctcaacctcctgagtagttggaactacaggcacatgccaccatgcccggctgatttttttgtatttttgtagagatggggtttcaccatgttagccaggatggtctcgatctcctgacctcgtgatccacccaccttggcctcccaaagtgctgagattacaggcatgagccaccgtgccccgccaaagccatctgttttaaacaratggaactactgaggcacaaggaaacttgctcacagagccgaggttagaactcagctatgctgagtccaagtccagtggcctcactgcccccagtctcatgctcctgttcatggaggggagcactcagcmcctccctcaccccacacccttggctgctctaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgaraagaaatatgtccgcaggtagyccctggcaaaggacaagaaaaaggccaggtctgggaggcaggatccgagtctgtcttcaaagccagctcagggttggatggctcatgaatgggtggctatgcagccctcacctgccacctgtgtcatgggaagtagccaccacaggttttatggccatctcttgtttctctactccttttccccttcattcaacaaatatttgaacacctaccrtgttctgggagtgtggagggcaaagatgggcagctcataatctggtggagatatgcatcaatgaaatcaccacccagtgtgtgtaaaagatcaaccaagatctgtgcctggagccctagtaagagatgggcagatgtggccgggtgcagtggctcatgcctgtaatcccagcactttgggaggctgaggcgggcagatcacctgaggatgggagttcgagamcagccttaccaacaaggtgaaaccccgtctctattaaatatacaaaattagccgggcgtggtggcgcatgcctataatcccagctactcgggaggctgaggcgggagaattgcttgaacccaggaggcagaggttgctgtgagctgagatcacaccattgcactccagcctgggcaacaagaatgaaactccgtctcaaaaaaaaagagagatggctctgttgtcctgttgctgtgattcctggaagccatccagaacagagccatccaacagacagagccacatggggaaccaaagagaggaagtggggagattcatgtcacacatgagtcagggttagaggtggagcctggactagaatcctgctctcttgacttccagtccaggagtcacccaagccacactgctgtcctggaggtctctgtctcaggggcttgtggggtcnggacaggatcagaacaagaagggtgtacactgcgccctcatcctagatactgtcagctgccacgcctggggaggcaaaagagaaggaggccatctcttcacccagggccttaaaaatgggggcctggcagcatcacttcctcttctgattccctgacacttctatgagggtggcacacactaggcctctgaagatcagatcaaaatgagcaccaaaggaaagtattagcttccatcttcaaatacgcagatggggaaagtattcccagagtgggtaatttcgagggcaaatggcctgtaaaccaactctgtcaaaggattccaggctgttaacggaagcatagtttctacaagggagcggaaggttttttcggtttctccttctgggaacactagaatatggacattgtcaaggtacacatctctagcgcagaggggacaggagggagagagaaatcctatctggctggaacgttaggagcagtagtgcttcagtctacagtagtgcttctcaaattctctaccccaagtgtgctctcataggcatctcttgaggactgttggaagtgcaccacctcaggcccatccacccaggcctgctgattcaaaatctgcattgcagagattcccggggtgatttatctgcacatgagttgcagcgtaagcagcactgctctagaccagtgggcctcagcttaggctgtactttgtgatcacctggggagatttaaatctgtgaatgactgttttgtccctagagtttctgaagtattagtaattagcctgatcctaaaagctcccgaagtgattttaatgtgaagccaggggtgtgaggcactgtccagagaagagagggcacaaggggccctagaatatgccccaattctagtagggctgttatggggaagaggactccaacttctctgtggcccttgagggtagagcaggggctaggaggaaaatctcaggggtagattggcattaggaacagtgaagaactttctcacaggcagagctgcccaaaaccagaatgggttgtaagctccctcaccggggacagccragcagagaccaatgctcactcagatggagtgtggcaggagggtttcttatcagaaagggaggttccagttgaccatggggtggtgggtggtcaaggcctgagctgagcagtgcagtgatgatgastgacctctgccccccaaccctctctcctatgtagggacagtggcttctccagccagggtgtggacacctatgtggagatgaggcctgtctccacttcttcaaatgactccttctctgagcaaggtgaggaggtcccagggccaggccccatttgcttgataacaagggaaaaggagaaggggctgctggggtgaggggtggggagtgtggcagggctgccctgacgcctcttcccaccctagacctggacaaggaggatggacggcccctggagctccgggacctgcttcacttctccagccaagtagcccagggcatggccttcctcgcttccaagaatgtgagtaggaacctggccctggctcatagccacccaggtctgtgctccggggaggctggatgagtgacgatggggaggaggaaacgggagcctgtgagggggtaggggaggagacagagtatgagagagtcatttgggcagcagctgcaaggatgagtgggagmaagctgtgcccagggctggagctctggggctgggcacctgtgtccccagcgtgaagatgaggaagggtaccaggctttcttcattcgwttttactaaatagtgtatgagagacaacagttgtctctgctcataaagcacgyggtctggtggggatgataacggaagcttcctcagaattttggggatattagataacgtataaagtgcgctcggcctaggaagaagtgccagggaatgggagctcttgccatcttccttagaacagattcgggagtcagtggtttgattgttggctctgccacctgctccgtgactttaagcaactatttaaattctgtgcctcagtttctacacctataaaaatgggcataacgattgttgaaaagaaaaagggttcaatgtgtgcagagtttagggaagggcctggcagatagcagctgctatgatcagaagtaacggtagggtttggagactgctctctgcacggaagcccttcgcttctggggcctgagcagaccagtcagaggacaaagggtgagaagggccatggctgctcagggtaatgggggtttctaagcattaaatgatcagatcacgatacacattctcagatcctgggccctggtagaaggtatagacaagggtttgtggtaaaggaccaaaactgttgttcactccagcagggactccaaagccatgtggggccctccctgccatcctcctcacctcaggctcaggtaggagaaggcccaagactaaccctgcagtgctttccctcagtgcatccaccgggacgtggcagcgcgtaacgtgctgttgaccaatggtcatgtggccaagattggggacttcgggctggctagggacatcatgaatgactccaactacattgtcaagggcaatgtaagtgctgggagggcttgggncaggctggggagggggtgaagagtcggggcccaaaataactggggactgtcatcccaggcccgcctgcctgtgaagtggatggccccagagagcatctttgactgtgtctacacggttcagagcgacgtctggtcctatggcatcctcctctgggagatcttctcacttggtgagccactgggcccactccaggcagagcctggggctggctcctctggttgccccactggtggacaaagctgtttggtgcccaggacacagcgagggttggtgagagtgcaggaatgggcaagggctctcgaaacccagcatcgtggctcctgcgggactcggcagaccctctgcccctgacaggcgctcctttctggctcttccctcgtttgtctctgctcagttgctgttacctgttaccctcctttgtcactgtttccctcctttgtctgaaatctacagacccttgaagatgcagctctctactactaggctctagtagaaagaactgctatttcccgaggactaggcacaaggacttgtactcagttcttaaatacgctgctcctataccctsataaccacctgactgtccacactttaacgatacacagctgaagctttggtctgattccaaagcctgtgcaagaatgtttggtgtgataaggcctggatagaggctcacaccttcctaaagcctaagcctgccacacactggctggcacacaggaagcaccgggtaagagtagctgctgttgcagtgttgtcaagtgggaccctttaaacccagtctaagatgtgtgtgggtgtgcgggaatggggagaagacaatgggcatggcctcttacctgatcttggcctttgcagggctgaatccctaccctggcatcctggtgaacagcaagttctataaactggtgaaggatggataccaaatggcccagcctgcatttgccccaaagaatatgtaagcgaagggatcccagggagggaaaaggacaccccaggctttcgctggaaagggatggaaggccgtgtggccctgatctttccctgtccaaaatgttccagggtcagactttatctctcccatagtggacacaacaagccccttttgagttcaagctatgggggatgttctcagagaagcagctgttcactagggctggtcctaaccgaccacttttcctttttttttttttttttttttgagacagcatcttgctctgtagcccgggctggagcgcagtgatgtgtgcaatcatagctcactgcagcctcaatcttcagggctcaagcaatcctttggcctcagcctcccaaacagctgggactacaggtgtgcaccaccaagcccagctatttttaaaaaattttttagtagagatgggatctcactatgttgtccaggctggtctggaactcctggccttatgcaatcctcctgcatcaacctcccaaagtgttgggattacaggaatgagccactgcacctgtccctaaacagacttttaagagatcgttattacagttaccctgaggataccaaaatggcctcatctgtcagaatgagggtgatgagagtacccttctgcaagggttactgtgaggattaaatggtaaagcatgccaaggacttggcataggttttatactaaacttactttgactgggtttggggacctctgctgggtaggtctctctaggggtgtgtgttaatggcccctggaccctagggagctgcccatgggcatcctctgtcctatctcccagatacagcatcatgcaggcctgctgggccttggagcccacccacagacccaccttccagcagatctgctccttccttcaggagcaggcccaagaggacaggagagagcgggtgagtggggtgaggcttggggtgggtsgccggtaaagcacgttgggctgggcctgatggatctggactgacagtttctggtccctcccaccctcaggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactrtcagttctgctgaggagttgacgacagggagtaccactctcccctccymcaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctctyagtctctgccctatacgccgccttcactccacagcctcacccctcccacccccatactggtactgctgtaatgasccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgcmgtgggatgtctctgtccacattaaactaacagcattaatgcagtcagcctctggttctttgtgccacatgagtacctgcaaattccctggaacgtctttctttccttccctccttcacatgaagtgacgagctcacagctgtggagcttgaccacactgtgccccatacgatgtgcacggaattgactcctgctacaccaaaaccagataatttaataaactttattcttgttgggggaagagggagggaaaaaaagccacctactccactcaataaattaacacatggccaattcccaggccctaaacaaaccttgggcacttgagccagtcctgctgtttccttatggcccagtctgcttccccttcatagaagggagtttttcctactgctgctaggttatgtcatgaccagggaccacatcccctctgtggagagggtcccaggcccagagaggatattggctgcagcagcagtggccagggaaaggaggaaggggatgctcttcctcaaagcttggggtggagaggacagtgctggaagagagctgtggctgactgttcctccctcctcagcttcccccaaatgtgggtacaggaagagcaagagagaaatgcatccctccttcagggagaatcaagagcccaaagggacccctagagttaatgaggccacccaggcccctagtcaaaggcaacaggctaagcaattcatcagactgagggggctgaaaccagggctcctcaggggtgggagagacctcagcagccttcccacctagtgctggggctcacgccttagcccacccaggacctccaccctgacccacacagcaggccccacggaacccaccagctaccagcctttccctcagcctcccctccattaaacataccgtgtcccccaagtgctctctcggggccagaagaggtttcctggtaccactcctgacccctggagggttgagaactgaggaccctgggtcccaccatgctcagggaatggaagctctttggtcagtcccagcagtcagaggccctccccacaggagaccacttctgcaggtcccctggatagctctgcctcaggcaagggccttactatggcttgagagatggtgtagtccctgtacaacagcctggcttattctgccactgcggccacctcctcttcctcaccctcctcctctgtctctgtcttgatctgagcaaccccaaggcggtagagggtgtcacgaatgaccacctcaccaggctggcagctctgtacaatgtcatggatctgacgattgacaatttcgcggctggtgaggaagtccatgaggcggttgtagaggtaatagtgagtggcattgtcgaaggcaatgggccgctggcggacaccgtttggtttgctgtccacgatggaggccaggatggttgcgtaaggtgccaattcagggcacagggccaaggagtggtgcccagcactggggtcaccaggattgggctgtaggcctgcatggacgatgcgccgcgtggcagtcttggtgactgggtgctggatagagtgctcagtttctgtcatgtccacagtataatgctggtccaagagctctgggcaggacacactctagaagagaaatgagaatgcattttgacaagaaggaatgactaaggtggaacccatctggtgatgagaacactctaggctcagccagccctctttgaatcctaacatcaccatgtactgtgtctcctaggccaacccctgcccgccagtgcctccatttcctcatgtgagaacagggacagtaacagtggccaccttccagaacagatgttggattacttatgctattattgcccccggtccattcaggccagtggctgcaggggagcagaaagatcaggctctgactgaggttaagacacttttctggagtccccagcatgctcatggagccagtgagccccagggagtaatgacaataatgactcctccaaggcaaagccagaggccttcacttcctataatgcatcctggctggggcactcaacctttgttattcttcccttcttcctaattatcagttctgacatctatttcagcaaaggccaaaggctggcctgctggccttggagggtacatgactggtgagaaatactgtctggtacaatataccaagacacagagacaagggctctgccactaatctgctgtgggacccggaaaagtccatttcctcctctgggccttagcatccccttttaataaaaggagagggttggataagatgagtgttttctaaaccagtgtatcttcagatcacaacaggcatgccatacagtgttatccatggtcaactaaatgtaagacatggtgaattaaactaatccagggctggctggggcctttaatatgtcagtgtgcacaataactctcaaaggtggcaactttctaggcttctctggaaggcaacctcttttaacacaaggtttgggatatcctgggcacactaagtgatatactgtggcctcaaacagagggcttggtcagtaaaaacttacggagtaggctgggcgtggtggctcatgcctgtaatcccagcactttgacaggctgaggcatgtggattgcttgagcccaggagtttgagaacggcctgggcaaaatggccaaaccccatctctactaaaacacaaaaattagccaggtgtggtggtgtgtgcctgtaatcccagctactcgggaggctgaggcacgagaactgcttgaacctgggaggcagaggttgcagtgagccgagataacaccactgcactccagcctgggtgacagagcaagacatggtaggcttgaggagacatggcagttcctcaggaggtgactcaccacaggtggctctgtggggctagagaaacagccctggttcctcccccacatctggttagtcagctctgggtagcagaggtcagcacacagggccactgacgtggccatatctaccacatagacaggcggccagtggcgggaagaggcaagcaggtccacatggtcacgggcactctcacctcgcacaagatacttggagccgcagaccacctgggagatgaagggtggggggcgcagggttaattaggaagccagtctgcagagagtgtacagttctcactcgcttcttcccaggaagatgagcaatcagcttcagggccgaagccatggccatcctgccagagcccatggcatgctgctcccttcctacttctgtccttaaatgaagtcaccagctcatccttgcccttctgagagacagctgggagcatcctgtcctcaacttaggctgaaaggcacctcagaacatctttcaaaaccccactctctccacatcacctaccagttcactatgctagctacatagcagcagcagcagctaagagctggttaagaatggagatgcctgggcccgaggtcaaacctaagaaactaaggtctctgaagtagggtctaagcatctgtattttgagcaagctccccaccagaccccagtgggcttgttgcccagatgggaatccacaatgtagcctagtaaacacctccactgacagggccccccaagcaccattccacaactctgggtacacccacttggctgtcacctccaagtgatgccactcccatcacagcccccaagatctacagctctccccatgctgtcagctgcttctcatgagatgatcccctgtcgcatgaacacaattccctgagcaggctctgatctgcccagagtagaagcattaagcatctccttcagacacagcttctgttaaagtagttgggaactggattctctttttacagctagatccccctgctgactcatgtgcttcagtgaaggctctgataagccacctctctcccattcagtacctgttaaggggggggggtttccgttccaagatctacctgggcccactctgtcatctagtacataacctgtcctggagctaacccagtgccaccttgtccacacccttccacagatttcccattcaaaaccatccaaaaggtccctcatcagtcagaataaaatacgaactgttactctggcctagagagctctatgtgatctggccccccgggggagccctccaacaccccctcctctcagctcactctgtctccccactcacggccttggtggtcccttggctgtgacactccttccctggcttaccaatgggctcctccctatcctgcaggtctcagtcttctctgccacctcagacagcaggttcctccctgttactttctatcttaggcccttatctaatttcttcagagccaatgccacaagctgtggtgactttatttccccactaaaatatacggtcaactagggaggaacgacatctttgtcattctttatacaagctcgcccttataccctcaacagctgatgcccaggatgtggtagggtgcttaaaaaatactgagagaagacccagcctccctccctagcccacggggtagcacctgacccgtgggcagctatgccggaggttgcccagtgacctaagtctagccccccaaaactgagctggatcagtccctgtatgggaagttcaacattagcaaattcactccaagctccccctagttattttcttacctgatgggggcacaccttgtagattttaccacctgtgaagtgacgtgggggccgtatagctctagctccattctgtacagattcgtagagggccaacaaggagaagcagagctggtcctggagtagaaggacaagattaaaaacataagggcgaatgctaagggaccacggctggtgctcagcatcacacactcacccaacacccaaagcaaaagaataaactgcctgggtcagagcgggccttggagcctcatcagcccaacctcctctaggtacaggtaagcaatcggaggccctgaaaggattaggtcacagacaaagccagccagactgctgatcaagctgccagactctgaggcctgagtcctttcactttttacagggcaaagaaaccatcaaaggggagctaacatttgaatctgatcttgaaggaagcataacattttcaacagcacagaaatatgaaagggaaagtaaataatgtatgaataaaacacatagacacatacactatgtaacagtaggcattttctaagagcttgcataggtagtaaccagacactgtgtaaagtgcattccttacaacaatctcacaaggttagtattttggttatttccattttacaaacaaggaaaatgaagctcaaaatataaagcagcttatccaaggtcacacacagtaaggaggagagccaggattcctgaccccagagcctaggctcacaaccttcaacaggaggaactgttagaggccaggccccacatacatgtcacatctagctgttgaccatctcctaggcatccctgactgccagcaccttgtgtccaaggcagatgccatcacagatattcatatccctgccctaaaaagtggaccaatcagcctactccagaagccccgatatccaccactgcccttgacactcaccttggagtcttctgccccaaaggggattccacactgccttagcaggtgctgcagcttctcttcactgtaggagccaatctcatcaagcttgcaggtgccctcctggagcagcctcaccaaggcactgccactgcctgcaagagacaacagtgctggtgggagggtgctgccgccagtcaccagaggccaaggctaggcccacaaaacagcaaacagtggaagccagctctgcaccaagccctcccccagtgctggcagaggtggaactcaagtcaggtccacgctttctgcagatatttgaagtctattagaactggctttctgccctggaacatctgagtgagatatcctgcacaccgccactgaaaaaaaccctaaaataagtcagcttttaatccagtcttctaaggtttttcagaaccaagacctcagatgcttaccatgactgcatcaataagaaaag

SEQ ID NO: 10738 - DNA, 65300 bp, Homo sapiens
  misc_feature (1)...(65300): n = A,T,C or G, or insertion/deletion polymorphism (see Tables 1-2)
tattagtcaaattccattcaaagaagtttcctggctatttcagagtactggaatgttgtcacaataacattgctttacttaaattggctcaacaacctatctaaagaaatctttattcttgtaaactacattttctgaaataaattcctgcattattttgtttggaggaaatctgtaattttggaatcaataagggtttgtgtcactcttttcattaaatattcatctatgccatttaattgtccaaaaatggcatcaggaatgtctacacaagtggaaaggaactgtctaagtttctgtacacttgatatggcttctgtgatggtgacttttggttgctctggtaaagatacctccccttcatcttcacttcctgcttcactggtattttcgccagccaccatgtcctggatgatgtctgtgtcctgagagataatgagatcatcatctgcagtaacaaagtcctggaaatttacttcatttgggacacaggtggcaatagccactgtgtgccacaacttttcaatggcaatgtctggttcactggctgctgattctgtgtcacattctgcaaattccatagggacgatgcctgccttctgccaacatttcaccactgtggatggcttgactgaccaccacgctgcagcaatcatgtcgatggcctgcttgatgtccacctcttctgatcctcactgctgttgagcttgaggaggatctgttttagaaggtggctccggtacagtactttcatggtgtgaattatgccaagattcagtggctgcaggacagcagtacagttggagggcagatacccaacctgaatcctttccaagtgtggaagcatgttatgagcagagcagttgtctatgagcaagaggatccggcgttccgccctcttcatcctggcatccacttgcatcagccactcattaaacagatcccttgtcatccaagcccactggttggctcggtaatcacaagggagggaatgaatgttcttgaggcagtgtgggctggctgacctaccaacaatcaatggtctcattttttcagtccccgaggcattgcaacaaaagagtgctgtcaaccgctgctttgctttcttgccccctctacagtggtctcctttagcagcaagtgtgtgctggggaagcaactggaaaaacactcctgtctcatcagcattaaagatatcatctgggctgtagtcagcaatcagttttataatttcccctgcatgccactcattaatcttatctattcctagaccattcattaacctgtcactatcttctctacagactgctttcaaagcaattccgtggcgatctctaaatctgttcagccagcccacacttgcttgaaaattgtcatagccaagcatgttggccaagtttagtgcttttttccgaatgacagaaccagtcacaagaatgtttttggcatggatttcttgaaaccaagcaaaaacagccttatcaatgtcatcataaagagcgctcctcatccttttccgctggggtcccacggatgcctcccgcaccttttcttcaaatttggtgcgatcctttaagaatgtagataaagtagagggagtgataccaaattcttttgccacatcacctttcctcttgcctgagtctacagctcccacaactttcattttctcctccagagagaactgccgacgcttcttgttccccttgtttgccatttccagggaatgagggctggccacaactaacaggactgtctggttcctcctcgcggcttgctttgccccaagtgtggaaagctgagaagacaaaatggagtacctatcaggaaacaatggatttcccctaaaagatggttcaggatttttacaaattgtattaggaaaggacaatttacagtcaaagtaaagaaaagataggattcatgctactgactttttgtagaggctacttgtaaagactcagaatgtttgaaacagaagtgatcttatctagcttacttaaacattctgaacctccataaaaatgggaataacaatgtttgctctgcctaccatgagaacagattgaaataacaggcagtgaaagagcttggcaaatagcattgcactgtatacattccgagttattctccagcttctttgatggacacagaaactggggccctgggaaggggcctacccgggttcatgcagcttagatttcttaactcagattactatttctgccaggccatggtcctgcttgaaattccaccaaagtgagatcttcaaagctctaccaccatctggcctggaaagatttttactgtgggaagatgtttctggtagccatacattcattttatatttacaggtgccaagctttaagggtagagtaatgaacaaaagagtcaaggtccctgttcttatgaaatataaaatgtggtgggaaatataaaaagtaaacagataattacagagggtgatatgtgctataaaggaaataaagactatgacaaagaataaaagaggaagatctacttattatacaaagggtggtcagggatgtcctcactaagatggcactgaagctgagatctccaagaatatggggaaagggctgtccagcaaaagacatagcatcagcaaaacctcaaaagcaaaaataggccgggcgctgtggctcatgactgtaatcccagcactttgggaggccaaggcggccagaccagcctggccaacatggcgaaactccgattctactaaaaatacaaaaattagccgggcgtggtggcgggtgcctgtaatcccagctacttgggatgctaaggcaggagaatcacttgaacccaggaggcggaggttgcagtgagctgagatcgtacatttgcgttctagcctgggcaacaagagcaagactctgtctcaaaaacaacaacaacaacaaaaaacaaaaaaaacacacacaccgaaaatagcttgaggtattcagggaactgaaatatttgcatgaatccaagtatatgacaaaggtgggtggccagaccattcaaagatgccatggtaggctggatggggtggcttacgcctgtaatcccagcactttgggaggccgacgcgtgtggatcacgaggtcaggatatcgagaccatcctggccaacatggtgaaaccctgtctctactaaaaatacaaaaaaaattagccgggcgtggtggcgggcgcctgtagtcccagctactcgggaggctgaggcaggagaatggtgtgaacccgggaggcggagcttgcagtgagctgagatcgcgccactgcactccagtctgagtgacagagcaagactccgtctcaaaaataaataaataaataaataactgggtgtggtggcgcatgcctgtaatcccagctactcgggaggcagaggcacaagaatcgcttgaacccaggaggcggaggttgcagtgggccaagatcacaccactgcactccagcctggcgacagagcgagcctccatctcaaacaaacaaacaaacaaagatgccatggtaaagaattggtattttgagtgcaacagaaatccacggatgttttcaggcattttaaaaggatcactttggctgttctgtggaaaatggatcaaagaggcaaagagaccaattaggtgacagattatggcagaagtgatgggcaggttgtagtacagtccctctctgggcctattttctttttttccttttttttttaatacatatttttgaaaagtcccatggttgcaaaccacaagcccagatgatgcctaaggtccttccagatttaagtcttggaccctagataggtgcttcaaactcaaatgcctttaggggccaggatggtggcgtaagtgagtgaaacagggattgaagtatttggagaatggtgtggtgtatcctgtctagaagtattcagaatttaaaacaaacagtccccctgccctacgctggtccaacaaaacatgatccagcagtagcagttttgggtaattgccttcgtaggcattttatcatgagaatccttaaaggacaagagaacctgctgtgactttatgctatgactgtcccttctcaagggtagatttttactatcacctccatacatgtatccatccattcatgacatgtactatgtattaagcagtatgcttgatgccagccatacagagatgaatggagcatagtgcccacctttgaggagcctaccagggaagacaaacactagagcatgtgaaaactaaatcagaggttacggagtactactggaacataaatgtgcagataatcaactggaatggagcatggatgggcagtgcacttcaaagagggaataatatggtgggccttaaagaataaacaaataggaactcatgagatgaaaggaaatatttaacatgaaaggcaatgaaatactatataggaaatagaatgtcctggtcaggaacaaaaaattctttggagaagaaagcaaggaccaaatcacaggaagtcctagtcaggtttctagcttgctttgggggcattaagaggcttttgacggttttttggttttgtttttctggaatgacatgatcagatttacaatatagtcttttggttgcagggtagagaacctaatgggtaaagttgattttcctaagagatggccttaaatctgaagataaaagcaggctaaaccagtaggccatatacagtttggatgttaatttgagtgcaataggaagctattgaaggattttaaggaaggagagatgactgctgtgtaaagaatggaagggtatcagagaaaaaagcaggagtccacatgagataatggtggcttggattagagtagtaatagagagatggtgagtagtagtcagtctggggctatgtttttgcaagccctgtgctggaccggatgtgaggtgaaggaggagtcaaggataacgcccaggtttctggtttgagcactgaggaatccagcagatgatggtgccatttactgaggtgggaggatctactgcgtaaacctcatttgttaagcactttacttgcttaatattgcttacttgtggcagggctgggattcaaacccaggaggctcacaacaaagctagcactccaaacactacagagtgctatatagctggttctgggaactactaatattgagaggagacatagaaagagaatgaagcaagagccaaatcagacaagtcttggtcaagctaagacgtctgaattttattttaagtgaatgagacactggagggttttaagcagggagtgacttgatcagacttacagtgcaaaatgatcaatctgactgcttcgtggagaatggattgtagaggggatgtggggagaactacatcagtccaggcaggagatgatggtggctagaaggttggtgatggcggtagatgcagagaagtaggcagactggaatacagtgagggttgtgcgggaacttgtacaaatgtggacaacttgtgacactggagagaaaggacaatccaatccaatccctatttgatttacggaagctctccatacggtcattcagctcagcttgagtcactccaggaactcactaccatcactattcgtgggccagtgggagagacggattgagggcagatcactggagtgatgaaggcgctacttgatgcggcactacgtatgaacccgatcctgaatgagagggaaagactgagacaggctgaggtcaggccttgaacgtcgtgctgaggagagggtggtattgtaggcttcccagcgcccgacgtggctctgaaaggtgaggcggggcctagatccctcacgctcagcacagccccgcccctgttacctgaacgccccacagcagtgcccgggggctgagcggccggggcgtcccaccgccggcagccacagcttcctcctccgcccgggacctctggccggaagcagtccgttcgccttactagaccccctccaagcctttgagcagttcgtgtgggtccgctcccaagctagggctgggctgttgcgcttgcgccaggggtcgcatgcagtcacgcgctgccgaccgcttccggtgcgccgcgagggccgccgggacgggtctccctggcgatccgtggtgtgccgctactgccggtgcagccgccaaaccggtgcctcggtgacgaccgtgtccctgccgtcttcctcgagctccccggggcttgacccccggggccctcggcaggcatcggtgaggagcctgcggagcgaacctgtgctcctattcttgcccttcaggaccccatatcgcgactccgaggaggggaagcgagaggggctgtcgcgactccgcgccgtgtgtcgccgggcggggccgcggggccggggctccttcagcccccgggatgcgcgcgcgagccctcgcctccacttccttgttgctgctgtcacgactggagccgcctctcgccgacagcggggagcgcgagtgcgccagccatccccctcgtccagccgccgggccaagcgcctccgggaatgtgagcggcgcagcttgcacgctcctccgggtaagtcccgccttcgagggccgcgccgagccgctgggcgacctcgagttggatgctgcggctctctgagcctctactgagtcttccacaaagtagggccactgagccttagtgtcctccttccgcaatccgtatgggacattcggatgtcccagacgtcttagcttgaccaagactttgtctggtttggctcttgcttcattcatgacccagaatgagggaaaggagctagcccagagtcaaactgtggcccatggctgagccctcaaaggcaatctcgtgagattccaaggaggatctgatgggacagagaaagtgtctcgcatatttcaggtattgaccttaactctgttttacagatgaaataacggagacttagggtaagtagattgcttaaggtcagaggtccccgtgctggtgcgactggtgtagtctgtactagaacccggattttctgtcctctagagcccttcgtttttaaccttaaattgtcctgcctttttttgcattgctatactgctgcctcgagtctgataacaaacttgtactcaggcttagaacagggtaataaaacaaacaaaaccgtagggtgttgtcttcctgccctcagcccaaggtggctgtaatgagtgtttcctaacccgttttgcgcagggtgcttagtaccctatatgccattcattacagatgctctcctgcagttactgcccttctccacaaggctttcagccgcccagaagtcaattcagggcaaaaaagcgcagtccccacgtagccttgatttgaactactgcttcccttatcctttactggcctattgcttacccagccaagttgtagactgtgttctcttcctgggttgcactatggcagttagaatgtaggtttttgttttgtttttctttgttagtttagtttttgtttttaataggaagaggaatcatttagagatgacagagaactaggaagaacctaaggaataatgtgtgctttacctggggtatatcctgaaaattataggtgaaatacagtgtgtctgcaatttctaggagaggttttttgttgttgtagttgtttgtttttttaagctttcgcaacattgtcaaaagaattcttgcctccaaaagactaggagccactgggttcatccttttctcacagtagaaacagttgaaatttaggatgtggaatagacttctctgagatcatcaggttagagtttaggtctcttgactccacatgcagtgctcattataccttatttgtggagtgaggtctaaatgagaggtgtgtgggctttgtactgcacgtatcagtcccatatttaccaccacaactgcctcttcccagaattctaaatttcctcctgacagattttcaggggcaactatgttatttcctcttgtaaaattcaagtggtttctgtgagcctttctccctccaaggattgagacttgtggtaaaagtccaatttagaacttggctacaaaaaaaactaactcttcttgaactggttattaagttttttatgcctcttttcctagacataaaagctgttagtagattctctgttttttagcccagcaccagagagctgatgttggttggtcagatgactgtttagatctgtgctgtctctagctcctagcatatgttgctatttcasttaattacaattggccaggtgtggtggtggctcatgcctgtaatcccagcactttgggaggccaaggcaggaggattgcttgagcctaggagtttgagaccagcttggataatataatgagatctcatctctacaaacaatttaaaaatttgccagacttggtggtgcacatgtgtagtcccagctacttgggaggccaaggtgggaagatcacttgagcctgggaggtggagactgcagtgagacaggatctcatcactgcactgcagcccaggggacagagtgagaccttgtcttaaaaataaataaatttaaaaataaaactaattcaattcttcagtcacactagccatatttcaagtgctcgatagccatatgtggctggtggctactatatttgacagcacagatgtagaacatttccatcatcagagtttattgaacagtgctggtttggagggttgccagtagagatggatagcagtgtagcataatgaaagaaggcccagggagttggatttttgagttaaaaatctatctctcaagtccctgcttgggcttggtggccttgggaaggttgttaagcatctcagacacagataatagtctttaacagaggctagatgtggtggctcacgcttgtaattacagcactttgggaggctgaggtaagaggatcgcttgagcccaggagttcaagaccagcctggacaacatagcgagatttcatctctattattattttttaaattatataaaattaaaaaaaaaacttaatgaactcttccattttttttttctgccaattacctgactttaggaatgaacccagcwgggcacagtgtaatcccactcatgcctgtaataccaacagtttgagaggccaaggtgggcagatcgcccgagtccaggattttgagaccagcctggccaacatggcaaaaccctatctctccaaaaaattagccaggcgtgatgacatcacctgtagtcccagctactcaggaggctgaggtggaaggattgctgagcccaggaggtcaagactgtagtgagcccagagtgtgccactgttctctagtgacagagtgagaccctgtctcaaaaaacaaaaacaaaaaacccaaaaacaaacccttttcatttgcatagcacttgactattttctttttttttttttaattaaaaaagatttttatttttttaatagagatggggtctcactatgttgaccaagctggctggcctcaaactcctggcctcaagcaaccctcccatctcagcctcccaaagtgctgagattataggcgtgagtcactgcgcccatccaattatttttaaatagagttgtgtctattgtatcctttgagtcttatcactataaatctgtgggaaggtagttgagacatgtctttttttatacatgagagagaaagctgaacaaaaagcagctaaaagacctgaccaaaattgcacaagctggcagagtataaagaaatcttttacatacaggcccttactacatgtttgagtgaatcaatgaaggsatttgcttaagttgatgaaacataggaggaatgggccagaacttctgattcctggccaagcatttttttttaacctgtttccatatagaattgttataatttggggctaataaatctttgtgttaaaggggtgggtgggtactgtatcccatgaatataagtgaaaagtatttctaaggcagtggtcacaaacttgcccggtctgaggaatcacctgaggcatttgttaagcatgtggatttccataccctcgggagattctgctccaggagggctgaagtggagctctggaatcttgtgtgttaaacaaccaagccaggtgcttcttaggatatattgggtttgggaaatgtctaagccttaaggcactggcagaggtaaggggttatttgatcaggaagctgctgcccctcttaggggagattctggaaactttattttgactttcctttcctttagccatggacgcatcatatgatggtactgaggtaactgtcgtgatggaggaaattgaggaagcctattgttacacctctcctgggccaccyaagaagaagaaaaagtataaaatacatggagaaaagacaaagaaacccaggttagccaacacattttggttgctgctagcatttataaacagaagttgcttggagagytgcattgaggaaaacttttaagactctttgaaaaagagtgttatgattgaagtcctgtgtcgagggatggggagtgggaagtggagggatttctgccagcattgccattactggccagactttgcttttgttttcaagttgtcacaggaaattgtaccatactgatggtagaagctaggtacaaaagagctacattatttattattatgccattgttgttatttaaacatttaaaacaaagcattaataaaattacaaaattagaaataaggctgggcgtgatgkctcatgcctgtaatcccagcagtttggaaggctgagacgggtggatcacctgaggtcaggagttcgagaccagcctgaccaacgtggagaaaccccgtctctactaaaaatacaaaattagccgggcgtggtggcgcacacctgtaatcccagctgcttgggaggctgaggcaagagaatcacttgaatctgggaggcggaggttgcggtgagccaagattgtgccattgcactacagcttggccaacaagaacgaaactcctctcaaaaaaaaaaaaaaaagaaaagaaaaagaaaaaaaccacacaaaaagaaataataccaattatatctgtacagaatatccaaattgtagctctaacttcactcttgactgtgaatacctcaaacttgtgaaactaccagcattggtcattttgattggtctgcttgcttccctctctcatccttggggaggtgccattgaccaggttggtgaccaaaggctgcgtagaggagcacggagtgtgagtgataaccagccccttgaggaagctttccctgagagtggaatgacaggacaggacacctgtatctatctttgctttaaaatcattcctgcacaaaaagcgatctttaggaaagccagtcaaatgagcctttgcttccaggtttctgaaggggaaacagccacttgctatctttaccattcattttcccctcctcccttggagccccttatcttcctgggtagttactcctgactgtaatatagtggctctaatgtagtaactttaatatggtagcttatataagcatttctcctataccatgagtttttatattacaaattgaatgtaatataatttgtgttgtactgacagctatcagttataatcaggaataagattataacttattataacaccatctgaggatgttatttaaatgtttgtttgcttgactttcagtccctatttagataaatgcttagaaakgagaagctaggttttatcaacctcttgactacccatatcttagcatagtagtacttactggttgaatgaagtcctgggtcgagggatggggagtgggaagtggagggatttctgccagcattgccattactgggaaagcctgaagaagtcattgcttcctcaggtctgcttaccttctgtactattacgacatctacctgaaagtgcagcaggagctcccccacctccctcagtctgagatcaataagaagattagtgagagttggaggcttctcagcgtggccgagaggagttactacttggagaaagccaaactagagaaggaaggtttggatcctgtaagtaatttttttttccagctattttttccactggttcagtgatgaaggccttgggaaaaccaagccccttgttctgtttccttttcttttyttgggaaaastttcatcgttttatccttcttgactctgggcttgcttgtttccattttgataatgccctgcactctcttgtcctcttcggttgcagcaatacgtggagctgacatttttttgtgttttctgcagtgagccttaggttccttttctaaattttagtgtaacttggagcccctcatagttactataaatagtagctttaatgtagtaaactttaatatagtagtttatataggcatttctcctacgccatgagttttcatattacagattgaatgtagtatattgtactaactgctatcagttataatcaggaataaggtttgcatgtttagaggtagatagagctgcttgtgtaatacagtaccacattattttgttagcactggtggttggaaactatgctraaagcaaaaatgcaagtaaagccaaagatggtggaggagaccaaggctttgggtgcttgggttaaaggactaacaaggaagcatttagaattatgtctgtcagcattttcttatttctagttcacagtaacaaaatacactgacagctatttaaactgctgggtttttgtttttttgagagtatccctgtcatggcataaactgctgtttttttaaactgaaattcctgcaggaagaataaccttgctgttgcaggctggaaccttttatccttaactccttatttcaatagaaacagttgtctgtaacttctattttggtaatgtagagcaacagcaacaactacgttatagcagaacaggttgtattttcccttattggagctcatcagctactgccatttaaattattttgtgcttattggcctggcattcttctttctgggagagctttgtcttacctacaggcttggagatgctactctctgctccctcctctaggtgatttgtttattaacagtgaatctgggaaataatccctatagtggagtggagatggagtctaagaaaagcttatctactccctttggtttccttattataataaaatcagctgtctaggctgggtgtggtagctcatgcccgtaatcccagcactttaggaggctgaggtgggaggatcacttgagcccaggagtttaagactagcctgggcaagttggcgaaactctatctctacaaaaaataggaaaagattagccaggcgtggtggcatacacctgtagtcccagccactcaggaagctgatgtgggaggatcacttgagccggggaagtggaggttgcagtgagccgtgattgtgccactgcactctagcctgggcaacagagtgagactctgtttcwcacacacacacacacacacacacacacacacacacacacaaatcagcaatctttttgtgcatgataaaatcctacgtaatcctggagtgatttgatttttaaaactacacactaatgtagatcattatcaagactttaaaaaaatttaaatcatctgcaatgattcttccttatttacatgcttatttctatctaccactatctctaccactgccaccaagaacatgagtaggttagttctgataatagctgagtgaccattttaacttttgagtcttggtttcctcatctgtaaaatggcagtagtctcttctcataatgtttaaaataggtaatgtaaatcacctagctgaattcttgataatactgacataataaatattaccctttagtagattaaacattcattgactatataataaggaaaagtggcatttattgagtacctggaatgtagtaagactgagtgaagctttatgtgctgtgtttgacctctcccagactgcctggtgtgatgggaagaccctcaatgcccacataccttgggagcctgtcagagccctgtggcaggctgtcctccttagcagcccttcaggtctcttgccaagtgcaggctccagtgatatgccttctagtctataaaatgagtatcattcaggccttccaggtttctttgtgcttggatttgttaagtccaggccatgctgtgtgtatttgncaccatttagtcttgttctcctaacatggctgcttcaaagggtggcttgagaatgccatttccccattacctctccaataaaggctccataaaagattcagtccatctgcttttatgtttcatctgagtgctgcttttaacttttcatttctgagtgcttcctttatgccttaagtagtctcatcgacttcttgcttttgatttattgaagaatccttttgtagttgactttagtgttcattttaaaagatacttctgaaatttttttttgttctgtttaattktaggtctcatttaactgttcactttgaacttttctgttttccttattgggtgcctttaagtttaaattgaaaaaataaaacataaatgactttttcttggtgccaattagccattcaggactgtgctttttagtacctggccttcttgatacttagaagacctggcctggagtcccagctttactgtttactaattttgtgtttagggaaagtttacctccctgagtttcatcctaaatnttctcatttgttaaatgggaataataatcttatctaacataatagtgttgtttttaagataaaatcagataatgtgtttgaaaacattttctaaacctgaaggtactgggtcattgttaatattcacatttttttccgtagtatattcaggaccttgtcacataaccccttctatatatactttctgtcacgaagccttctaatgaagacccttagctttgtgatctgttcatcctcttctttgtaagtctggggaaaaccagtgaggtcagaatgcttacttgctgccttgagtttcatcttagcctgttaacttgtattttatgctttttgggtttttattgagcgttatacattctaatgtttgaatcttatgctgctttggaatcctaaagtatcagagctcaaaaggaactcataaattgccagattcagctcccttgttttacagatggggcagctgaggcctcaggaggggaaaggatttgctcaaggctatgccagacctcaggttctagctcacagtttcatatggcaagaccagtgctctttccagagttcagtccatgctgtttcctgtgtgactgagtgaataagctayattggctaaagtgtgattcaaatgaagatgacactgctgttgacaggggctgaccttatctgaattaggtcaagagagtagagtttttccagtcccttttgcaggaaraaaaaagaacttacacatatatatatatctttctctctccatgtggtcttagtccatttatctctgcttgtctyccccttcctggcttcctcatcctcagaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtcccygaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtrtatcagtggtaacagtcatgagggtaagtggctttggtactgaagtctttggctttgtctggagttacttaaagggcagctagcaccatacagtgtgattccagagcagtggtaatcaagagtactggtgtggcacttactgatactgcagttctcttgaatgtgtcttgcccctgggctcactccagagttccttgaaatttctcaggcactcttaccaactctttgcccagcttagccagaattttcttcacatgagatggttcataagctacattagcaagaaagctgcaaattgtatttgaattatccacgagtcaaagctaggatctgtcaggcaatttagtatcagtcaggattttatgttttctgaagactgcttccttttcttgaaatgggatttcactctgttgcccaagctggtcttgcattcctgggcttaagcagtcctcctgcctcagcctcccaagtagccaggattataggcttgtccatcacactggctccctgaagactatttcagcaaacaatggcaccttgagctgtgtacaagaattttcacacaagacctgtacccaggtcttcctggattcagatggggtaggaagaaaaaagttatcttcaaggccaggttgatgggacttacctctgagaaagaggaagcaagtttctacagtggcctaagtgtcattctcagttgaggggaaaacagcacttttagtgatcccaacaacctcatcccctagaagtggaagtggagagaaactgctaccatgccatagtataatatataacctgccctctataaccttggagaggatagcattctcagagatgggagtctttctgtgcaggctaagaggaccagcttgctgtagcccttatggcctgggcagaagagaacaagtacccctgcaatctgtcccagggctaaatccttatttgttgcctcagtgctgtttatgataatgaagcgtgcaactagccggttgttgttgttgttggttggttttttttggtttttttttttttttttgagacggagttttgctcttgtcacccaggctggagtgcagtggcacaatctcggctcactgcaacctccacctcccgggttcaagagattctcctgcctcagcctccaagtagctgggattacaagcatgcgccaccacgcctggctaatttttgtatttttttttttttagtagacatagggtttcaccacgttggccaggctggtcttgaactcctgacctcaggtgatccgcccgcctcggcctcccaaagtgctgggattacaggcgtgagccgccgtgcccggccgccactagcctgtttaaagcaggtaaatagggtgctgagaacacttgaaagggttagaattggattctctcactaactgcttatgtgatcttagaagtcctaaatgtcttagaacctcagttttctcatctataaaataaacatagcacacttcctgtggaaatagttttctctttgttcttaaactttttgagataatcataaattcattccttttgataagcacattgggatgagtacactgtctgttattaaacttaatccaggcttccagtgttgagtggcctgggtgttctttattactctgtttcagtgaaactgtcyttctcttcattgcccataggattccagtgagagtagctcctctgcaccagccacacagttcatcatgttgcctctgcctgcctactcggttgtggagaaccccacctccatcaaactggtcagtactgtatgtgggggattgatggcaattagggtgtcataagcattttttttctaagtagatttgtctttttttctttctgagctaccagttgtaggaccaagaagatttctaaaagtcttagaacctcaggatgcgaggactggcaaagatttcagggattatgtggtccatatgttcttaatgggggtgagggggttgtagatagatctccatgggatccatgaactcacctcaagttttatacaaacttttttcctggaatggattccatgacttttataaaattttcgtaagcatacatgatttaggaaaatgagcagccactgatctaattcaatactgtgatcgtacagattaggaaaagggccataggagagaaaggacttgttcaaggttacaagacaagtcagactggattcgtttcttgattcccagttgatatttttttcagcattggggctgagatttatccctgtttatctttttctcacactattataaatggcatttttagaaaattttcaatatctgattgcctacaactagtatatcgtaatacaattgattgctttgtatattgggcttgtattctacaactttgcttaactcacttattagttctggtaacttttgtagatgctgttgggtttcctacaaagttaatcatgctgtctacaagtaatgacagttttatatgtcctttctgatttgaattccttctttttcttgccttatgatattgtctaggacttctggtacaatgctgaatagaagtggtaagagcagacatctttgtcttgtcctcatgtaaggaggaaaggattcagtccttcttcattaagtatattaactataggtttttcctacatgccctttatcatgtttaggtagttccctctattcctaattttctgaaagcttttatcaggaatgcatgttggattttttcaaatgctttttctgtgtctattgagagtattataagaattttccggaagttggttaaggtggtgaatttcactattactcaaattttaaaccacccttgtattcctgggacaaaccccatttgacagtgatgtantatccctctcatagattgttggatttcatttgctaaaaagtttgctcagaatttggctcagaatttccttatacagtctctgtccacttttcatatcagggtaatgcttgcctcttaaaatgacttgggaagtattttctccacctcagttcttttccttaaatggtagtattaccagtgaagtcatctgggcctggagttttctttgtgagaaggtttttaactgcaagcccaattttaaaaatatgtataggactattcagactgtctctttgagtgagcatttggtattttggctttcaaggaatttgtccatttcatttaggctgttaaatttattgacataaagttgttcataacattcccttattaccctgtaataaacaatgtacttatctacaaagataatttgaactgttgtttccctattgctgacagatgaaaaagtttagaccttaaaataatacctgattgttggccacttctggttaaggccactctctccagctttccagtgacaggtaatgctttacattacaaccaactaatattctaagattcttaraaatggacaaaccacttgttgcttattttgattgtttctggacagttactacctgtgtggaaaaattcagggtgctaaacaacagtgtcactttatggcctggtactacactagagcatgtcacaagttcgcaagggcggtggctgctccctctactaacggatactaccagagaccttcacacagtgcagacctcggttactaacacctaaatattaacacccatgggatttgcagtccctatgttcatgtctagtacttgggtaagctccacaccaggcacatattgttttatgcaatctttaaagacatctgcaatagacaatatgcagtttaaacaaactgtgaggtttataaacagagaattctttacgtttgctattatgtcataacaggcacaatctgaaatacaattttgtactagcagtgtataaaaatacttttaaacgatactttcgataggtacagtagcactttaaagaaaaccactgtgtagttattccttttgaggacctactaaaacagttcaacttactgcccccagctacatctaaagcacgaatgtggaaagcaagttctcttacccaggtacacaccacacacacccacatgctgaaacagtctccatttatgatgcatgctgatgaggcatcaatctcaaacagggtatgagatgacagtgtttggtgcctgtttccatttccaggtttggtatgaatgaacaagaggcaaaggcaaggtggagtctgtgtatgggccctctctaggagtttaatctggcatatcaatatttaacttgggaggtgggggaacatatttcccagggattaaaactacctggtcttcccaaacactggagcaattttcggagcttctggaaccaatgtttcttcagcaccttygctatcttcctgatggagatcatatgaaatsttcccatattctcttaaaaatgggaaaatttcaagcagaaactggcagaagtctctgcgaataccaaaccaccaatgattgcccctttttggcctaaatgttgtggtcattaaagttagtaacaaaagccaaagggggacagatatggagatacaggagaatgtattgcggccatccagtctgtgaaccagcaggacttcaaaggtgagcagggcacgatgacagtcgttatccagctgatggccatggtcacgtgtgttcttcactgccctggtagttctcatttgttctttttctagtttcttaaggtagaagctgatgtcattgattcaaaacctttcttttcttttcttttctttttttggtarataaggtttcactctgttgcccatgttagagtgcagtggcacaatcatggctcactgcatccttgacttcctgggatccacctacctgccccagtctctcaggtagctgggaccacaggtgcataccaccacacccagctaattgtttcaaattatttgcagagatgggggtctctctgtgttgcccaggctggtcttagaactcctgggctcaagcaatcctcctgccttggcctccaaaagtattggaattacaggcgtgagccaccgtgcccagctctttctttcttttctaatgtaggtgcttactgctatgaatttccctctaagcactgctttagtggcattccacaaattctgatatggtgtgttttcattttcattcaattcaaatactttctaatttacttctttgacctatgagatacttagaagcgtattatttactctgcaaatatttggggattttccagatatctttctgttattgattaataatttaattccactgtggcctgacctttttgatttatttaaactgaatccctttaaatttattgagacttgtcttacggcccagaatgtggtctgtcttgataaatgttatgtacacttgaagagaatgcatagtctgctattgggtggaatgttctatacatatctaattaggtcaagttgattgataacgttcaacccttttatatccttactgattttgtctacttgttctatcaattataagagaaggcatctggccgggcacggtgatatgtgcctgtaaccctagcactttgagagactgaggcagaaggattgcttgagcccaggagttcaagaccagcctggacaaggcagggagaccccgtctctacaaaaagcaaaaaatagttgggtgtggtggtacacacctatagtcccagctactcagggctgaggtgggaggattgcttgggcccagtagttggaggatacagtgagctgtgatcgtgccactgcactgtagcctgagcaacagagtgagactctgtctcaaaaaaaaaaaaaaaaaaaaggaggtgacatttaactatccttgtagatttgtctgtttcttacagttctcttaatttttgtgtcgcaaattttgactctcttgcgaagtatgtaaacatgtaggattgttgtgccctcttgataaattggcccctttgttattacaaaatgacctttatctctagtaatctttgctctgaaatctactttgtctaatatctagcttttaaaaattattgttacatcaagaaatatatttttccatccttttaactaatttatatctacataaagtgtttttgttttgttctgctttgtgtagatagcatatagtttcaatataaaagcaagaccctctgacagtctctgtctttaaaagaggtggtttaagccatttatatttaatgtgattattgatatggttacatttagatctattattatttgtctcatcaattttgttctgccttcttctgatataagtattttttatggatctgctttcttttattggcttattagctattgactttgttttggttattttagtagtttctttagggctaaagtacatatttttaacttataagtttatcttcagagatctctactgagataaacaatatgttgtagataataaagctgcaatattttaaaataggaacagcctgcagctttgactcatggagaaactggttatttctcctgagtctttattctcctggaaattactgttctttcatgctctaataaatgtcagccaagcacttctagaaaagtgttttatgattaatacttaggactgaaacgtcatccttgaacattagcactttttttcctaaagtcatttctctagcctacttaacaatgttaagaatttccaagtccatggtaatttacttatgaaactaacctatcttaaatttttactctgctttcttgaggtgttcagaatgagaattatacattggccataacctgagaaaggatcagagatgttttatattccactattaatagtctctcacaagcatgtagaatctaagtgaatgttttctcatttcttatctcactttctcagcaagacacgcctataaaataggaagaacaggcgattttacagaggaagaaactcagggcccaagagttaaggttccttaccaccaggtcactcagtgtattagtggcaaaattggaasccaaagcctggtcttcctctttttggtgccataccacttcacgctcatccttgacttaataccactgtcataattggaagccataattgaagccttttccttaggcttccttgcagaggtagctaatggtagtttggtgtttccccaaggaagctttttgcgttttggctgggctagggaagctgggattaatagctgagtaaacattcatatgtgacagaacaaatatgacagagaaatgggtttttttccagccttaatctagaagcggagcatgactaatgaatgagtcgtttttatttgtagctgaaatattataacccatagtaatacattttgctcaaagggagatcagtggagatgataagagccagtggctatatatattaatatgcaaataactacattctgttgagtatcaaaggatagggcctggcttatagtcctgaactgcccttattttttcagtgaccatggatctatttttattctgaatcccaggtccttggttgtctgaagaatgaagatgaagcaaattctttgaagtatttagagccagagggtgcagctggatgcatagaaggaatgttgggccaagaatagagaaatatgggttctaggtctagctctgcccttgattgatgatttgaggcaaagcatttaaacctcagtagtaataatacgtacttaatacgattgctgagagtattaaatgaaatattggtaaagtgtttagcattgtgtggtgcctagctcartgcatagcaactatcactttcttcattcttctggtacctaactgtaatgttgggcaattgtctttccccatttgaacttagtttctccatttctaaagagtgaatttgttgtattgtaggacctttccaacactgaccttttatgatatgattatgaattggttatctttccacaagcttgtgacctcctggtgttgctgtgattatagtggtcatcagtctgagagaggttgttctattgattctgatgtgctctttatttacagaccactacatatacccgccggggccatgggacatgcaccagcccagggtgctcctttacatatgtcaccaggcacaagccacctaagtgccctacctgtggtaacttcctaggagggaagtggatcccaaaggtaaggtccattggctgttgctgctttggaagcctcacagaatagactttctgtttgccattaggaacaggtgatttttaaaaagttaacatttgtttttactgtctgactatacaagtaaatcatttccattgtatatagtttgtttaaaaaatacaaaagaaaaatggaataaattgttatccaaactcatataccatccaaagaaaagccattattracattttggtgtacttctttccagtctttttttctgtgaataagttctgtatctgtttttttcttcttctttccyttcttttttttttccagtagagatggggtcttcctttgttgctctggcctcaaacagtctcctgtctcggcctcccaaagtgctgggattacagcactgtgagcactgttttcccttttatttttctttctgttttttcgtggatatctccaatactataatattttgctttttttaatttaacatatcatgcctttaaatagtcttcaaaatagtacctgtttcataatttccatgaactactacaccatgtttatttacttgtttctgtcatccccccgtctgtatatagagatgtctgtatctatatgtctttaacatttttatttaacactcatcatcagttaacaatgtttctgtttatgtcacattgtgagttccttaatgaccttggtatctcccacagcctttgcccatagaagacactcaataaataaatgagcatcactgctgtgcccttctgaagttccgtttaacatgttgtcacctgtgtatgcttggtgcgaactagataaaacatatatacttgccacattttttatatgaaactatacattttaagggctaaaatggatggaagaggcagtaaattctcacctagttcagagaggagagacatttataaggactgagacagacaggcaaggtattatagaagagagagagttgaagattcaacagaatttgggtgggtagaaaaggaaagagaggacattattttagtgaaaatggcttaggttaggttcgtgattatcacatgtttaactcagcatgytccaaacttgtatgtgtagaaaaaccttgtatagcagcataccttaaacttctctggggcaattttcacatctctttgagaaatactgggatggtgacttttgccctctggatgagtgttttggcttctggctaagttcagggtagcactaattccaggagacaggataattaagaacacaattctggagttagctacctcagttcagacccctgcttcccaaggtttttaactatgtaatcttggtcaagacattctatatctgttcctggatttaagttttgtctcatctgtcaatggaagttagtacctacttcattagggatgttagcagggtcaaataagattatccatatagactaaatggcagtttctggtacatattaaatcctcagtgaatgtcctgctatcatcatgatagacatcaatgtaattattagccctactattgctcttcatgttgtcaggaagggcctagtgctaatgtctcacagggggttttgtctaaggctcttgtgccatcttctctgatgtgcctctctgaagccatcagtgtattcacaatgtattccccaaaaaggcagttctctaactgcagtggggagattgaactggatagtagtcagaatcttccttgrcctttcttgaccaatgcgaaacaggtctcaaatgaccatatttcctgtgcttatacatgaaagactgtcagtgatcactgtgggcttatccctccttcaggctatttttactttggctttttcatttcttgtatgtgtggctttctttttcatttcttgtatgtgtggttttttttccactttgaaataacttttttttttgggacagagtctcttgctatgttgcctaggcccatttcaaattcttggtctcaagtgatcctcctgcctcagcttcctgagtagctggtactataggcatatgacatcataccatcatacctggctttaactgaaacagctttttttttttttttttgaagatagagtcttgctctattgtccaggctggatagcacgatctcagctcactgcaacctctacctccctggttcaagtgatccttatgtctcagcctcccgagtagctgggattacaggcatgtgccaccacagccagctaggtttttttgtatttttagtagaaatgggatttcaccatgttggccaggctggtgtcgaactcctggcctcaagtgatccacctgcctcccaaagtgttgggattacatgtgtgagccatggtgcccagcctgaaaaactttagagccatggttctcttactaagatcaagctcatggcatgaaaacaatttttttcttagctaccttcccccatcttgacttgctaagtcagaatttaccaatgtgttctgcaaggattaccatgtcaagagtagatactgtgatttctaaagcttatagaaacagaatgagtgtgagaagacaggtaacattttaccatcagtgcacttagaattttagaaataaattgactttgattatcagctacttcaactcttttgagtttccagctaaggaaaaatagattttgaaaaagcgacttactaaattcacacagccaattatcccattgccttttccactaaaccacacttctcagkcattgctgtgctgtttagctgcagaatgtaagacaagcttgtccaacctatggcccaggatggctttgaatgaagcccaacacaaattcataaactatcttaaaacattgagattttttgttttttaacaactggtaatcaatgtattaaaatagttgacttaagcatctgcagtggtgacttgcacctcaactcctggctcagtactgatggaagtaatttgcttaacaatctcagaaggactgtgcaagtcaattagttgcttgtggattctcctatggaaacattcctatgtcttagaaccttgaccacaagtttttcttgtagtgattctcaaagtcttggtaggcattcgaactgatcctttcactgagattcttttcctttgctcctctgatcaagtcagcacacatcttctccagggattttatgttgcagctcgttagagtgatttgaattcggtgaattgccacctccagctccatgggtgtttttccggtgtctttaaaagccttggctgcagcgggcttcctgaccgacttgttccttggcgagagagaacagcggtgagtcaggagcaggagcgggcaggagcgggcggaccgcagctccgcaccacctatgacygtgtcttcctcaaagagcaaaacattatwtttttttgtgtgtgattattttatttttatttttttaggctcatcagctattgttagtgttagtgtattttatgtgtgactcaagacagttcttccaatgtggcccagggaagccaaaattggacaccccgatctattaataagatttcttgaattctgatttttgaggcagcaagtataatttgtctctaaaagctccaagtgtgtttgtgccagccaggaaatgactcaccttttgttgtattgttctagagttcatactggctaaaattagcccaagaaatatgtggcatagttcccaatgagttggataaaacaaaagatagtatataaggctgtttagctcaaggcttcattcttaaggctctctgatggcagcagttgaggtctctctgagcctgcagcctcagagaattttgaaagtaacatctaaaatgagtaggctgagttaatgaaatgtgagatcaccaggtagagttgttttgctcagattgcttaaattacccaatctttctgtggtgatttttgtctaaaatagcctacttagtaggcagtgtttgctcaaaaatcttatctcaaaaaatgagtttagtctcctgtttttctgctaaattttccctctcctgcagtaaataagctctgtgcacttgacttggaatttttctccatgttaactcactcttaggggctattatgtgttagaatctgagaatgctttaccaaagagctcttaagaggtcacctgttactggctcttttttttttttttttttttccagacagggacagggtctcgctctgtcacccaggcatgaatacagctmatgcagcctcagcctcctggggtcaagtgatcctgccacctcagcctctcgagtagctgggaacacaggcacacaggctgcataccaccatgcctggctaatttttttttttttttttttgtagagatgtggtcttgccatgtttcccaaactggtcttgaactcctgggcttaggtgagcctcttgcctcagtttcccaaagacttaggatcacgggcatgagccatgacgcctggctgttaccagttctgaactagaagtgcagtatgcagatggctttggaaatgttgaggggtttttgggtagtaagcgactgggagataaatcattgaaatttagtgacattggcacagacactaaactttctgtaatgtgcagggaggtcctacacactatagaattaggtcacccaaaatgctgtctggctcctgttgacaaatactgagagcccaaccctttgctatttcataaggggaaatgaggattcaattgaagcttgccttataccacataactaattaggagtggagctaagcttgatagaacccagcctttatgtttcctagtttacagtgccctttatgatatacatggtgggtagaaaacctttctgaagacaaccactatttaaaaacatttttaaaagcrtatgtgtgtatatataatactattatttccactgcagtgctaattggataaaagctaagacaccaaggactttttaaagccaggtctagctraaatagcagctgccatttttagtgagtttgaatatttgtagcacataataatgcatgagttaatttgatccagtgcaaagtatgtgacatatgtgcaagtcattcttaagactctccttaaagaatctgggacaaaaaacagaatttttcccaaaggagatgggaaaatttgaatctgtccacatgaggttgcggccacattgggattaactgaatctcataaaaggaccaccaaggtgaacaacttagggcttttaggccctgtatggcagtatgtcaccctctttctagacacacagaagtagcctttgaataatgtaaaactaaatgtaaanctaaaaaatgccaacatttggttgatgaaacctggagaagcttttcaataagaattcattagaagatgaacagttttattcaaacgaaggcatttaatgctrtagtgaaaggaacctgtagccagaaaacttagattcaggctagttttacacttgagatcttaagttaacttcttcctttcatggaccttagtttccttatttattgcccatatgttattaaaaatgagagaatgtttgtgaatgtcatcaactgtaaaatcccttatgtatacaaggtattcttatttttctaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcycatgttttggttaaggaagctcccgggaattgtggtacagcagtcactaagacgccagtcgtcaaaagtggtgtgcagcctgaggtcactctggggacaactgacaatgacagtcctggagcagacktaccaacaccatcygaggggacaagtacctccagtccactccctgctcctaaaaaacctacagggtaagtcagtgtgtttgtataatatagggctttggaaatgccccatgtttcttttatctcatgtctgtacagcatgcctgagagaggcagcagagaccaggcaatggttcctgttttagagatacagaaaccaaggcctagagatatataaagattgtcccttcccccggactctgctattcatgtactgctgtcagattacttacacatctcttcttgtcagtctccctaaagcattaattagagwcttgctggtataggctctgggcagtattaaaactatgagttaccagtcctggatactggatttggaaagagaatctttattaaagcatcctgtagaaagagttctggccttatagtcagagaactcagtactggttctgactgtttctggcttctgtttgactttgggcattgtcacttcatgtctcttcacctcagttctctcctctgaagaatcttgagttggatattagaaaatcttatcctcacaggctgactgtacaaactgaagattgtatataaaacatgcaaccaagtaccttgcaagtcggaggaagtcactatctttttctccccttttcctccttaaatgcttaattggattctgtgtatatcccttccctgaggaagttgtgttcttgtaactgaagacccttatttgtatcaatggttctcaactggtaacaattgtgcccgcaatgaacaccagaagccaattccacttttaactttgkctggcttttcctggaaaaataagaataccttgtataccttgtatgcaaatatgtatgtgtgtgtgtgtatatatatttttcccattttttttttaacacaaatcatagcacaacatacatacttctacatcttgttttttatttttatgtttatttttattgtttgagacaggatctctctttgtcattcagtctggagtgcagtggtgcgaacacagctccctgaagcctcatcctcccaggctcaatcgatcttcccacctcagcctctggagtagctgggactacaggcacgcactaccacacctggctaatttttgtatttttttttttgtagagatggggttttgccatgttgcccagactggtcttgaactcctgggctcaggtgatccgcccgccttggcctcccaaatacatcttgcttttttttgggatggaatctcgctctgtcgcccaggctggagtggcgccatctcgtctcactgcaagctccgcctcccgggtccatgccattctcctgcctcagcctcccgagtagctgggactgcaggcacctgccaccacgcctggctaattttttgtatttttagtagagacggagtttcaccgtgttagccaggatggtcttgatctcctgaccttgtgatccacccgccttggcctcccaaagtgctgggattacaggcgtgagctaccgcgcccggccccatcttgctttttttaaaaaaaatcatgtagcaatatactttggcgatggttttgtatatttaaaggatgaagctgtgcactttagaccttttgtttgagacacgtaaatcactctagcaaatgtttattgaggcctcctctgtggtataggccatgtgctcaacattggtgctgcaaagatgaagcaaacatggactctgttctctagggtctctaagctgctgtcataagtatatgctctaactagaggtagattagatgttacagctataatagcgattggcattacacgctgtagacatcgttttacacttctgtgtcttcgcaatgaccccatactgtataggtaattactgttccattttacatattagaaacttgaagttaacagaagaatgaaattacttgtccagggccacacagctatttagtggttgaatttgaactcaatctgtctaaagcttgacagtttaaccccaatactatcctctaagaaagcactatgtagagattgcgctttggttttcttccctttgttccagaatttccagatttctcttcttattcttttcagagntgacctgcttacccctgggtccagagctccagagcttaaaggcagagcacggggcaagccctcattactggctgcagcaagaccyatgagagcaattttgccagccccagttaacgtggggcgaggcagcagcatgggactgcccagggccaggcaggccttttccctgagtggtaagggctgggacatacctgggatggaggggctgtctgacaggaaagggacaggagtggggggttgagaacggacatagagacttggggagactctgaatgcacttaagtcaccagtttggctcctggttctctcagataagactccctctgtgaggacttgtggtctgaagccaagcacactgaagcagytgggccagcccattcaacagccatctggccctggtgaggtgaaggtaaggcccattttccagagtgggagctgtttgagggtctggctgcttccatktaatgtatcaaagctataggtaaaggcacatcccatttcttacacgttggcagacctctgggtggaggttaacatgaatgatttatctgttttttaagtaatttcttaaaacttaagtgaatacatgtttttaaaccttttacttagaaataatttataacttagaaaaaagtcacaaaaataaaaatagtacagagaacacccatatactctttacccatagtgacctattgttaatgtattagcccattttgctttatcttttatgttcatgtgtgtccccccaccatatgtgggtgtgtacacattgcatgtgtgtaaaatacacattatagggtaagttatgcctttatgcttgtttgtgtatttcataagaatagggattttttttttttttggtggcagtgtctcactctgtcacccaggctggagtgcagtggcacaatcttggctcactgcaacctccacctcctgggttcaagtggttctcctgcctcagcctttcctgagtagctgggattacaggagcacaccaccacgcccggctaacttttgtattgttggtagatatggggtttcaccatgttggccaggctggccttgaactcctgacctcaagtgatccacccacctcggcctcccaaagtgctgggattacaggggtgagccaccacgcctggcctagaataggaatattcttttactgaaacattgatgtatacctttactctcccattcatattccaaattgtgtcaattcgacctgtgaaccctgaaaatctgagacaggtctcagttaatttagaaagcttattttgccaaaattgaggacatgcacctgggacacagcctcaggaggtcctgatgacatgtgcccaaggtggtcagagcacagtttggttttatacattctagggggacatcagtcaacatacacaagatgaacattggttcagtctggaaaggcaggacaactggaagcaaaggcaggaagactcaaagcagggaggggacttataggttataggtagataagagacaagtggttgcatccttctgagtttctgattagcatttccaaaggaggcagtcagatatgcatttatctcagtgagcagagggtgactttgaatagaatgggaggcaggttggccctaagcagttcccagcttgacttttccatttagcatagagatttgggggccccaagatttattttcttttcacagacccgattttatatatatatatatgtatatatatatatgtatgtgtgtgtatatatatatgtatatatatgtgtgtttgatatatatatgtatatatatgtatgtatgtgtgtgtgtgtgtgtgtgtgtgtgtgtgtgtgtgtatatatatatatatatatttttttttttttttttttcctccagaaacaaggtcttgctttgttgcccaggccggagtgcagtggtgcaatcatagctcactgcagcctcgaactcctgggctcaaggaatcctcccaactcagcctcctgagtagctgggtacacaggcaggcaccaccataccaagctaatttttaaattttttttgtagaaacggggtctcttgctatgttgcccaggctgatctcaaactcctggccttaagcgatcctcttccctcctcggcctcccaaagtactgggattacaggcattagccacctccccagtgtcttctttattttattgtatatttttaaagcccctcctattctagcacagttcctttatatagcatatttttctccagtctgtgatccagtctaggatcagatattaacgtttagttgtcatgtctctttagcttccttttaaaaatgaatgcatggttgtagaaaatatagaaaattcaggtaaaggagaaagaaaagtccctcatgatcctgccacccagaatgaccatccgatgtgctttcaggtcttttcctgaatttgtgtgtgtttattttttaatacagttttttaaaaatcagaaacttggctcttactccatatactagtttgtggcttatatttttcacttcatttagtgatacagatattaaaaattttctgtgtgtccaaattccatggattagtggggttggttggttggttttttggctatatgtagctagaatagttatcaagttttttttttttttttcatgtcaaatgggtaatgtgctgacgttataatgaggtttgagggaggcacatctcacccatgtgcatgaataccagattgtcatacttgtgagctataaaaggatctctcaaaatttcctaagttagcatttttcaagcttttgatcatgaccttcagtaacaggcatattttttattactgcccagtaaacatatatactaaaggtttaatgaagctgtgcccttactatatgcagtcactttttttttctcattcctatttgcaaaatcctggtttcaacccattaaattaatgttatgacccctcattggattgtgacctgtagtttgaaaactgtgtcatggaccaggttggaataggaaaacgggtctgccatctcccrtgtcatgtgttctttgtcagttaacttcctttctttaacagttttacatttgccctgacaggaatatcaactggcttttactttgagaactgttttgttttccacacagatgtggcagctctgggtgtatgtgtgatcttgcggtgtagaaggaaggtatctggttagcgtcggtagttttgtatatttccagcccctagattcccttcatgtacactctgttacttgggtaaaccccagtcttctctgtaaatagtttccttttgattggtgacattgggtatttgttaaaagccacaagctcttttactagtcttaaaccagtaaagaggtacatgagatattcagaaaatcaacttaaattcattattatagaataattttaattttgtatgctttatcttttctttcttttttttagctatataagtaaaatatacattccttataaaacatttgaggccaggcatggtggctcttgcctgtaatcccagcactttgggaggctgaggtgggagcattgcttgagtccagcagttcaagaccagcctgggcaacatagtgagacccacatcgctaccaaaaaaaaagcaaattttgtagatagtggtaaagagggagaaacaaccatgattgtcctcttaccctgtgacattttagtgaatagtctttcagacatctttctatgcaaagttgttcaaccatgtatttatatgtataaaagctattatgtgcttttataactcagtagtagttgtaaatctgattcatggtgtttctaatacatggtattagaaactgcacagaagcatgtggcaaggcctggacttgaacatgacactcagcctttggtgggctkgtgactgccaactggcagtccagagggctcatttggagaatagctctacaaattccccgggaaagcattccctcaagtcgtttcaggacatgggagctcaggagtttggctaaggttcaaaagcrctaaataatttgttctgatccacagctaccaagtggcccatccaacaggacttctcaggtgaaagttgtggaggtcaagcccgatatgtttcctccatataagtacagctgcactgtcacattggtaagtatgcagctaggtggtggtrggttgacatggaggttgttttgattttgtggttgaaggtcagtaggaggctgggggagagrgtggtggtagctgggagggagaacagggtcnggtatagattgttaatgatgaagatcccatccctgatgcaaataatagctactggatgaatctgctgggttgttttggtctctttccaggtgagatttataaagtgtaggacagctgagattagtgtatttttattgagagttgccagagatgagaatctagtccagatttaacatttagctgtcttggaaccttttagcttagaaagggtgttccacagttacatttaggcaacgttgcctttttctccctaaaacagagtccagttcaacacgagtatcttaaagtaaaatagagaagtactttagtaaagcagcttattttgtttagcctagtgtttcccacagggttttccctttatttttaacataacacatattaacgtcctaatgsacaaatgtgtgacattgggatcacccttttgtagggcaggcagcatagagcagggaaataaatgctagacagctgagagacctggtccaaaaggagttctggctctgctgctagcatgccatatgccactgggcaagattctttccttctgtggtcctcagtttcactatctgtaaagtgctgcattggtttagacatctttggggcatctgtcactctcaacattctctaattctgttgatgcttaaagtatcaaccagcaagatgtcttttggcagtttctctagctgatttgattaagatgaacagattttgagagaacagctagatttttaaaaagtcttgcctcataatggcagacaggttcagaaagggtcattcattccttcaaaaaatatttattgagcacatattctgtactaggatctgtactggggattcagtagcaaacaagacagcacaatgtgatgggttaatgtctggcctgacctgatccataaggagaatgtgtctcttatcctggagatctgctcaggtttctttctcttgtgacctaaatataatcactaccttttccatgccttcactcaccactccctttggctacaggaggcaactagatttaccatttagggggaactacccctgagtagaccctctcttctgctgattagatagtaacttgtcataggagcttagatgctagagctttgagctttaatagtctgtaagtcacagtttgtcttcaggcagggcttgaactctttagttcaccagtctcaagcactctttgtttaaacagacctgctttactccaccaactgcctggaccctgaaggcatttgagtttctgaccattgagagtcaactctcctgtttcacagatagggaaggactggactggatttgccaaaaatttacagcctgtattaaaagtaaaagagttaactgcagaaaaggttaaggctcttgaagttaggctgaatctggtttgcagttgccactctcttctctgatttactggcagctgctcattctggttctgggttctgcccaggtttaacttaatttttgtagaattgaacactggtcttacttttttaggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgtgagttccttcccccaaacacatcccctggcctgttctgggctctgttagtgaacctgtcttagtagaaataagaagatttttaaagtacatggtggtagttagagcatccaaactgaaccagttggtgggttctgaacctgagcaagtgccgccttttctctgagcctccttgtccccattgccagggtgaaggggttgactaggtatcttgatctctgagaaccaagagttcactcactgcagagaatgatgtagcacaggccttaagtaggagtgaaaggagagggacgaaagggttgcatcctcttaccgctgaggcctgatacaagacctgtaagttgatttactgtttcggtaaatagagaatgccaacctaagactttgcagattagaccaccgctgctttctcaggctccttggaaagcttttagttaatcaaagctttatttctagcagtctaggcagccctcctctctgaagttgggccaaactacttgggtagtaaaatacattccacttggctccttagggctgctattattattattactattaccaggaaaaatgggcattttcagaggtccccagaatttccatatgagttttttnaagtgaacagaaaatggtggcacttgaggcagcaaatggaaggactaaaataaggatgagaagagaaatgtcactggtctgccttggggaaagaggggatggcacacagaacaggtcaggacytgagatggagcctggtcactccagatcaaggctggaccttgaaaggcaggcaggttttgaatggaaggggaaggcatgccatacttaagtctctcccactagactgtagtctggtgagtgaacatgaagtgtgagtatggataaggataagtgtgagtgataaggataagtgtgagtgaacatgaagagtgttccatttggctggaggagatggcgtgggggcatggggtgggagaaggggtgttacggaaaataagacgtgaaaagcatcttggaaccatgtcrtggaaggtcttgtcagtttgttctttagtcagtggggtcctactgaatgtccttgagccggggagaggcctagaggaaagttatttcaagaggggaatttatgggatgagagtttgggagtagacaggactacagaggtggggagaactgcttcaagcttagaggtttatttgtatatggagagaggcctttttgatgatgaatctcaccctggtctccagagtctgtttccgtgcttgaggtgatgttctgagkttattgtccttgtgagaaaggaaagtggaaccaaagtatgtgggcactaatggcttggtgggaaaaacactggggctgggagtgaccctgagttggaagcttccctctcccgagctttagtttctccattggtaaagtaaggtgggcaaggtagattagatctgggcantttactcttaagagacaggagccttagagaagactgataattgagtttyaaggagtttataaatccctgaaattgcatgcaaaatgggtccgtagctttcatcagattctcttgctccactggatgcctgctgctggaagtaagctttcttcccggattttcagtgggtttcaaagtgctcttcttgccatagcattgatcacaccccatattgactgcttttcttaactccctatgagaccacaatctcttctagggcaggtatgtctgtttttcctgcaccttctaaccctggagcttacatatacaaagtgtgtctatctgtaattaggagatagaattgagttctgtgtaggtagaagctctgagcattcctttctccttccagttcattttagctatttgcrcggtttgcagtggaagtgggtgttactctctagatctaggatgatgaaggaacttaacttctcaggtgacataggaaattatctagggacctcttgccaatttcaaatcccactcttaaacttatatccatctgtatttggttaactgagaactgcccacccccaggaccctcatctgcagaccttccatcactttccaatctcctaaagtttggagaaatacagtgtaattactgctttccagaaaataaagcactggtcagaaccacagggatcttcttgtgtgttgtcatttggagccccctggtagccagatgttttcacatctctgagatggaatggtctttagtcctttctatccttcatctctggcgagagtcacgggacagtattcctgccaagtggtcttccagctgtggtttcatagtcatgactgagaacacacagcctctcggggcagctcattctagtgttagtcagctcttctgtagccactgattaattaattctctcagccagcctatattgaatgcctgctatgggccaggctttcagagatgaataggacgtggccctttcccttgaagagcttacagtctagtgggagagaaagataaccaagctattacaaatgaaagttgtcataggtatgcggagttaataaaaagctccttattaagtgtcctagtctgttttgtgttgctataaaagaatacctgaggctaggcaatttataaagcaaagaggtttatgtggctcataatttggcagtctgtacaagaaccatagtaccaacatcttttttggtgagggcctcagactgcctccactcatggtggaaggcaaggggagccagcatgcatagagatcacatacagaaaraggaagcgaaactcattcaccacctcccttgctcctgccccacgataatctactcatgagggatctgcccccctgacccaagtacctccctttaggacctgcctccaacgttggggatcacatttcaacatgagatttggagacggtaaacatccaaactatagcattaagcatttaacttctacagagccatgtataatatgtccatcacatatgaatcagtatcttatgtgtgtctcaggcatcatgctggttgggaatcagtaaataagcagaatcctacccttactgaagcggggagggtggtggtttagcagctntcagatgatgaattctgcagtcaaggggtgcactcagagaacacaaagcggggagtgatttatgctgccttggcaaaaaggatcagggagaagctccattgaagagagacctgcttgagaaagacctatttttaatgagtatttcagaacattgttcctggaagcctctgactggtatacanaattaccttgtacccagaagccaccgagaattaaagacagataactttaagcagtgcagatacttgtttatgtatcaaaactatcattcatagagccttcattgcaccataggcattgtgctaagtgctttacttataatatcttacttaatctgtrtaatggctctaagagattactatttttatgccccatttcacagatgaggaaattgagactcagaaagattaagtaaattgccttgggtcccacatacacagctgttaagtggcatatccagaactgaaacctgggtctgttatcctctaaaccccatacctgatgaatgagagctaagtgttgaatccattaccaagagttgtatataatcctctcatttactgatacaggttgactatcctgtatctgaagtgcttgataccagaagtgttttggattatttcataatttgcaatatttgcagaatacatactgcttgagcatccctaatccagtgattcaaaatctgagatgtctaatgagcatatcccttgaatgttgtctcagtggtcaaaaaatttcagatttcagagcattttggattggggtgctcaacctgtagagaaactgagccccacagagaaaaataaccagcctttagtcacacagtgagttattagctgagctggttaggaacctaggtttgccacctatcagtcatgggccccatctgtctgctgctcccagacttttattattttagcctgaagctggctctttctgctctgagtgcttggtgatcaatccactctcttcccaggaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaaggggracaaaagtaagcaccccttaactctgcccctagctaccccatcccatttggctcatactgctcttttcttcagaaaacattaaaactataactgtgaagatgttattctctgccgtttttaggcttcctttaactttctgattgctgaaagtaaagtaataattggtaattatcatttctgttgaaatgcctgaaagttatcaccagattaggatttagtttacatctggactgccccacacaatgtttaggtttgggagttcattgggattggttaaattatgtaataaattcagagttacattaattgtagggatgattccacagattccaacaaagtggaaatacctacctagaaaatcctaagctccagcaaatgagaatttgccattgatcactgagccctggaactccataaagaagtctctttcccttctttttttttgttggtgatgtttctggtactagctccctggctgggccccaggagtgctggctgctgacagccagccgtctgcagacagtgactgcccaggtgaagatgtgtctgaacccccattgtctggccctgcacagcttcatagacatctacacaggtgggtgccaaccttctcttccctcagagcatcccaaagcaggcttgggaactgcctctatggatgagacctctggccctttgaggactgggccttctcagatggggcttctgaggaagggggagtcttcttcctaaatgtcttagtcccacaagatgacttttacctctcaagtgttgaagctctcaactgggatctttaaaataacagatcttcattgtggaagggctggaaaatgcagacaaataaaaagaggaaacaaaaaatcaagagcattgctactgccatgagataaacacttatttaacagtgtgatcaatcttccagaaatgtttattcatctgtgcagaatataagaaattataggatgtataggtttatagtctttctttgaacaaaagtacggttgtgctagatgttgttttggaatgtgctttttaaacttaggggtacattgtgggnatcttcctgtgccagcaagtagagaagtacatgaccatttttatagggatgtatggtgctccagtttacacttttgtgattcagtctttgtgtacagccctaatttgtcttttggacaaatactcagaagtggaattgctgcacatttaccctttcctcccctattattcatcaacatcaggcatttgtggaacactcaccgtgtaccagccattttaagactttggttgaatcctaagttttgtttgtagaattgagtgctgaagatgaaagtgtatttttgatgtattctctttgtcttagaacttaatggtgctttattttgaattcatgtttttaatgtcttatattattagattgagtttgtactattttatgctcttgccaacagttaacaaaagtgcctattaccctgttgtctatccaggctagtactcaggattatatatttatttagtcaacatgtattttaaaatttacatgtagttaagtgtgttgctccaagttccataagttctgacagatgcactaagtggtgtaactaccttcacaatcaatatatagaacaggtctatcacccaaaacattctcttttactgttcctttgtatttaaacccatccctctcccccaacctctggtaactgtttgatctcatctttatccatatagtgttctctttcccagaatgtcatgtgaaagcaattatggcacgtagccttttgagtctggcttctttcagtaagttaatcctttgagagtcatccatattgtgtttatcagtgatttattcctttttattgtggagtagttttctgtggtgtggatgtaccacaggttgtttagctgttccccatgggrggatatttggtttgctaccggtgtttggcagttacaaatagagctgctacaaatatttgtgtaccagcttttgtgtgaacctaagttttcatttctcttgggtaaatacctaggagtcagattgctgggtcatgtggtaagtgtgtgtttaattttataagaaaactgcattaccaaagtggctgtaccattttgcattccttcccacaatgggtaaaagttacagtttgctctacatgccagtacttagcattatctgtttttgtttttcagccattctaataggtgtgtctccgtataaactgtagagtcagcttgtcaatatctacaaagtcctgcttgaattttaattggattgtgttcaatctgtacacatcaatttgggaaattttgacatgcctaacaatgttgaatcttccagtccatagtctttctctccattttaataggttgtcagtttttctagtttcagcatataggtcctgcccatattttggtagacttacatataagtattttacttttttttttcagtgctaaatgacatggttcaatttctagctattcattgctagtatagaagtataattaagtttgtctgttgactttgtttttgtaaatattataatttttttaagtttatcaattttataggtaaaaacttgtgtataatcaggtaatttgttgtatttctttgtagtaggtagagtatatgtcctttttatgatcctttatgggtttttttctatagtaaatttcttttgtgttttcattcttcttttggtcttttttgttgacagttttctcccagtttatcgctctatttattcagttttacctctagcctgtcagaatgtgatatcagttgtcttttacatttgtacctggtgatttctgggggcgtcatgacttttgctttttaaaaaatatttgtatgggaccagagctttgctctcccttgtggtttcagcctttgcacttctccttacccttcttcactgggaacacatactccaaaatttgcttttgtgcagattagtgcattatgttttgtgcacatataaaatcacccacttttatttgtcttaaattgactgcgcttaaattcctcagattcattcatttcaggatttggtgttggagtgatttcatagcctttgttgtaccccttacacattcatgagctaaaggatgctcctggcctttccccaggtgaagttgtgtgaggtgtaaaggaagagtgatacctttggtcctgaggactgagctgggtgggaagaaagtgttccttttttttattgggggaaaaagatctactatatgtactatttcattattttttgtttgtttgtttaatgatgtattataggcaactttgcgtcagaacagttagatctacttctttttaaaaaaaaatggattccatgttggaatactttattctttttaatgctttctattttatgaattcaccataaattaattaaccctttccctattgatgggcatttagttgtggggtttttgttttgcctttttcaagatatataacttgaataaaatagagatggggctttgntatgttgtccaggctggtcttgaactcctgggctcaagcgatcctcccaccttgggagactacaggtctcccaaagtgctgagactacaggcatgagattacaggccatacctggcctgttttgtttttttgagatggagtctctcactgtgttacccaagctagtcgacarctcctgggctcaagcgatcctcctgcctcatcctcccaagtgcctgcaactacaggcacgtgccaccgcacccagctggtgtgtattctattttttgccattgtgtatgatacattaatttccttgttgcctcttcttaacctgcaggtctctttaatgtggggaacaagctgctggtaagcctggacttgctttttgcaatcagaaatcagatcaagctcggagaggaccccagagtgtccatcaatgttgttctgaagtcggtgcaggagcagacaggtaaaagttgttttcttccctttcccaaggttagtcctaagctccctcggaattttcagtgatggcatttggttaaaagactcattttgaagaagagtctgattattttgaaaaggagacattcttgacttcctaatacactcttccttttgaattttacaaatgccaaactaattttggaaagcatgaatctttttgtgcatccagggacccttagcaagagattacgagtgacttgtagaagtaccttctttgmtcatagggagacttggccccattgcatgttagactcattctgaccacacagctcctggatatctgcttccagtcccaaggctcatgccaagacctaagagtgaggaccatcctttctgtctagaatatttttcctccatgccctctttactcctatttgtgcttttcccatcccattcctataggctccaatccccctctaccttacctgctgtgagaacagatggagtagagcctactagagttacatgggcctgtgtttcagtcttggctctgccactgttgcagtgtgattttgagcaagttattcttgtgcctctgtttctccagttataaaatgaggataatagctcctcgttcataaagaattaaattgaggtgagattaatgacataacatatccaaagctttcagcacagcatctagtacttagtacaaggcagctatcactccagtgggaattgctctttgggttgccacctgagcacttgcaggccagatccctgaccctcagggtaggtagtacactggagtgttctttaaggtgaatcagtctggcagaattgctctacttactacccactggctcatccctagtggcttcagtgtctttttctgtgcccttctcagtgttcttgctcttctttcagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgangagaatgtgctagcactgaagagcgtggaggtaagtgcctcttagccaccgtgagggacctgcggaattttctcattttggcacctcccttcctatatgatatccccagggggtggatagctccagtcctgtctaggtgaggcaagtgagtttttcctcccacagcccaagatttcatttagggaatgccagatggaaatggaggcatttgtttattcagttactcacttgaaaaatgtatttatccagtgaataagtatcaaaaaatatatatagtaaatatattgaacataaactaaatgcatgttttagacacctgggagatagtagttaaacaaagtttckgtcctcatggagctcactttctggtttggaggacacaggaaacaaatatctgtccaggagtagtgagtgctgtgaagcacagtaaagctgggtaagagagagagaacagtgtcatgggaaagggcatttgtattttatagagggcagtgaggggggaaggcccctctgatacagtagcatttgagtagagatctgaaacccatgtggctttgtggaggaatattccaggcagagggaacagctcgaacagggtctgaggaaggcttgctgggtatgattgaggaccagcaaggagaccagtggtgcagctcagagtgtgggagggagggagggagtggtggggtgtatgaggtccagacagtgcaggaggccgacgctatgtagggtaacatgggctattttaaggacttacacagagtgaaatggagagccactgaaggggttggaggaaaagagtgacctgagctaacttaggttctgaactgaaaaattttcacacaataataacatcaaactcagatggcttcatagattaattagaacaaatatccaagaaatattattccaaacataggcaagtaacaaaagtgggcatgtttccccaactcatcatataaggttgtataactttggaaaccaaatcagacatttgatgtaagagaagaaattggggctgaatatactcatgaatatagatgaaagtctgaataaaataatagcaaatcagatctaacacagtaatgcatcatgacaaacttaaacacaggaaagcaaggttgtttcagcagtaggaaatatgttaatgtaattcactacttaaccgattaaaggggaaaccctatatgataatttcattaaatgtatggggaaaaaaaagttgtccagtatgattctacacccatatttatgataaaacttttagcaaacagaacagtaggaaatcttccttaaccttctttagggtttaaaaaaaaatcccatagattacttttccctgtgatcatgctatgaggtctggtctacactcacaggcagggactgcgccttgaatatgccagtagttgcataggagtgtgaggtttccatctctgaactctaccatagtaaacaagagcctgggacatgagctgactttcaggtactggacttgcatctcatgtgttcactgatcaggcaggtgcagaacctgtagagaacagctttggtgtattctggcaggaccactagacatattaagggttgaatgcatagtcctgtcttttacttcccaagtaagaaaccaggcaactaaaccattttgtttgtgttatctcatctagaggctgtttccagattgattcaaatccgcttgyctagtagtagtgttaataataatgcagctaagatttattgagcattttattactatgccaagttcttaatctgtgctaagtgctttactatatgacttaattttccctacaaccccatgaggtttttatagacataggcactgaagcccaagggccttgcccaagctcacccagccagagaagggtggggctgagattgaccttgctctttctcagccgctgactgtggagtctgcaccctaagcactgccattctcaccagtacctcctacgactctgagttctgtttcttctgatcatatctggccacagcaagtttatggtttccaagaatagacagaggcccacctccctgcaaaggtgccatctcctagtcctgcctggcacccgtcctgtcccaatcaaggctcctctgtcccagaatggagtagcattcccttcactctcagtttgcttgtctctttccttcagtggtaccaggtacttctttcatagaggtacttctttgttttgtgtgtggagagtagtgtggtatgtgtggggagagagtatcctgaagtctgtgaactaaaacaggaagttattgaacaaaacttaaatatgctgttatccatgaagagacttgtcagcccctctctcggagttgtataaaggaggaccctgtggttagtttgtgtactgggttggcatttcctgttcccttgctccttgtggagaggatagactcagctggcctcattcccctaggtgtgccatttacacagagcatgcactaagcacccctgtgaggtggcaaacaaagaggaataaggtgaggagaggagcctttatggggagcagtggttcttggactttagtgggtataagaactacatagggcagtggttctcacaactttttacagtggagggcttgctgggtcccacccacaggatttctgactcaggagatctggagtggggccaggaatttgcatttctaacaagttgtcagatgatactcttgctgcttgtccaggaccaccctttgagaaccattcctctgaggaaacttttttaaatgcaaaattaggagtttagttcatacagctcaagatgtggccaaggtttttacatttctaataagtaagctatacaactgtgattgaggtattaggatccgggtcacgttttgagagccatataagagggcattgcaagaagaaaaattgagtagcacaagcgctattaatagatgtctataagagataagtaaatgctgccctgggtagaggagatagctgtgtgctgatgatgtgtgggaggatgtcggcaatccacagggccttggaaaatggctggaattttactcaataggattctgctcgttcttgccagcctggtatcagcagtaagggtttgggctttggaactagacctgtgttgacgtgattgttctgtctcttcgagtgcttgaatactcacctcagccatccccagacttgttttttagtagttcattacaaagtgtctggcacataacaggtactcaaatggtagctccactttctttgtaagacagggaaaatgacataaacaaaggtatagaaacagaagggatttaggaactattcatgtctgggagagtactatggtgtgagggaaagaaatgtgaccaaaaggcaggtgggtacagagctgtcaaattcaaggccctgtggcagtgcctggctgtctgacttcccttcaccaagccttggcttccctgtgtgtataatgacggggtagrctgttgtgttgctgatgttctgtgactcccacagtttgaccttctttatcctgaccttctagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggtaaggccacctggtggctgactggggtcaaaaaagggctcagtcaagagtctgggacattgtccatggcaagatagcacagtggtagcgagagggccaggccccgctgcaggactcctttcagaaagataataacagcccgtgtcaaaatcccctagagtttaaagttgtggtgcagagttttgaagagctgtcctccatcttacatagcaggggcgcacagctcattgtcagccttctgggatacacacactgagtagcagaactcctataaaaaatgctgataaggctccatccccaaaggttttcattgagcaagtgtaggggcaggccaaggaatctgccttcaaaacaggcctcccagagggttttgcagctagttttatggattagacattgagaaaccctggactagcgggtaagaggataggtttctaacagcttgagtttgattcccagctttgccacttagctgtgtgaccctctgtcaggtcccatcattgccctaagccactgttgcttcttttacaaagagggtgcgataatagctacccacttcctagatcactgaagataaagtgagctaatgcggttagagtgatagccgccttttttaactgtaacccatagtgagaaatacattttgtgtcatgaygcagaatgatattcgtacatatgcaagtgtgtataactgaaacaacattcccaaaacagtatttttctttattttctatcttatttcatttttgaatttttggatatgacccactcaattgatattgtaatcacttaatatgttgtgatccactggttctcaaacagtgcttcctaatattagatattgaggctgggcacggtggctcacgcctgtaatcccagcactttgggaggcccaggcgggcggatcacgaggtcaggagatcgagaccatcctggctaacacggtgaaacaccatctctactaaaaacacaaaaaattagccgggcatggtggcgggcgcctgtagtcccagctactcaggaggctgaggcaggagaatggcgtgaacccgggaggcggagattgcagtgagccgagatcgcgccactgcactccagcctgggcgacagagcgagactccgtctcaaaataaataaataaataaaaataaaaagatactgaggtccacctcatattcctgctaatattttaagggcccaggcatcttttttttttttgagacggagtcctgctctgttgcccaggctggagtgcagtgttgtgatctgggctcactgcaactctgccttccgggttcaagcagttctcctgtctcagcctcccaagttgctgagactataggcgcacgcaccacaccaccacacctggctaattttttgtatttttagaagagatggggtttcaccatattggtcaggctggtcttgaacttctgacctcagataatccacctgcctcggcctcctaaagtgctaggattacaggtgtgagccactgcacccggcccccagggattatttttttaaggtgcccccacatagttctcttgtgctagccaggttcaggaacgttgtgtagagggcacttttaaaccgagagctgctgttcttttcttattgatgcagtcatggtaagcatctgaggtcttggttctgaaaaaccttagaagactggattaaaagctgacttattttagggtttttttcagtggcggtytgcaggatatctcactcagatgttccagggcagaaagccagttstaatagacttcaaatatctgcagaaagcgtggacctgacttgagttccacctctgccagcactgggggagggcttggtgcagagctggyttccactgtttgctgttttgtgggcctagccttggcctctggtgactggcggcagcaccctcccaccagcactgttgtctcttgcaggcagtggcagtgccttggtgaggctgctccaggagggcacctgcaagcttgatgagattggctcctacagtgaagagaagctgcagcacctgctaaggcagtgtggaatcccctttggggcagaagactccaaggtgagtgtcaagggcagtggtggatatcggggcttctggagtaggctgattggtccactttttaggncagggatatgaatatctgtgatggcatctgccttggacacaaggtgctggcagtcagggatgcctaggagatggtcaacagctagatgtgacatgtatgtggggcctggcctctaacagttcctcctgttgaaggttgtgagcctaggctctggggtcaggaatcctggctctcctccttactgtgtgtgaccttggataagctgctttatattttgagcttcattttccttgtttgtaaaatggaaataaccaaaatactaaccttgtgagattgttgtaaggaatgcactttacacagtgtctggttactacctatgcaagctcttagaaaatgcctactgttacatagtgtatgtgtctatgtgttttattcatacattatttactttccctttcatatttctgtgctgttgaaaatgttatgcttccttcaagatcagattcaaatgttagctcccctttgatggtttctttgccctgtaaaaagtgaaaggactcaggcctcagagtctggcagcttgatcagcagtctggctggctttgtctgtgacctaatcctttcagggcctccgattgcttacctgtacctagaggaggttgggctgatgaggctccaaggcccgctctgacccaggcagtttattcttttgctttgggtgttgggtgagtgtgtgatgctgagcaccagccgtggtcccttagcattngcccttatgtttttaatcttgtccttctactccaggaccagctctgcttctccttgttggccctctacgaatctgtacagaatggagctagagctatacggcccccacgtcacttcacaggtggtaaaatctacaaggtgtgcccccatcaggtaagaaaataactagggggagcttggagtgaatttgctaatgttgaacttcccatacagggactgatccagctcagttttggggggctagacttaggtcactgggcaacctccggcatagctgcccacgggtcaggtgctaccccstgrgctagggagggaggctgggtcttctstcagtattttttaagcaccctaccacatcctgggcatcagctgttgagggtataagggcgagcttgtataaagaatgacaaagatgtcgttcctccctagttgaccgtatattttagtggggaaataaagtcaccacagcttgtggcattggctctgaagaaattagataagggcctaagatagaaagtaacagggaggaacctgctgtctgaggtggcagagaagactgagacctgcaggatagggaggagcccattggtaagccagggaaggagtgtcacagccaagggaccaccaaggccgtgagtggggagacagagtgagctgagaggagggggtgttggagggctcccccggggggccagatcacatagagctctctaggccagagtaacagttcgtattttattctgactgatgagggaccttttggatggttttgaatgggaaatctgtggaagggtrtggacaaggtggcactgggttagctccaggacaggttatgtactagatgacagagtgggcccaggtagatcttggaacggaaaccccccccccttaacaggtactgaatgggagagaggtggcttatcagagccttcactgaagcacatgagtcagcagggggatctagctgtaaaaagagaatccagttcccaactactttaacagaagctgtgtctgaaggagatgcttaatgcttctactctgggcagatcagagcctgctcagggaattgtgttcatgcgacaggggatcatctcatgagaagcagctgacagcayggggagagctgtagatcttgggggctgtgatgggagtggcatcacttggaggtgacagccaagtgggtgtacccagagttgtggaatggtgcttggggggccctgtcagtggaggtgtttactaggctacattgtggattcccatctgggcaacaagcccactggggtctggtggggagcttgctcaaaatacagatgcttagaccctacttcagagaccttagtttcttaggtttgacctcgggcccaggcatctccattcttaaccagctcttagctgctgctgctgctatgtagctagcatagtgaactggtaggtgatgtggagagagtggggttttgaaagatgttctgaggtgcctttcagcctaagttgaggacaggatgctcccagctgtctctcagaagggcaaggatgagctggtgacttcatttaaggacagaagtaggaagggagcagcatgccatgggctctggcaggatggccatggcttcggccctgaagctgattgctcatcttcctrggaagaagcgagtgagaactgtacactctctgcagactggcttcctaattaaccctgcgcccccsacccttcatctcccaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtggtgagtcacctcctgaggaactgccatgtctcctcaagcctaccatgtcttgctctgtcacccaggctggagtgcagtggtgttatctcggctcactgcaacctctgcctcccaggttcaagcagttctcgtgcctcagcctcccgagtagctgggattacaggcacacaccaccacacctggctaatttttgtgttttagtagagatggggtttggccattttgcccaggccgttctcaaactcctgggctcaagcaatccacatgcctcagcctgtcaaagtgctgggattacaggcatgagccaccacgcccagcctactccgtaagtttttactgaccaagccctctgtttgaggccacagtatatcacttagtgtgcccaggatatcccaaaccttgtgttaaaagaggttgccttccagagaagcctagaaagttgccacctttgagagttattgtgcacactgacatattaaaggccccagccagccctggattagtttaattcaccatgtcttacatttagttgaccatggataacactgtatggcatgcctgttgtgatctgaagatacactggtttagaaaacactcatcttatccaaccctctccttttattaaaaggggawgctaaggcccagaggaggaaatggacttttccgggtcccacagcagattagtggcagagcccttgtctctgtgtcttggtatattgtaccagacagtatttctcaccagtcatgtaccctccaaggccagcaggccagcctttggcctttgctgaaatagatgtcagaactgataattaggaagaagggaagaataacaaaggttgagtgccccagccaggatgcattataggaagtgaaggcctctggctttgcctnggaggagtcattattgtcattactccctggggctcactggctccatgagcatgctggggactccagaaaagtgtcttaacctcagtcagagcktgatctttctgctcccytgcagccactggcctgaatggaccgggggcaataatagcataagtaatccaacatctgttctggaaggtggccactgttactgtccctgttctcacatgaggaaatggaggcactggcgggcaggggttggcctaggagacacrgtacatggwgatgttaggattcaaagagggctggctgagcctagagtgttctcntcaccagatgggttccaccttagtcattccttcttntcaaaatgcattctcatttctcttctagagtgtgtcctgcccagagctcttggaccagcattatactgtggacatgacagaaactgagcactctatccagcacccagtcaccaagactgccacgcggcgcatcgtccaygcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccrccttggggttgctcagatcaagacrgagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctsntagctggtgggttccgtggggcctgcngtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggttttggtgtagcaggagtcaattccgtgcacatcgtatggggcacagtgtggtcaagctccacagctgtgagctcgtcacttcatgtgaaggagggaaggaaagaaagacgttccagggaatttgcaggtactcatgtggcacaaagaaccagaggctgactgcattaatgctgttagtttaatgtggacagagacatcccackgcgtgactgttagttaggatgagtcagcttgggggagtttgtgcttcctgcttggtgtggccagccacatgccaaggtcccctgccttctagcccagaatgacgggactgggcagaacacccccaacttttagctgccacttggstcattacagcagtaccagtatgggggtgggaggggtgaggctgtggagtgaaggcggcgtatagggcagagactragaggtcctgtgagattcttagaggagccatcctgctccaaggggcctgagctgagtgtggtctgtgagcatctgctgctcctctcagagagggagatctcactctctgccagtctgtctagccccaaagagcctggttttctcagtatcagtgtagctcctggggacttcataggcataaagtcagtccatttccatgaagataaggggattaggaaagaaggttctactagttggcatagcaaacacgaggccaacaccatgagaacagtaggggaggcggggggtgagggctcagcccccagcccctgactggcagtgatggcccatgctcaggaagtgggatcctctgacctcccctgaatccctcaccttcccaagtttcagagctgggccgagctgttgagtgaaatgaccgaaggcagagtttgtatgttctccccgtgtcgccccatccatggaggagttgaagtttggaggaggggagagtggtactccctgtcgtcaactcctcagcagaactgayagttgttgggctgcagcaagggctgggcgatatccccttgctcgcagcaggtcaggtgctcactagagctctcctcctccagctcactgctgctgctgccgctgccaccgcttctgctgctgctcggcagattggtatagtcctgagggtgggagggaccagaaactgtcagtccagatccatcaggcccagcccaacgtgctttaccggccacccaccccaagcctcaccccactcacccgctctctcctgtcctcttgggcctgctcctgaaggaaggagcagatctgctggaaggtgggtctgtgggtgggctccaaggcccagcaggcctgcatgatgctgtatctgggagataggacagaggatgcccatgggcagctccctagggtccaggggccattaacacacacccctagagagacctacccagcagaggtccccaaacccagtcaaagtaagtttagtataaaacctatgccaagtccttggcatgctttaccatttaatcctcacagtaacccttgcagaagggtactctcatcaccctcattctgacagatgaggccattttggtatcctcagggtaactgtaataacgatctcttaaaagtctgtttagggacaggtgcagtggctcattcctgtaatcccaacactttgggaggttgatgcaggaggattgcataaggccaggagttccagaccagcctggacaacatagtgagatcccatctctactaaaaaattttttaaaaatagctgggcttggtggtgcacacctgtagtcccagctgtttgggaggctgaggccaaaggattgcttgagccctgaagattgaggctgcagtgagctatgattgcacacatcactgcgctccagcccgggctacagagcaagatgctgtctcaaaaaaaaaaaaaaaaaaaaaggaaaagtggtcggttaggaccagccctagtgaacagctgcttctctgagaacatcccccatagcttgaactcaaaaggggcttgttgtgtccactatgggagagataaagtctgaccctggaacattttggacagggaaagatcagggccacacggccttccatccctttccagcgaaagcctggggtgtccttttccctccctgggatcccttcgcttacatattctttggggcaaatgcaggctgggccatttggtatccatccttcaccagtttatagaacttgctgttcaccaggatgccagggtagggattcagccctgcaaaggccaagatcaggtaagaggccatgcccattgtcttctccccattcccgcacacccacacacatcttagactgggtttaaagggtcccacttgacaacactgcaacagcagctactcttacccggtgcttcctgtgtgccagccagtgtgtggcaggcttaggctttaggaaggtgtgagcctctatccaggccttatcacaccaaacattcttgcacaggctttggaatcagaccaaagcttcagctgtgtatcgttaaagtgtggacagtcaggtggttatgagggtataggagcagcgtatttaagaactgagtacaagtccttgtgcctagtcctcgggaaatagcagttctttctactagagcctagtagtagagagctgcatcttcaagggtctgtagatttcagacaaaggagggaaacagtgacaaaggagggtaacaggtaacagcaactgagcagagacaaacgagggaagagccagaaaggagcgcctgtcaggggcagagggtctgccgagtcccgcaggagccacgatgctgggtttcgagagcccttgcccattcctgcactctcaccaaccctcgctgtgtcctgggcaccaaacagctttgtccaccagtggggcaaccagaggagccagccccaggctctgcctggagtgggcccagtggctcaccaagtgagaagatctcccagaggaggatgccataggaccagacgtcgctctgaaccgtgtagacacagtcaaagatgctctctggggccatccacttcacaggcaggcgggcctgggatgacagtccccagttattttgggccccgactcttcaccccctccccagcctggcccaagccctcccagcacttacattgcccttgacaatgtagttggagtcattcatgatgtccctagccagcccgaagtccccaatcttggccacatgaccattggtcaacagcacgttacgcgctgccacgtcccggtggatgcactgagggaaagcactgcagggttagtcttgggccttctcctacctgagcctgaggtgaggaggatggcagggagggccccacatggctttggagtccctgctggagtgaacaacagttttggtcctttaccacaaacccttgtctataccttctaccagggcccaggatctgagaatgtgtatcgtgatctgatcatttaatgcttagaaacccccattaccctgagcagccatggcccttctcaccctttgtcctctgactggtctgctcaggccccagaagcgaagggcttccgtgcagagagcagtctccaaaccctaccgttacttctgatcatagcagctgctatctgccaggcccttccctaaactctgcacacattgaaccctttttcttttcaacaatcgttatgcccatttttataggtgtagaaactgaggcacagaatttaaatagttgcttaaagtcacggagcaggtggcagagccaacaatcaaaccactgactcccgaatctgttctaaggaagatggcaagagctcccattccctggcacttcttcctaggccgagcgcactttatacgttatctaatatccccaaaattctgaggaagcttccgttatcatccccaccagaccrcgtgctttatgagcagagacaactgttgtctctcatacactatttagtaaaaacgaatgaagaaagcctggtacccttcctcatcttcacgctggggacacaggtgcccagccccagagctccagccctgggcacagctttctcccactcatccttgcagctgctgcccaaatgactctctcatactctgtctcctcccctaccccctcacaggctcccgtttcctcctccccatcgtcactcatccagcctccccggagcacagacctgggtggctatgagccagggccaggttcctactcacattcttggaagcgaggaaggccatgccctgggctacttggctggagaagtgaagcaggtcccggagctccaggggccgtccatcctccttgtccaggtctagggtgggaagaggcgtcagggcagccctgccacactccccacccctcaccccagcagccccttctccttttcccttgttatcaagcaaatggggcctggccctgggacctcctcaccttgctcagagaaggagtcatttgaagaagtggagacaggcctcatctccacataggtgtccacaccctggctggagaagccactgtccctacataggagagagggttggggggcagaggtcastcatcatcactgcactgctcagctcaggccttgaccacccaccaccccatggtcaactggaacctccctttctgataagaaaccctcctgccacactccatctgagtgagcattggtctctgctyggctgtccccggtgagggagcttacaacccattctggttttgggcagctctgcctgtgagaaagttcttcactgttcctaatgccaatctacccctgagattttcctcctagcccctgctctaccctcaagggccacagagaagttggagtcctcttccccataacagccctactagaattggggcatattctagggccccttgtgccctctcttctctggacagtgcctcacacccctggcttcacattaaaatcacttcgggagcttttaggatcaggctaattactaatacttcagaaactctagggacaaaacagtcattcacagatttaaatctccccaggtgatcacaaagtacagcctaagctgaggcccactggtctagagcagtgctgcttacgctgcaactcatgtgcagataaatcaccccgggaatctctgcaatgcagattttgaatcagcaggcctgggtggatgggcctgaggtggtgcacttccaacagtcctcaagagatgcctatgagagcacacttggggtagagaatttgagaagcactactgtagactgaagcactactgctcctaacgttccagccagataggatttctctctccctcctgtcccctctgcgctagagatgtgtaccttgacaatgtccatattctagtgttcccagaaggagaaaccgaaaaaaccttccgctcccttgtagaaactatgcttccgttaacagcctggaatcctttgacagagttggtttacaggccatttgccctcgaaattacccactctgggaatactttccccatctgcgtatttgaagatggaagctaatactttcctttggtgctcattttgatctgatcttcagaggcctagtgtgtgccaccctcatagaagtgtcagggaatcagaagaggaagtgatgctgccaggcccccatttttaaggccctgggtgaagagatggcctccttctcttttgcctccccaggcgtggcagctgacagtatctaggatgagggcgcagtgtacacccttcttgttctgatcctgtcctgaccccacaagcccctgagacagagacctccaggacagcagtgtggcttgggtgactcctggactggaagtcaagagagcaggattctagtccaggctccacctctaaccctgactcatgtgtgacatgaatctccccacttcctctctttggttccccatgtggctctgtctgttggatggctctgttctggatggcttccaggaatcacagcaacaggacaacagagccatctctctttttttttgagacggagtttcattcttgttgcccaggctggagtgcaatggtgtgatctcagctcacagcaacctctgcctcctgggttcaagcaattctcccgcctcagcctcccgagtagctgggattataggcatgcgccaccacgcccggctaattttgtatatttaatagagacggggtttcaccttgttggtaaggctggtctcgaactcccatcctcaggtgatctgcccgcctcagcctcccaaagtgctgggattacaggcatgagccactgcacccggccacatctgcccatctcttactagggctccaggcacagatcttggttgatcttttacacacactgggtggtgatttcattgatgcatatctccaccagattatgagctgcccatctttgccctccacactcccagaacacggtaggtgttcaaatatttgttgaatgaaggggaaaaggagtagagaaacaagagatggccataaaacctgtggtggctacttcccatgacacaggtggcaggtgagggctgcatagccacccattcatgagccatccaaccctgagctggctttgaagacagactcggatcctgcctcccagacctggcctttttcttgtcctttgccaggggctacctgcggacatatttcttctcgaggtggatgttcttatagtcgacgcctccctcggggtcctggccggggctcaggctgggtcccagcatggcctcagccttccttcgcagaaagttgagcaggtcgccatagcaacagtactccgtgatgaccagtacagggcctagagcagccaagggtgtggggtgagggaggtgctgagtgctcccctccatgaacaggagcatgagactgk

SEQ ID NO: 10739 - DNA, 69920 bp, Homo sapiens
  misc_feature (1)...(69920): n = A,T,C or G, or insertion/deletion polymorphism (see Tables 1-2)
tttcaatagattgttctgttcctgctccattccagtctgtcctatatactgccatcagattgatcaaagctgtggtttctttgtctattattttgattcatttttagatatggtatcattcatttttaaatttaacataccaatgaagattacaagacttaaacatcttatcagaagggggcatttattttttaaatcaagaaataactttccaaaagcattgctttgaatgccattctcttaaagtccttcagtggaacttttgagtgtgattagacatgttcattatcttgattgtagtgattttatgggtgatgatttcacaccaacttatcaaactgcatactttgaaatgtgtagtttattgtacatcagcactaccttaataaggttgtttttttttaaaaaaaaaaaaaaaccttcagctgctccctactgttcatcaaataacagtctgatattcaaattcccccagtatctggccctaactgccctatatagccttaatcaatcatgattctcctctacaatcccaatgctctagtataaccgagccagtcactaaagctgccctcctcctactgttccctatgtttcatattgctttttctgaggctctacctgtagacatcttcaagacccaacccaactgtcatgaagccttctccatgaaggctatccatataaccagaataagaagtggtctttgcctccttgaacttttgtttgtaccacttttatgtttcttatccaaaaaatggccttaagttgtaattatctgtatagtcatcttccccactaggataaaggattgctgaatgatacaatttgttgtatacttctgtaacacccctcctcttcattatctggcatrtacatcgatattaaaaatattcattaaatgaatgaatagctgattgactcagatgagacttcaagtttgattatatttgaaaaggatgctaagctttaagagtcctgatgctctttattttaaaaaaaaaatgcttcaggctgggctcggtggctcacgcctgtaatctcagcacttttgggaggccaaggcgggtggatcacctgaggtcaggagttcaagaccagcttggccaacatggtgaaaccccatctctactaataatacaaaaattagctgggcgtggtggcacatgcctgtcatcccagccactcaggaggctgacgcagaagaattgcttgaacccaggaggcggaggttgcagtgagccgagatagcaccattgcacaccagcctgggtgacaacagcaaaactctgtctccaaaaaaaaaaaaaaaacttcaattgcaagttattggttgacctttgcttcttgaggattttgaaaccaaaggcagagtatgcttccctgtgtagtgggaggttgactatgaagtctgcagcaggtgaactgaaggacttagtgaagtctcagaatgctgtagtgacaagcagtagattgaaagatgggtagggggacttttcctacccgggatgatgtgaaaacatgagaaaatcaaacaagcttcgttaaaggtattttataagcctcttctgtgttcatttataaaaggaaaaacaagcctactctagagataaaggaggtcatttatttctggccattgcagttcttcagagatggactctgaagctcagtattgacaccattcctttcataataatagccctgctgcttgggcagcagcattcaggaaagtaccctttgccaggttcctgtgcctccatgtaggaaggcccatctgctcctggcataatgaaagtgcctagctagagacaagaagcacagactgtgccagacaagagacttggagtaattgatataatgagtaaccaagtgagagtagatccctcaccaaagcgtaaccacattagctactttatcacaacagacttatttttaggtatactcaagaccatgttaagcactgtgggttatacaaacgcatagaatacactatcattgcctttgataaatctgaaaatacaggggacatcttttgaataaactcttaaataaacttataggagacaaggaaattgaataaatgaaaacttctatagctgaatatacagatttatattgaagagattcagactaagggaagatcatggcgaaacagaggtaggggcaagatttttgaagaaaaattgagctttatggttttattttcattgtggtgaaacttaggggtaaaggtgagaagtagaaaaaagtggtagtagaacgaacgaggtctgtaggtgatgtgcttggataggttgggtggggatagttgacagggaggggcttggtgacaagctaaggaatctggacttgttcccgtagatcatcaataactattctgattctttagcattaaagtgcagttttaagaactttcatccagccttggttaacaggagatactagaatggaaacatatagataggaagatactctaagtttattgctataggaatccgggtgtgaaagtgggaatggggctaagtgggaatggaaaagacaggttgaatctaaaagacattgaggagaaatttccaataggccttggtgatcaaaagaatgcttacaaaggactgaatgtttcacagacagtatatatatcccatatcaaatcaatgaccctggaatgtagggaaaggcaagagtagtgaaactaaagctaaggttgggtaagtatcttctccagggtaaaacatgtctccccctcatctaaaagacagaaggatgttctgagaatcctgaatgtttttcctattgaatagtttatcttacccttgtagtcttccctgaaattctcctcaattaatgtttattgtaatctaattcctgacctctgtgatactgatatttccccttaaactagcatactcccctcttcttggaacasgtgacatggtgaccagcactcttctctgttgtgttcttccttctgaccaagcactacagccacatgaggcagcagtgagatgtggccttgtcactcctcttcaggtgcttatccacaatttacttcccacaatttacttgatggttctggcaaaatgtttgtgagtctttttttattgcatggaattgtgttcacttaggttttatgccagactggtttaaatgattcatcataaattctgaaactcttttaggtatttgccaacctttactgcatgtcttgtttcccctccccagctctttatcttcccgcaagatacaaatgagtcaacacaatcttcatcaaaaagcattgtgctctgtagaaggaagtgtgataaattaagtagtagcttatttttttaaaaaaaaaataatagctccagctacttggaagtctgaagtggaaggatcacttgagcccaggagttccagactagtctgggtaacatagcaagaccctgtctcaaaacaaaacaaacaaacaaacaaaaaaacccaaaacaaaaaaaataattaaagttttttgttttcttcttcagtttgttttttgcttgcttgagtggtctgctcaggaaatggccttgtagctaagtgggttttgggggtttggttatttcacaatgtctctataccttttgggtttacagtagaatagattgctgcttgcttttttaaaaaagtgtgaagttctgccaagacactatttacagattcttagattttgaggaaagggactatggaggcatctaagcaaaattttttttgttatctcctatttatttctgtcttctccctcattaagaagaaacaagaaagttagtaagagattgtgctgaaatataggcttgagaaaaatagatttaaattttattaggcaggtttgcctcatcaattaataaaaattaataaagttctagttttgtgtaattgaggacattctaagggtacagagaaattataaaactatattatcttctttgtccaaacatagaaaatcattttccttttaggattatgctttgctactctgcaattaagcaagttagtttggaatgtttttatttttattttctttcccaaagttacctaaggagtgttttaatttttatcagtaatcatgtctgtatctttagttctgagttgctttattaactggctaaggatgtttttgttttgttttgttttgtttttaccatattctggctttctcagtgttgtatgccaatctcctaagacaatgtttagaatttagtgggtactcaataaatttgttgaacaacttaatggatttttaaatgtttatttctaattttaaaaacggtatgataattttagaaagcaaactttatcataattctaaaattatgataattttagaaagcaaacttacacaattgattcttttttgcttcttttagtctttaactatgtacacacttttacatggttttagttattacaaacttgaaattttgtatttttataaatcaaagatttcccatattttatgttttaaaatagccaaagtaaacatcacgttacttagagcagcaagaaattctctcttaattctagatggggataatttaagaaatatactattcctaacaaatattgctgaagaatgagggtttattttaatttatgtatactgggattgagtttcttaatttgaaatattgtctttaagttgtctataaccaagatatctcgatgatctttcttttttttttgcagtacttagtaaagagcatgcagtatctttaatgttcagattaagcagtgttcagaatcatgatatcctgaaggaagtttgaataatgttgcaaaacagaaaggattgctaatatcttaaatagaggaagtcctaacaacacatttcccagttttcttcaggatcaagactaattttgttaacatttgttgaacttctgccttcaataaagatgatatactgatttttggatgttctcacactgaattaggcacttgggtagacttgtacccattgagaggttatgcaagctsaaatgtggaaagtttttctagaagagcctgcctttcagggccaaaatgccacaggcacagcataacttcctgaaacaaatttatttcctaagacattggttgcagagtagaaatgtgttctttagaaacagttcttcaggctttctgccctaaaagttacaatgttgtcagcaaggtggttgattttactttctttttgttccatcacagtttaccagcattacatatgcagggtattgagctaactgtctggtcaggtgctccttgtgggggccacttgctctagatcctatatagaccaacactcttagtctttatatccagaacccaagtgaagcttcaaaggttactgggagggttgaagaggtgctgaaatcaacacttcccttaatggaggtcagcacttccccagtcctgggagagacacagactgtcagaagcatctgactttgcttcattcaaaagggagtttgaggtatatatagcagacttaaaagttatgaataaaaataccttctgtgatgaacagaagtttctcattgatcacactgacaagaaacctttcgatgaacagtccgggtagaagacatgtcactctaaacagtgtctgtcttctttcctgggcctaactgaactttgcagagttcatttgggacataaggaaacagaaggtgtcaacttggcccttgtgctcactgggaaaatggggagagacagaactcattcaggagacctgtaattctgttctttctctgggaggcaagaagaaaggtgagttttgcatatgggtgatggaatggaataatctcagttaagcagaccacactttacgttctagttagcctcttgtttgttaaaaatttgaattgtaaccaggttcctttgctgagaaggaaggcactagggccctggagtgagatgatggctgtgttatgtgaccacagaaggtggttacgtactaatttcctctagggcttgtgatgaagtcagtaaaccacagccttcagcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctggtgagtcctgtatgtgaccctctcagggtagttacatacactatttaactgactatgggggtccaattttccgagaccaaattgctcttgggataaagtaaatatgagaccttggcggggaagacagaaaaaaaaaagtttgacttctctgagtggtttgcatgtatttcaggtattctctcaaaattactggttttaatattttgtttgctagttctttggagtttggttaggaatcctacagaagacatatacaactccagatgtaaaaacactaatattaattgaacatccagatttccccaggtatctaagttgtggtttatgctttatattactaattttaattaatattaagaagaaagagaccaatgttaacttttcatgcaatattacatttttagcctcccctctgggattctatttggttgacaaaggtttttgaagagcaccaaaactacccactgccacagttttttttgttgttgttgtttgtttttttaagattcagaatcttactctgtcacccaggctggagtgcagcagtgcaaccacagctcactgtagccttgaactcctggcctcaagtgattctcttgcctcagcctcctgagtagctggggccacaggtgtgtatcgccatgcctggctaatttaaaaaaaaattgtttttttcttttttgtagatacgagccttgcttttttgcccaggcttgtctcgaactcctggcttcaagcaatcctcccatcttgcctcccaaagtgctgggattacaggcatgaaccactatgtctggccatcatttttcttttctttttcatatgaaaaatatattataacatgtgttttttcaataacagggcttccttaacttcttttgcttggagaagtggaatggctaggatggagagtagagacaagtgtaggtcaaggagagaaacatgagtacaaggtagcttcaggttgggtggattagattacccagaagaacagtgaatctcctttgagagaactgtgattattgatgcaatggcagctgggtaggcctcattcaccctacaagctgagatatcagataacatagggtgtctaatagtacctatcatgtattttagaatgcttacagctggcgtttcagagatataagaattttaaaccttagctcttcagttgtgaagaaatgggtggaaagaggggaactgaagtacaaacctgaaattaaatcatgattttttttcaccaaattatgaagtatttgacatgttcttaaatctctctgttttctaacttataaaatggggataataatacatgtcctacctatcctcacaggattgttgtgatgattaaatatcaataacaatcattaaatgtggtcatttattgagtaccatttattgagcacttagtatgtaccaagttcagttctaagcactaaaaatacagcggtgaacaaaaagaaccaaaacctttgcctcctggagctaacantctggtaccggatagcagatgtgaaaacactctgaaagtcttgagtaattagatattattgagtgattagatattatgataggaactccgatgtcagctcaacatggataatcttgtggtactatgaaaaatgtgctctcactgccactggctgatcagtctgagcccctctggtagagttacctgaaaggagataagtaggaagttctagcacatgtgtatacatgtccctgcccctggactataattcctaagccaaggtaacccaaggcatagatgtaaaaagtgagctgaggggcagtgccggcctctgttttattttggttgtgttttttaaaataatgtagactggccgggggcagtggctcacacctgtaaacccagcactttgggaggccgaggcgggtggatcacctgaggtcaggagtttgagaccatcctggccaacataatgaaaccccatttctactaaaaatacaaaaattagctgggcgtggtggcaggcacctgtaatcctagctactcaagaggttgacacaggagaatcgcttaaactcgggaggcagaggttgcagtgaactgagatagagctgttgcactccagcctggacaacaagagcgaacttctgtctcaaaaaaaaaaaaatgtagactatatccctaatattttaccttttctcagctaaagtcattataatttctcaccaaaatatagcagctacctcctaactggcttctctgcctctagccttgccccaccttcagtcaattttcagttcaacacccaagtgatcttttaatcatacaaatctggtcttttttttgggggcgacaaagttttgctcttgtcacccaggctggaatgcaatgacaccatctcggctcactgcagcctccacctccctggttcaagcgattttcctgcctcagcctcccaagtagctgggattacaggcatgagccaccacgcctggctaattttgtatttttagtagagacaaggttccaccatgttggccaggctggtctgtccaaccaggtaatccactcgcctcagcctcccaaagtactaggattataggcatgagccaccacgcccagccaaatctggtcattttttccctgcttaaaaacttgttatagttttttttagctgcttaatattgtgcaatataatacacatttagaaaagtacataaaacatttaagtataattataaagcaaccattagcagtgcaaccactacccaagtcaagaaactgtcagacccccgaagacccatgccccatcaggtcccctacacccatctgcccctgtcctgtcctaccctggccaagggataatcactatcctgacttttatattaatcacttccttgcttttctagctcctgattttaaggaccttgtttttgggtagtgattaagtgtaacctcactgttcactgactcatgtcctccagtggaaaaatagagtcttcctctcagctccatctaaaggtttcagatgagacaccagatagagagctttgggggagtagaggagtagtgaatgaggctagactgcttgcttggacaaggtaaatactgccactaaatcagagggctttccatctggtcatgttctgtgtcccatcttaagcccttaatgtattctcccaggattttatgtttccgaggtttgaggactcattctgtgacacaaggccactgttcacttaactggtggtaactttaagggaattatcaaaaggcatctctatttccaggtagattccctgagcatcctaacccctttaccctctccccaggtccatggttcagatttcagtctccacttccttcttggccatacatctttgtacagagaacaatacagatggctgtctgtatccccaagttctacatccttggattcaaccaactatggatcaaaaatatttgaaaaaaataccaaaaataacacaacaacaaaaaataaaaaatataaagcataacaacaatttatctagcatttacattgtattaggtattataagtaatgtagagatgatttaaaatatacaagaggtcatgtatagtatgtgtaaatactatgccattttatatgagggacttgagcatccacagattttggtaattgaagggggtggtcctggaaccagtcccccacagatactgtgagaggactgtattcataattggatgtggcagtcctgttaatggcagctgaagccagtgccatgctgcttatgtcttttccctgtgccaggactaaattcagtaacttttctgtagttgaaactaccactgaccacccatctaaggtttttatacattcatataaacattcattgagtgcttattgtgtgcaaagtaatgccctagatgctaggaatgcaatgcaatgctccatgctttagtggagcttatgttataaggcaatagatatgtcttagagaggcagacattaaacaactaattgctatattaaatatttaatataattgtgatagtctgggtgaggtggtcaaggaaacatcaacattcattttcttatttactactccttaagaaaaccctgtgaaatagctacaaatgtcatttctgacttacaaatgaggaaactgaagctctgagaagttaaataattggcctaagctcactcagctgttcagccatagagatgaaatttaactcagatctgtcttattacagagctgtaacattaatccttatccaatagtgttctacttcatccaatgacactgagtctctcaaaggacctagttttagggtaagttttagggtaaggacatagttagtatagtttctacacagcagaaacagcaggatgcaactatactgttgaaatttctaaaggtattttcaaacgttccttattattgttataaaacaatattattgaaagttaaaagaaagtaaactcaccataataccaacattctaacaaatcaaaactttttttgtggatcttggccaggtgaggtggctcgcgcctgtaatcccagcactttgagaggctgagacgagcagatggcttgagtccaggagttcaagacaagcctgggcaacatgatgaaaccccgtctccactaaaaataaaaaattagccagaagtggtggcacatgcctgtaatcccagctacctgggaggctgaagtgggaggatcacttgaccccagggggtggagggtgtagtgagctgagattgcaccactgcacaccagccagggagacagagtgggaccctgtcatacacacacatgaaaaccaacaatagctttttttgtggatcttctagttcttgtccatttatgtaaatttttaatattattgtaattatagcatagatacaattttgtgttctcatattttcacttaccattataccaaaattatcaggctgattaaaatgtatatgatttttaatagttgatgatgcagcatcatcacatggacatatatttgtctatgtgggttttgttgttgttgttgttgttgttgttgttttgagatggagtctcactctgtcaccaggctggaatgcagtggcatgatctcggctcactgcaaccaccacctcccgggttcaagctattctcctggctcagcctccccagtagctgggactacaggagtgtgccaccacacccagctaatttttgtatttttagtagagatggggtttcatcatgttggccaggatggtctcgatcccttgacctcatgatctgcctgccttggcctcccaaagtactgggattacaggtgtgagccaccgcgcccagcctgtccatctggttttataatgaaagaataataatcataatagagaatgcttctatacctcttacagacactgttctaaacactcatatataaactcatttgctccattgaggaaggtactgttttcatttccattttataggtgaggaaacaaacagagaggtcaattaacttgctcagggtcacatagctagtaagtggtggaactgaatttcaatttcaggtagtcttgctttgtcatctgaagtcataaaaactttggagtcatataaatcttggtttgaatttaagttatgcccatgattagctatgtgaccttggattaagtcagtaaaatgtgggaataatattcactttgaagaactgctgtgaagataataagtatataaacttcctgagacatagtaatacccaaataatttatttctccattgttaaacagttatttctagtttttcatgattattgataacactaatatgaatatatttttccatgtggtttttcccttcttttggattaatccttaggctagatccccaaaaatgttattactgggtcaaagactattagcatctaattggttaagtattaccaaatgtatttccaaaggagtttttctaatttgcaatatatgaatttatcatcttctctaccaccttgctagacttaataaatataaaagagaataaaagatgaaaacattttgcctacttactatgtactaggcaatctgctaagtgctttgccgtacgtgatctcgtttaatcgttacaactaccccaagaggaaaatattatgttcattttacccatgaaatggaaaagcccggatttgaaaccagtctgttttttttcaaagcctcttaacctctgtacttaaactgtatcaggtaaaaatcatgactttttttctgatataactagcataaaatagtactttattatgttaatttcattcattggatttctgagccttaaaatgttccatgattattttaaatctgcatttccttatatacgttttctgttcatctactttccacagtaacaacagctaatccatagaactgtgttccagactctgtgctaaaagtgcttcacaaatagaacttcatttacctcccaaagaaccttttaaaatggctatcaatgtcctacatggtgtctctccagcttcttatagcatgctcattttcttgtccttgccatgcttcctctgccatagggccttgcacacatgttgttacctccgccttgaacattcctcacactcctctttacctagataacatttggtaattttktttttttttttttgagacggagtctcgctctgtcacccaggctggagtgcagtggcacgatctctgctcactgcaacctctgcctcctgggttcaagttattctcctgcctcagcctcctgaatagctgggactacaggtgtgtgtcaccatgcccggctaattttttgtgtttttagtagagacaaggtttcactgtgttagccaggatggtctctcgatctccygacctcgtgatctgcccaccttggcctcccaaagtgattataggcgtgagccaccatgcctggcctttttttttttttttttttgagacagggcctcacttggtcatctaggctggagtgcagtagtgtgatcatggcttactgcagcctcaacctctagggttcccatctcagcctcccaaagtgttgagattacaggtgtgagccaccatgcccgactaataattctttagatctcaatttggtggtcaattcttcaaagaaagctttcttttcttttcttcttttytttttttttttttctggagacagggtcttgctctgtcacccaggctggagtgccgtggcttgatcatagctcactgcagacttgacttcctggactcaagtgatcctccagcctcagcctcccaaagtgctgagattacaaccatgagccaccacacctggccagagaaagctttctggacctctttgaatagatcaaatcttctattgtaagttcttattagcaccatttgttatttttcatagcacttaccacaatttcagttttttgtttgtttgtttgtttgtctgttttgagatggagttttgctctttttgcccagaccagagtgcaatggtgcgatcttggctcaccgcaagtgactctcctatctcagcctcccgagtagctgggattgcaggcaaagttgcagtgagccgagatcgcgccactgcactctagcctggatgacagagtgagatcccatgtcaaaaaaaaatatatatatatatatatatatttattaaatataaaggattcattgaatcctaacagaaagaagatacctagttctgaaggccaggtttaggtgctaacrgtttaawctatactagaaatcagactggtactattgcaacttctggagattcattagaagaccagagacatatcaaagatctggctacatcttggttctataaaggagacatagatacatcctggttctgtgtatattatagtaatgatactaaccaaacagttatcaacaaggtacttcctacagagcaagtgcacaaacatctatgaattgacactactcattcctgtgaatcagcctatcacttgaacatatttatcagcatttcttgacctttgtgcacattaaggtgcaatttttaaaaatgccaccaccagaataaatgtatcacatcacctctgaagctgatttctctaacaccatctccagcctctcactagggaccatctagtcctacattttcatttactcacaggacacttaaaacacatttcttggctgagcgcagnggctcacgcctgtaatccccacactttgggaggctgaggcaggcggatcacttgaggtcaagagttcaagaccagcctggccaacgtggtaaaaccctgtctctaataaaaatacaaaagttagctgggcatggtggcaggtgcctgtaatcccagctactcaggaggctgaggtgggaggatcacttgaacctgggaggcagaggttgcagtgagccaagattgcgccactgaactctctgctgggtgacaaggcaagattctgtctcaaaaaccaaccaaccaaccaacaacacacacatttcttgccattttctcacattttatgtatctaaagttgaacctcttggtttactcaccccaatttagctattgcctacccacctacccatttgccccactattgcactggaaactaacctcgataagtttgtcagtcttgttgaagatgattgcattgcacgctcgtacaattcagtcttgtcctccattcctactggtagttctcctgattactggatttagaagcctgagctcctaatgccattccttaccacttgtacttcttctgtcctgatggaggcttggtataatactgacctatatttgcaaggcactgaggaactaccttgcagagttctcgagacagccaaactttgtgttctcccacctagcacaggagggccaagtttaattttcctctccctaaaatgtatctaaaatgctacgtcttctatccagtaatgtagtccttcaaggcaaagatatcgtggtcttgtgctttcttttactttctgttcttttttgggagtgactttattttatttactagtctgtgagaataacatgcaaatgactcaatccgaatttctagaatctaatactccttgttatactggccaggatccccattctcctctcctttcttgaaacgaaaggggtagtatcatctacaaaccaaatgaacttactattagcttatcaagcacacacagaatctggtttctcacacattccaccctatttcagggcccacgagggatgttgagctctctcttcactttattctcttttttatttttatttttattttttttgagacggagtctcacactgtcacccaggctggagtgcagtggtgtgatctcagcttactgcaatctctgccttccaggttcaagcgattctccttgccttagcctcctgaatagctgggattacaggggtctgccaccatgcccagctaattttttttgtatttttggtagagacggggtttcactatgctggccaggctggtctcgaactcctgacctagtgatctgcctgcctcggcatcccaaagtgctgggattacaggtgtgagccaccgcacccagtctcttcactttatcctcttggcaactattcccctgacttctcttgatggtacttcctctagggaactcacacccctaccttgtagttggcaaagaaataccttcaccctttagatctcatatcttttcttcacaaacttaaacccatccccatgaccctgcttcctcttttatacccttttgctttctactttcagggttcctccttttctggtgtagtttattactttttctgccctaattttgccctaatttgttctttcttgggatattggagcccgggagtctggcaggaagagaggtggaagagaaaaatgaagcctgccgggcgcggtggctcatgcctataatcccagcactttgggaggccgaggtggggggatcacttgaggtcaggagttcaagaccagcctggccaacatggcgaaaccctgtctctactaaaaatacaaaaaaaaattggccgggcgcggtggctcacgactgtaatcccaccacttcgggaggccaaggcgggcagatcacgaggtcaggagttccagaccatcctggccaacatggtgaaaccccgtctctaccaaaaatacaaaaaattggccaggcatggtggcgggcgcctgtaaccccagctactttggaagctgaggcatgagaattgcttgaacctgggtggcagaggttgcagtgaaccgagatcatgccactgcactccagcctgggcgatagagcaagactttgtctcaaaaacaaaaacaaaaacaaacaaacaaaaaaacagaaagaaaaaggaagacttcacagtggtatgaccttaagataagatgtttgagggaaaaaaatcaaatctttcatacattacaaatgaataattctgtaggcatttcctgtgtgatgttttgctaagagtgtctgcttttgtcatccagctagattactcgagggggaggaaaggagtaggaaaaatgaaagccattctgccttattgttgaaggtagcagtgaaggcagctaaacaaatataggacacacatacacacacacacccatcacctttatctgtaacattttgccaaattaattgaaggatatcttacgcaaagggctttgtgtatagcattctccctagaaagcgttccacaagcaaaataaaacaaaaataaataaaaacagtataacaaggagtatgcactgagcttagttctggagactcctagaagaaactgttctgggacttgagatcttttcagcagccctgggatcaacagcaacctgaaaatgatcattctgaagttgcttaagagcagggagatttgaaaaattggtgtaacttcagctgaaattcagcctagtctttcatgtgtccttaaattcccaaattagtccacttgtatccatatccatcttgaagtaaaaatatgctataaagatagttcagtagcttcttggggttcaaagttaaacaaacaaacaaacaaaaagatatcagttcagtatctctcctctcaaatccagttctgaaaatccagaggaattcaaactacagtaggctctctttatatacggaggatgtgtttgaagacctatagtagatgcctgaaactgcagatagtaccaaatcttacgtacactatgttgtttttacctatacatacatatctataattaaggtcaatttataaattaggcacaataagagattagcaataatagctagtaatacaatagaacaattatgataatctacagtaataaaagttatgtgaggccaaggaaggtgsattgcttgagcccaggagtttgagaccagcctgggcaacatggtgaaatcccttctytactgaaaatatgagaactatccaggtgtgatgcttgygcctgtggtcccagctttcaggaggtaaggctgaggtgggaggtgaggctgaggtggaagaatcacctgagcccagaaagttgaggctgcattgagctgtggtcaagccactgcactccagcctgggtgacagagtgaaactttatctcaaaaaaaaaaaaaaaaaaagtgactgcttttggaactgaaatctttgaaattttgctagatatagagaaattttattcagcttaagctccacttccacttagaaaaaaaagcgatctgaagtaaaaagactaatagaacttaattattttccagttgaccatttaactaaaaagcagttataaagaaagtaaattaagcttttaatatctgcccattgggtggagcatatagcttgcttccagaagatatttggttcttaaaatattcacaagtttcacttttaagttcacgctatctatggctcagctgcagtaagtgtgatcttttcacttccccaaatgtcactgaactcaggtctccttatgctctgcagctctgtcctgaacggagtcagaaccagaagataataaaagggttgaggtagaatgttttgccagtggaaaaggaaarctctttagagatagcttcttmcctcatttctctaggaagattaatttttcttggaatcttattacagaagctgaaaaggcaatctaccaagtacaaggcagacaaaacctatcctacaactgtggcygagaagcccaagaatatcaagaaaaacagatataaggatattttgccctgtaagttccatttctctctataaactcatactttctcccaaattcaatcattactatctctttgtacccmttgcttactgatcctgatcttggaacatggcattgacaacttagtttgtactatttatgactgcaaaagaatattcattcattcattcattcattcactcacttgttcactcatgagcatacactattcacagtgttaggccctgatttaaatctgctgactaagccctcttaattgtactatgtctgtcttttgtattatagatgattatagccgggtagaactatccctgataacctctgatgaggattccagctacatcaatgccaacttcattaaggtacagtgaaagaaaataaaagcattccatatttctctagatacccaaaaaaaggggagggctggctggactcagtggctcatgcctgtaatcccagcactttgggaggctgaggcggaaagatcacttgaacgcaagaatttcagaccagcctgggcaacatatgagaccccatctcaacaaaaagttaaaaaattagccaggtgtggtggcatgcgcttgtagtcccagctactggagaggctgaggaaaggggattgcctgaagccaggaggtcaaggctgcagtgagctgtgattatgccactgcactccagcctgggtaacacagtgagaccatctcaaaaaaaaaaaaaaaaggaagcggaggactaggtgagaacagggtattatytgtagtcaccccgtgtaatttctgttcccctttagggagtttatggacccaaggcttatattgccacccagggtcctttatctacaaccctcctggacttctggaggatgatttgggaatatagtgtccttgtaagtayggtgttgcttttgttactttattctctactttattaaaaacagtgcttttaaaaaattggtcagtggaacttcagggttcaggcatcttttagtcagaatcacaatgccattcttgtccaaggaaatgaaagttctcagccaggtgtactctgggaggccaagaggggtggatagcttgagcctaggsgttctagaccagcctgggcaacattgcaaaaccctgtctctacaaaaaatacaaaaattagctgggagtggtggtgtgtgcctgtagtcccagctactgrggaagctgatatgggagaatcgcttgagcccatgaggttgagactgcagtaagctgagattgtgccacagcactccagcctgggtgacagaatgagaccctgtctcaaaaataaataagttttaaaaaataataaaaataaatttaaaaatgagaaagttcttaccttgacaggctcatttggtaacaagattactggtctgaacagagaaaggggaagtattgtcagaatgaaggaagagtagcagcaatattttataagtcaccaggatttattttttggttaaaaaaaaacgacaaaacagaaaaaagaacggttaatactttctgagtctgggatccatgtattaactgctctttctaactatatatgaatgtttaagtttctatctatttcatcccccagatcattgttatggcatgcatggagtatgaaatgggaaaggtaagttactttctagtacctgctgaccttaaaacaaaggaaagaagaaaaaggagagggaaattggcagcagaacttacctgagtgtacctagataaaacttatgtcatcttcatagttttcagtttgggaatgccacgtgattctcagaggatttttttttttctcctaagaatcctatttgtttgttttctcagtagaccctatgttttacagttaaaaacaaggtatgcttttaagattaacaaatcacttgcccatttctattaattagatatctttaactgccagccagagcttttaatcctgtgccgtccaatattgcatccaccagccacatacagctattgagcatttaaaatatggctaatgtgactggggaactcaattattttaattgatttaaacttaaaaactgacatgcaattcagttatcagaaagctgtttgagtatgtgaaaatttttcaaatgtaagttttattaaatctaaatggaaataaaatatttccaaaatttggcatcctaattgagattagctataaatataaaatatacactggattttgaagacttagtaaaaaatgccaaatatctgataattattttatattggttacatgtcagaatgttttgatatattgggctaagatatgttattaaaattaatttcacctcttttcattttttaatatgtctgtttgaaaatttaaaattacatttgtggttcacattatatttttactggatatcactgttctactgttgccattctgagttgacaattctaatcaaaagcaagggaactaggtatttcacttagcttgtgcagctgttttagtagacatatgatttctgttagttcttgtgaaatactaaaaataggtcaaagatttctatttctactttttcagactcccaggaagtctrtaatttatatatcctttaatgtttgttttcccatctttggagattccaataatgtaggggttgaagcccaaaggggttagacgcacctaacctaaggtgaaggacatagagctgaatttgcttccaaatgagagagtggaaaagactagaatatatggagggaaatcactgtattctgctttgtgcaacagaaaaagtgtgagcgctactgggctgagccaggagagatgcagctggaatttggccctttctctgtatcctgtgtaagtgtaatgtctgttctcatgtctgagtaaagcctccagggtctaccttatagagagcttgtctttgcaatcactaatacttgagtcttctttttctttttaggaagctgaaaaaaggaaatctgattatataatcaggactctaaaagttaagttcaatagtgtaagtataaaataagaatgataaactcaaaagcctatagagatcaggcaagtaaatatagatgtgtgtagctcaggctgggcataagacaatgggaagtggtagggtctttgatgtcatgaatgagtcttcatattcaagagaactttgagcctggccgacatggcaaaaacctgtctctactaaaaacacacaaaaaattagctgggcgtggtggtgcatgcctgtggttccagctagtcaagaggcttaggcaggagaaatcatttaagccctggaggtggaggttgcagtgaaccgagatggtgccactgtactgcagcctgggtgacagagcaagactgtgtctcaaagaagaagaaaaaaagaagagaccattgttataatatgtcttcaatctattctataccatggcacacatataaaatgataatatttgtagggtgaacagaagctgaacagtgcatagagactggggaccagtttgagagcttaggctgccctaggccctgcccagcttctctaaggcaaaaagatttaatatatcagcatgattgtgacacattggaggcataccagttgggaaacactggtttgaactattttcatatctagctatttcctcttgtgaatggggcagatggggacaaaccaatagtaagtgacctgaaatcacttttaatggttttcagaaagcatctggtcacctgagatctatagagaagaaaccggaataaatttcaaaaaggatatagatacaacttagtatgccggactgttgtcttggtataatgaggtggagttctaaccacaagttgtcttattatcctggctatttttaaaataatttcaactttttttttttttttttttttttgagacagagtctcgctctgtcacccagtctggagtgtggagtgtgcagtggtgcaatcttggcttactgcaacctgagcctcctgggtccaagcaactcttgtgccgtggcctccccagtagctgggactacaggtgctcaccaccttgcctggctaacttttgtatttttagtagagacagggtttccccatgttggccaggttggtcttgaactcctgacctcaagtaatctgcctgcttcggcctcccaaagtgctaggattacaggcgtaagccaccacacccagcctcaactttaatcttatgaatataagacacaagggcrtaaatgtgcaggtttgttgcatgcatgccactgaataatcccatcacccaggtagtgagcataatacccaataggtggtttttcagcccttgcccctcttcccctcccatctggctactttttataggaaactcgaactatctaccagtttcattacaagaattggccagaccatgatgtaccttcatctatagaccctattcktgagctcatctgggatgtacgttgttaccaagaggatgacagtgttcccatatgcattcactgcaggtatgacactatatataaaccttctacccaaaatgaaccaaatgtcagagtctggccaggactgtgtaattgaaaggggaaaaggttaatagcaaaaacaaacgataataaattcaacctaagcattaaattcatgtttttctgataagttacttgtgagtagtacagttctagagactcttgctctgagatgttgcctaggacctcttgcatgacaaatgggctctgggaaatggtggggtttggaaagtttaattgtccccaggtatcttcttcctcaaatctgctggtgaaattttccagctactgtcaatggtccattctctctaggtatacatgcatacatgctactgtgatctttcatttcagtgctggctgtggaaggactggtgttatttgtgctattgattatacatggatgttgctaaaagatggggtgagtttctctcagcaggcacttcccatttgcttagtctactgctttcatacttagtaatkgtttggtttttcaaaacatctatcttcatgattcatcttttctagaaaatgtacttgtagacccactctgtcagatgattaaattagttcccaggtaggtgggtcttaaagggtggtccccagacaagaagcatcagcatcacctgagaacttgttagaaatgcaatatatattgggctaagatatgttattaaaattaatttcacctcttttcrgttttgaatgtgtctatttgaaaatttaggccgggcacagtggctcacgcctgtaatcccagcactttgggaggccgaggsaggtggatcacgaggtcaggagatcgagaccatcttggctaacatggtgaaaccctgtctctactaaaaatacaaaaaaattagccgggcatggtggtggacgcctgtagtccccactactcaggaggctgaggcgggagaatggcttgaactgaggaggtggagcttgcagtgagccaagatcgcgccactgcactccagcttaggtgacagagcgagactctgtctcaaaaaaaaaaaaaaaaaaaaaaaagcaaaaaaaaattagccaggcatggtggcatgtgcctgtaatcccagctactcaggaggctgaggcaggagaattgcttgaacccgggaggcggaggttgcagtgagctgagwttgagccactgtactccagcctgggtgacagagagagactccgtctcaaaaaaataaaaataaaaataaaatacataaaggaaaagaargaaatttttggccgggcatggtggctcacacggtaatcccagcactttgggaggccgaggcaggctgatcacctaaagttgggagttcgagaccagcctgaccaacatggtgaaaccctgtctctactaaaaatacaaaattagccaggtgtggtggcgcatgcctgtaataccagctactcgggaggctgagacaggagaatcacttgaacctgggaggtggaggttgcagtgagccaagatcatgccattgtactccagcttgggcaacaaaagtgaaagtcctcaaaaaaaaaaaaaaaaaagaaagaaaaagaaaatttaaaatcacatatgtggctcacattatattttactggatatcactgttctactgttgccattctgagttgacaattctaatcaaaaccaagcaaacttggctggttgcagtggctcatgcctgtaatctcagcactttgggaggctgaggtgggcagatcacctgaggtcgggagttcaagaccagcctgaccaacatggagaaaccctgtctcaactaaaaatacaaaattagccgggcctggtggcacatgcctgttatcccagctactcaggaggctgaggcaggagaatcgcttgaacccgggagacagaggctgcagtgagccgagatcgcgctgttgcactccagcctgggcagcaagagtgaaagtccgtttcaaaaacaaaacaaaacaaaaagcaaaaatcaaaacccaaggaaactagatatttcacttagcttgtgcagctgttttagtagacatatgatttctgttagttcttgtgaaatactgaaaataggtcaaatatttctatttctactttgtcagactcccaggaagtctgtaatttatatgtcctttaatgtttgttttccaatctttggagattccaatagtgtaggggttgaaccccaagggggttaggtgcacctaacctaaggtgaaggcaaattactgggccccaccccattgaattgaatcatgtctctagagatgggggcccagcaagctgtccaggtgattgtgatgcatgatgaagtttgaggaccactgtcctaaattatatagttacccttcctttatccaaagatgctttaatagatggactcaacttactgcaatcatactttgcgttccaatctataaatcattttttaatgtctaataggaaatgggaagtttaaaatatggcctttagacctacctaccaacctcttttattttatgcaactctcatacttgtgcatctactgaatcctgtccctcgttatatctatagttttagacatttggttataccgtgtgaaatcattctgaagagtttctttagtcttttctagggaaaataccaggctctaaatcatgttgcaagtgataagaaacctcatttgttttaaaaatgcatcatttttctgatattaccccatgttagaagagcagatgccatggaagtacaagactatgaaaaagtagcaataatttattaacaaaatattgaaaggaatattttcccctttaatttgatagataattcctgagaacttcagtgttttcagtttgatccrggaaatgcggacacagaggccttcattagttcaaacgcaggtakgaactatagtgaatggatcagaacatgtgtctgagtcttgctccatctgtttaatggtgaggcatccaaaaacagctgactgctcagatataacaccaatttaccattacgtgctctagagtccattgccattttctctaactctgaatatcccaatatttttcctgtatcccttgtcctgngtcaaattcctttcattccttattttactgtctgttcagaaaatattaagataccaatgtaatattacttacttccttacaaaggatgttgtaaaagtattcaacaaactgacttgtggacttgaaatagctaggtcatgttaatttgaaattttgtagtgataaaattcatctctgaaagcatagaaaatcagggatttgtaatttctacccaggatgtggtaacagaatatggagaattcagtctatgtgctcgttttaggaaacactgaaaaataaaaataaaaaccatattcctattacctacagatagccactattactatttttctatagtttctcctgattcttattgcatgcatacttaaaaaagaaaaaacataattgggccgggcgcggtggctgacacctgtaatcccagcactttgggaggccaaggtgggtggatcacctgaggtcaggagtttgagaccagcctgaccaatatgctgaaaccctgtctctactaaaaataaaaaaattagctggatatggtggcaggcacctgctaatcccagctacttgggaggctgaggcgggagaattgcttgagcctgcgaggtggaggttgcagagggccgagatcacacgactgcactccagcctgggtaacagagtgagactctgtctcaaaaaaaaaaaaaattacaatcacactctatttatgtatcacaaycttttaacctaccccagaatacccatacttgttcactccattaggaatgctcttcccttctcctagcccaaatctctcactgcctacaatattaatttcacccatatttctacacgaatagttttacccaatagttttagttttctaagtggtctccatttttaatatagaatttagaattgacccattcattcatgaaacgtgtattgatgtttattaacaggcacttttgtgtaatttgttagaactacttttaactacttaaatagcaagaccttaaagtgtttaaaacacttacaaatgaagatgcaaatagttttagagataaaacaactgacaatggcaattcagatatttagtctagaagttgtgaattaaagggataaaataaagagctattataatataaaactgtttggcctgcacagattttccactaatagctggtggaaaaaaataactttcatgtgtgctgagtgtaggtgttttctatattcaacctgtgagggagaaagcttatgtgaaatgaaagcattagctggtttaatgctgtcagacttgaaagaaggctgatccatgtaaatgcataaagatmccagaagtatggaacctagttatataaatagcaatactaatttaataaaactataccccatttcaaaaacgaatttcatttcaggcctacttttaagagttggaagacgctgaaaaagccttcacattttggcattatcaaacaactaactgaacttgacagttgtagctgttttttctgacactactgtaaccaggaaatggcactgtaaccagatgagagcttcctgtctgatttttctttttcttcctttctttccttccttccttccttccttccttccttccttccttccttccttccttccttccttccttccttccttccttcttttgagatggagtttcacactgtcactcaggctggagtgcaatggtgcgatcttggctcactgcaacttctgcctgccgggttcaagcaagtcttctgcctcagcctcccgagtaggtgggactccaggcacgcatcaccatgcccagctaattttttttgtatttttagtggagatggggtttcaccaygctggccaggctggtcttgaactcctgatttcgtgatctgcctgcctcggcctcccaaagtgctgggattacrggcgtgagccaccatgcccagccctgatttttctttcttaaagaaattagccagatgtggtggctcacccctataatctccgcactttgggaggctgaggcaggtggatcacttgagctcaggagttcaaaaccagcctgggcaacatagtgagaccctgtctctacaaaaaatacaaaaattatcagggtgtagtggcaggtgcctgcagtcccgacttacttgggagactgaggtgggagcatcacttgagcctgggaggtcgaggctgcagtaagccgagattgcatcactgcactccagcctgggcaacacggtgagaccgtgtctcaaaaaaaaaataaataaataaataaataaagagcatactaatggctgtgttgaatgatatagactctgcattgtttcctgctaaaattatctttgaaaaaaaattgttctttatttgtacagaaatgtgtaaagtgtcagggaaaaccctgaataggccctttcaggtaaaaccctgattaggccctttcagataaaaagtaggttcaaaattaagtgcttgagaaagtacaggcaaaaacagagtagtaataactcataaaccttgtaataatagaggtctcatttctctatggtgaaatccttttgtaaccacaaatttcaaaaccttatttagtggtttacttttttttggtatctttattaggacaaaattttagcaactttatctaaatgcactgaactaagagtgtggaaattaagtttctaagccaagccctggaaattccttctgaatgacctgggataaactgtttgtaaataggtataaatagcttatctactttatagagcaattgtgaggaccaaattaaagcatagacattgaagttatctatctatataccaaccactatctctttttccagaaaagatgaaggttgcttacaaaaaatccatctagaatgaaatatttttttttttaatgtgagcaagggaaacagaattagagaaatgatggtggagagaaagataagaaactaggtttagaacataaaagaaacaagtcataagattcctgtacattagttagaggtgtatcaaatatttagctattttcagcagcataaaagtgctttgaaatctgaagtgaactacgtaagcataaggcattgttagtaagtttaataacatgccgatcgtccttttgggtctgctatattaggatttgattggtgttcatattcctaaaatctggtcctgtcgttcaccaatttttttgtttttgttttcatttgttctgggttgtgatgctcttcaggaacaatatgaactggtctacaatgctgtattagaactatttaagagacagatggatgttatcagagataaacattctggaacagaggtaaaatttaaactagatattatgtcaaaaaaattttcatacttgcttttggtcaagggatgtcagatttgttgcaggatttatctattgtcacaactaaattgagagcgtcaggtgtgcatagggctgcactgaaaatttcctgtggaaaatgacaaattaatttgatgtaatttaacttaaaaaattaatctcactaagtccggtggctcacacctgtaatcccagcattttgggagctcgaggcaggcagatcacctgaggtcaggagttcaagaccagcctggccaacatggtgaaccccatctccaaaaaaaaaaaaatttagccaggagtggtggggcatacctgtagtcccagctactccagaggctgaggcaggaggattgcttgaacctgggaggtggaggtcgcagtgagctgaaatggcaccacagcactccagcctgggcaacaaagtgagaccctgtctcaaagagaaataaaaatttaaaaataatctcttggctgggcaaggtggttcatgcctgtaatcccagcactttggaaggccaaggtggaaggattgttcaagcctaggagtttgagagcagcctcagcaacatagcaattgtctctacaaaaaaatttttccaaatggccgggtgcagtggttcactcctgtaatcccagcactttgggaggccaaggtggggttttgccatattgaccaggctggtcttgacctgggatcaggagttcaagaccagcctggccaacatggtgaaaccccatctctactaaaaatacaaaaattaactgggcatggtgatgcgcacctgtaatcccagctactcaggaggctgaggcatgagaatcatttgaacccaggaggcggaggttgcagtgatctgagattgcaccactgcactccagcctaggtgacagagcaacactctgttaaaaaaaaaaaaaagccccagcaaaaagagaaggcttaactaagattcagagtctcataacaatgtgaaaatacccagatttcagttgaaaatcacttattataccaagaaccaggaagatctcaaactgaatttaaataaggacaataggtgacaacaccgagatgatacagatgtcagaattatctgacaaggattttaaagcagccaagataaaaatgcttcaatgagcaattaaaaacatagttaaaacaacaacaacaaaacaataaaaagaatgaaaatataaaaaaataaaaaaggtaaaaacatgcttaaatcaaattaaaaaatacaaagcctcatcaaaaaaaaaaaaaaaagagtctcagcaaagaaacaagatataaagagaaccaaatggaaattttagaacttaaaaatacagtaactgaagcaaaatagatgggttcaacagcagaatagagggtacrgaaaaaagaattaatgaattgaaaagtagaacaatagaaattgcccagtctgagcaacagtgataaaatagactgaaaaaaaataaacagagctgcagggaactaagggacaaaaaaaaaaaaaaaaaaaatctagcattgggtcatcaaaactccagaaagaaaatagaaagggcagggctgaaaaagtactggaagatacatcataattaaatttctgaaaacaaaaaacgacaaaaaagttttagaaatcagccagaaaaagatgacaccttaactgtaggaggaaaacaattagaatgacagcagattttgcattaggaatcatagaggtcagaaggaagtggcacaatattttccaagtgctgaaagaaaataactgtcaatccagagttttacacccagtgaaaacatccttcagggctgaaggggaaatcaagacattctcagatgaagaaaaactaagataatctgttaccagtagacctaccctaaaaaaatggcaaaggaaactttctaaaccgaaagggaatgatgaaagaaggaagaaagaacataataaacaaaagtgggtaaatataataaactttccttctcctcttgagttttataaattatgttttacaattgaagcaaaaatataacactgactgatgttgttctaaatgtattaaaggaaatattttaaatgattataacaggaggatggtaagaaacataaaggaaggtaaggcttccacacttgaactggtaaaatgataacaccagtagagtgtgataccatatatctgtatctatatctagagccatgactaaaaaaaggctatacaaagagatataataaaacacactataggtaaatcaaaatggaattctaaaaaatgcaggaaagagaaagcatcaggaaaaagaaaagagcaatgagaaacagaaagaataaagrgaaaacaaaaaataaaatagcagaatgaaacttgaccatattaataattacattaaacatataagcctaaatacaccaatatttactggtggtagagtgaattgccagactggcatagagaattaaaaaacaattcaactatatgttgtctatgagaaactcacttcaaatatataagagggctaaaaacaaaggaatggaaaaaagttatatcagtaaacatgaatcaaaggaaagcaggagtggctatgttaatatcagataaagtagacttcagagcaaagacaattatcagagatagggagataatgataaaagggtcaatctgccagtaagacataatagtcctaaatgtatatagaccaaacaatgaaattgcaaaatatgtgaagaaaaactcatagaacttaaaggagagaaacagatgattcacagtcatagccagagacttcaatattcttctttcaacaattttgatagaactagacagaaaaccagcaaggatataggtgaactcaacaccactaactgacaaaatctagttgacacttacagaacactctacctaataagaatacacattcttttaaagtgcttatggaaaatatatatcaagatagagtatatcctgagccataaaaatctgaaaaatttgaaaaatttttttaaattgaaattagcctgggagcagtggctcacacctgtaatcccagcactttgggaggccaagacagacggatcacatgaggtcaggaatttgagaccagcctggtcagcctggccaaaccccatctctactaaatatacaaaaattagccaggtgtggtggtgggcacctgtaatcccagttacgtgggaggctgaggaaggagaatcacttgaacccgaacctggtaggyggaggttgcagtgagctgagatagcatcactgcactccagcctggccaacaaagcgagactctgtctcaaaaaaaaaaaaaacaaaaacaaaaacaaaacaaccaaaattatacagaatatattttctaaccacaatagaatcaaattagaaatcagtaacagagaccgggcatggtggctcttgcctgtaatcctagcactttgagaggccaaggtgggaggattccttgaggccaggagttcaaaatgatcctgggtaacacagggggacccccgtctctacaaaaattaaaaactcagccaggtgtgatggcatgtgcctgtagtcccagctactcagggggctgaggtgggaggattgcttgagcctgggaggtcaaggctgcagtcaactgtgattgtgccactgcactccaacctgggtgacagagcaagaccctgtctcaaaaattaattaactaattaaaaaaagaaaaaaatcagtaacagaaaggtaacggaaaagtatccaaatccttggaaatcaaaccacacttttctaaataatctattgggtcaaagagaaagtctcaaaggaaataaagaaacacactgaattaaacaaaaatgaaaatacaacataccaaaatttatgagacagaagcaatagcagtactgagagggaactttatagcactaagtgcatccattagaaaacagtataggtctcaataatctaagctgtcactccaagaatatagaaaaagaaataaagagcagaaatcaatgaaattggaaacaataatagagaaaaatcagaattggttttttgtttgtttttgtttttttgagacagagtttcactctatcacccaggctggagtgcagtggcatgatcttggctcactgcaacttccacctcccaggttcaagcgattctcctgccttagcctcccaaatagctgggactacaggtatgtgccaccatggccagctaatttttctatttttgtagagatggggttttgccatgttggccaggctggtcttgaactcctgactatctgcttgcctcggcctcccaaagtgctgggattacaggcgtgagccaaggcatccagcctggtttttttaaaagataaaaaaaaatcgttctttaacaagatcaatgaaattgacaaacctttttaaaaactgacacagataaaaagggagaaaatgaaaattaccaatatcaggaatgaaataggagctatgttgtccaggctggtcttgaactcctgggctcaagggattttcctgccttggccccccaaagtgctaggattacaggcgtgagtcaccacacccggcccagaatggattattttctcaaacacaatctaccacaatttactcagcatgacatagataatttgagtagccccttagtgattagaaaaattgaatttgtaattttaaaactcccaaaaaagaaatctcaggcccacatagtttcactagagaattctatcaaatggttaaggaagaattaacaccaattttatacagtctatactaggaaatagaaaaggaagagatactttccaattaatatttttattgtggtataatatatcattttaatttactattttagccatttttaagtgtacaatgtagtgtcattaagtatattcacaatgttgagtgactatcactatttctggaactttcattattctaaacagaccctctgtatccattaaacaataactccctattctcccctcccactggcccctggcaaccatccttctactttctgtctctatgaatttgactactgtaggtacctgataygggtggaatcatatagtatttgtccttttgtgtctggcttatttcacttagcgtaatgtcctcaaggttcatccatgttgtaacgtgtcacaattttcttactcattaaggctgaataatattccattgtatatgtttatacacacacacaccacacacacacacacacacacacacattttgtttatccattcatccatcaatggatacttgagttccttccactttttggctgctgtaatgctgtgatgaccatgggtatacaaatatatatttgtatccctgcttttaattactttgggtataacccagaagtggaattacatgtggtaattctatgtttagttttctttttttttttttttgagacggagtctcgctctgtcgcccaggctggagtgcagtggcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggccgtttagttttcttttagaacagccatactcttttccatagcagctgtgccattttacattcccaccaacagtacacaaggattccaatttctctacatcctggccaacactttttattttctgttttttgtttatttgtttgtcttttgagcacagtctcgctctgttgccaggctggagtgcagtggcgcaatcttggctcaatgcaacctctgcctcccgggttcaagcgattctcctgcctcagcctcccaagtagctgggattacaggcacatgccaccacgcccagataatttttgtatttttagtagagatggggtttcaccatgttagccaggatggtctcaatctcttgacttcgtgatccgccggcctcggcctcccaaagtgctgggattacaggcgtgagccaccacgcctggcctattttgtttttttgatggcagccatcctaattaggtgtgaagtggtatctcattgtgattttgatttatattttcctaatgattagacacctttctgtggtcttattggccatttgtatatcctctttggaaaaatgtctcttcaagtcctttgccttctcccacccacccctactttttttttagtcagggtcttgctctgtcattcaggctggagtccagtggcaccatcatggctcactgaagcctcaaactcttgggccttaagtgatcctcccacctcagctcctgagtagctgaaactataggtatgcactaccacaccaagctaatttttttttaattttttttttagagacagggtctcattatgttgcccaggctagtcttgaactcctggcctcaaggagtcctcccatctcaaactccccagtagctgagactaaaagcatgagccatggtgcccagattttgctcattttttaattgaggctgtatgcggtggctcacgcctgtaatcccagcactttgggaggccgargcgggcagatcacttgaggtcaggagtttgagatcagcctggccaacatggtgaaatcccgtctctcctacaaagacaaaaattagccgggtgtggtggcgtgtgcctgtaatcccaggtacttgggaggctaatgcaggagaattgctggaccccaggaggcagaggctgcagtgagccgagatcgcaccactgcactctagcctgggtgacagagtaagactctgtccccctccaccaaaaaaaaaaaaaaaagagttgtttacatgttgttgagttttaggagttctctatgtattctggatattgatcccttatcagatatgtgatttgcaaataccgtcttccattcagtcaatgggttgcctttttgcctttgtgtcctttggtgtgtaaaagtcttaatctcaatgaagtccaattttcctattattcttttgttgtttgtgcctttggtgtcctatccaagaaatcgttgccaaatccaatgtcatgaagcttgcccattttcttataagagttttacattttacttcttatgtttaggtatttgatcaatttttgagttaatttctgtatcataagataagggtccaacttcattctctctctttttttttttcctttgagatggagtttcgttcttgctgcccagggtggagtgcaatggcgtgatcttggctcactggaacctccacctccctggttcaagtgattctccggcctcagcctcttgagtagctgggattacaggcatgcgccaccatgcctggctaattttgtatttttagtagagacggggtttctccatgttggtcaggctggtctcaaactcccgacctcaggtgatccacccgcctcagcctcccaaagtgctgggattacaggcatgagccaccgcacccagcctcaacttcattcttttgcatgtgtatattcagtttttcccagaatcatttattgaaaacactctcctttctccattgaattttcttggcacttttgtcaaaaatcaattgcccaccatatgtaaatgtttttttcaaagctcttctattccattggtctttagtctatactatgtcagtaccacactgttttaattactgtagctctgttgcaatttttgaaatcaggtagtgtgtcattcaactttgctcttctttttcaagattgttttgactgttcagtgccccttgaaattccatgaattttagtctgttttttaaacaaattatgtaaaaatgccattgggtttttgataagaattgcattgcacttgtagatcactttgaatgtctatttatttatatcttatttaatttctttcagcaaagctttgtagttttcagtatacaagtcttttgcctccttggktaaatctattcctaagtattttattctttttgatgccattataaatataactgtttccttaatgttcttttcagattgttcattgctaatgtatagaaatgcaactcgttttatgtgttcattttacatcctgcaactttgaatttgtttattagctctagcagattttttgtggaatcccatatataaaatcatgtcatctgagactagagataattttacttcctttttttccaatttttttttttttttttgagatggaattaagttagggtcttattctgtcgcccaggctggaatgcagtggtacgatctcggctcacttcaacctccgcctcctgggctcaagcaagtctcctgcttcagcctcccgaataggtgggattacaggtgtgcaccacatgcccggctaatttttatatttttaatagagacgggctttcaccatgttggccaggctggtttcaaactcctgacctcaagggatccactcaccttggcctcccaaagtgctgggattacaggcgtgagccactgtgcgcagcctttttttccaatttgaatgcttttttttttcttgcctaagaacaaaattaattaaaaaaattactttggctagaactttagtactatgttgaatagaagtggtaaaagttggcattcttgtcttgtttttgatcttaggggaaagtttaagtctttcatgtatgaatatgatgttagttatgggttttcatatatggcctctatcatgttgagaacatttccttatattcctattttgttaagtgattttaacatgaattttgtcaaacgctttttctgcatcaactgagatgttcaaaatggattttaacatctctgaaatgaagatatattttataatcaattatattttaagattctatgaaccacaataacatatttcataatatgataattgctataaaaaataaggattgggaagctgaggtgagaggaggacttgaacccaggaggtcaacaccgcagtgagccatgtttgtgccactgcactccagcctgggtaacagaataagaccctaacttaattmaaaaaaaaaaaaaaagattgaggccaggcactgtggtacacacctgtagtgtcccagctacttgggaggctgaggtaggaggactgcttgagcccagaagtttgaggccagactgggcaatacagcgaggccctgtctcttaaaaaagaagaagattgagcatggctggacaggggaagaaatgtgattttaggttgggtggtcagggaaggtttccttatgcagatgacagttaagcagagatctaattacttagaaggagccagccatgcaaaatttggagcaaaaatatattaatcagggggaatagtaagtgtaaaagccttgacttggaaataagtttggcatgctaaagtaatggcaagaaaaccagtatacctagagcatagtgrggaggaaaagagtagaacaagatgaaataggtccagagacctaataagtacctgtaaagggctgagatgctgaaatttctaaaggcagagtgtttttgagactaaagttacccaccaaagaacatttttaaaactcccacatttgaaaagatgatgatatacacaaatcctttctrgtttctataatactattaatcctttattctggccatctcagtatatgaacgagttcttgctgagttcaatattttggaagctaatctaactctttcatgaattattttaaatctttttatttcctgaaaaattacttttcagccttctaaatattaaaatatcttattgacattgcttcactgaaaaccagcctctgacttatttcttttaaagagtcaagcaaagcattgtattcctgagaaaaatcacactctccaagcagactcttattctcctaatttaccaaaaaggtgagtacaattttatwtatctaaatgttgactaattgtgtctgggagatgaatctcatgcttatacatcattgtgatgctaggaagcggcctgtttggggtatggtgtcatcattacgctttctttttgttttagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactaggtaagttattttttaaagtttgcatagaattttagatttcattttgtttctatagaatagttggtttcttctcctcttccctcttctcctctgcttcttctctttctttcttttttctcttttttttcttttttttttttgagatggagtctcgctctgtcacccaggctggagtgcagtggtgcaatcttggctcaatgcaacttccgcctccagagttcaagcaattctcctgcctcagcctcctgagtagctgggattacaggcgcgcgccaccacgcccggctaatttttgtatttttagcagagatggagtttcaccatgttggccaggatggtcttgatctcttgacttcgtgatctgcctgcctcggcctcccaaagtgctgagattacaggcatgagccaccacgcctagcctgcttccttctctttcttcttcctgctactcctcaaataaatacattccaggagtgttttaatgctgtaataagttgaaaatagcaacatcaaacataatattccatgaaacaggcaacaatggaggcaatcaagatctggtacaggatctgtaccagcaggagtgcttctaaagaaggcacgcctcatttctagaaatgtatatcaaaggctcacaatatactgttttttaaaaatattttttgaaacagaatctcactatgttgcccatgctggagtgcagtggtgtggacattgctcattgcagccttgatgtcctgggctcaaccaatcctcccacctcagcctcccaagtagctgggaccacagggacacgccaccatgcctggctaattttttttttttttagaaatggggtcttgctatgttgcccagcctggtcttgaaaatctggcctcaagcaatcctcccaccttggcctcccaaagtgctgggattacaggtgcaagccaccacacctagcttcagaatttactcttaacatatagaagcagcttccaaaggaagagcagaaaaaaatttgatcaatagcacccagattttttgttgcacaattatgtggctaaaatgagttgaacatattgctaaaaattgaattatcttcctgcaggatttggaaggggagaacctgatttcttgctcttttgtagtaatctcgtagatgacaatacatgtttagtattttgtgtaaaaattttatcatatgtatacctttactttcatgttttgtctcttttataattctgtatttttgcatataatgcatattgttctgttttactgattagtttgaaagtagaaatgagcaccctgttagagatgatgacaataatttgatgtggaagatgatgagggaaagcaatgaacaagtttaactcccttaggtatatcatcaaataatttgtaaagcacattctacatagataggaggtggagaaaacttttgctctataacattatttattgtagagtttcttaataaatagttgtgtagatcatttgtagctttgttgcaaaaatatcttatctggatctaagatgttccttctgtgattagattattttatacatttttaaacatttaaatgtattttcttttcttataccttaaacttctctgagcatctgcatcattaaaaaacagagcgagactccgtctcaaaaaaaaaattaattaataaaaacatacccttattttcagggattgtaacaatatcgtcatgtgccatctggtggcagtttcttgtaataccatttaaaatgtttaataaaaactgaatgtttgtatagaaatacagaagactatcctatactgttgttttgtaaaatggaaaaatacccatattcttgaattttgtatagaatgaagagatactgaaatctttatgattttacctaatgtataactgaaccttttacacgtcaaagcactttataatgttttattatatagtctatgtaaaacaaaaggagttatgtaaaagttaattcaaagcttccaaaattaatataatattttatgttaactgatacaccgtgactcaatcaaaatgtttttgagcttttatttatttattattattattattttttgagacggagtgtcctgctgccacccaggctggaatgcagtggtgcaatctcggctcactgcaagctctgccttccgggttcacgccattctcccacctcagcctcccgagtagctgggactacaggggcccgccaccacgcccggctaatgttttgtgtttttagtagagacacggtttcaccacgttagccaggatggtttcgatctcctgaccttgtgatctgcccgcctcggcctccgaaagtgctgggattacaggcgtgagccaccgcgcccagccctacttttgagcttttaaaacaataaatgttaaagaataagcaaaaacctcctgggtttgtaccttaagagaatttattttgctttttccttgaatgaacaagtgtcaactttactgataatgttgcttcaacggaatttaaatataaattatggtaaatttatatttaatattagaatataagaatttcctttggattgttctaattaacaattgttacaatatttttgacattttggatagcaactgctccaaggatagatgatgaaatcccccctccacttcctgtayggacacctgaatcatttattgtggttgaggaagctggtgagtacagttcagtaagtataaaataaagtgtgggatgggcatggtggctcatgcctttaattccagcactttgggaagctgatgtgtgagccttgagtttgaggagttcattgaggccaggagttcaagactagcctgcgcaacatagtgagacctcatctctaattttttttttttaatttagcagagcaatagcagcatgcatgtgtagtcccaactatttggatggtggaggtgagaggatcacttgagcccaggagttgggggctgcagtaagccatgattgtgccactgcactccaktctgggtgacagagcaagaccctgtctcaaaaaataaaatgaagtgtgaattaactagattacttctcaggtcctttcnatgttttatgtattatttgctgagcaacatttgatgtctaaaagaatactattcctaagaaccgaactatattcactttcttccaggagaattctcaccaaatgttcccaaatccttatcctcagctgtgaaggtaaaaattggaacatcactggaatggggtggaacatctgaaccaaagaaatttgatgactctgtgatacttagaccaagcaaggtcaataattttttaatgactctactcatttagattcaatagactacagttctactccttgtatttttaacacccatcattcaataaatcctaagcacatactaaatatagaacaatgtgctagaggatgttgggataaaaaggatgtataagacacaattcttgcctgtaagaagcttcttgtctagtagtagagatataggatgtgtacaaatctttatttttgcctatatttattataacaaagcaaatgtgatcaatgtcatatgaaagataaagaatttcaagtgtaggagatgcctccaggttggaagtgatcaaggaagatttagtgaaagaggaaacatttgagctgattcttgaaggatagttaaggcaaaaataaatgtttcatacttaagtaggaagcttgttcactgtagtcatttggtaggctatatcatgtttgctgtgataatatgttatagagaatgacaggtgtgcatattacttaagataaaccttttggaatagtgtggttgatggtaaagtcagagatgggggtgggaggggtttgtggattaaatagaaaataattattgaaagtaggtgtgtcctgcttctggaggaaaaatagaagtgtatctaaaaatgttatgcatttctgtatagtctgtgaaccaattctcttaaaatttgagagatcagaaaaataattaaacattttaaagtacctacaattgcaatgctgataggcaaatattctctgccttttaaattataattctaatgtactagtaattattattgtcattaataataggcacatatatttactttaacaactcccagaggaaagaacagtcactcttccaatgttatgaagtaacttcaatttccgcaacttacctctaattaaattttcagggaaatgtttcaggtgggacagaaataagtcagaaggggatcaatttaggactaattgccatgggatataaaaatcagtgtaagagtgaaagatgccatttcataattcagcacacttacaaattaggaaaaatagggtctacatttcataattatctctacagctatattacatataagttcaaaaatgccattttttgctttgagtttgtataatttgtatacatattcttctttcacttttcctttctttttttcttttagagtgtaaaactccgaagtcctaaatcaggtaaaaatttctcttggctttagatgacatttagccctaagattggaagaatggttcgttaagtttagagtaattcacttcaggaagttacttggttcccataatagcttccagtattcattgatttatttctggctttcccagactagaaattttgtaaagagcaaggtgaagacaggattttagaattctgctccttaatatataacctctctgaaataatatataaaaactatttcagagagaatcttttaaaactttgcagcttttccactatagagattttcccactgttaacagtgtgattcaaaaaattatttctggccacttaattctttaatttgctgttgcctctccagtacttgtctgagctttgcctgtttcatgcattgaagaacaaaaactaacatttattgggcacttccaggtactttgtttacattatcacaagtggtagttgcccttaacatatttattcatactgtcatattattcaaatacatatacagataatataaaggttaaaaaacatgggctttgccaggaatttgaggctgcagtgagctataatggcaccactgcacccagcctgtatgacagagcaagatgctgtctctaaaaaacatgacaacaggccaggcgcagtggctcacacctgtaatcccagcactttgggaggccaaagctggcggatcacgaggtcaagagatcgagaccatcctggccaacatggtgaaaccctgtctctactaaaaattagctgggcstggtggcgggtgcctgtagtcccagctactggggaggctgaggcaggagaatcgcttgaacctgggaggtggaggttgcagtgagctgagattgcgccactgcacaccagcctgggtgacagagcgagactccatctcaaaaacaaaacaaaacatgacaacaaaaacaagggctttagagtcagataggctttaagtcaaatccctggtctatgaagaattatcaacatgcataaacttggttaaattacatactttctccttctatttttctcatttataaaagaagaatagaatcccttagataatttttatgaggattaaatacaataatgtcgtaaagcttttagcgtagtacttgtcaaataagtcctcattaaatattatcgattataatttttattaatcattaaataagcattttactaagcaacttctgtgcaccttacacagggttagaataggcaggatgtatgagaaagagtactacttaatgcttatattcaaatagagtagataaaattaatactcacrtggaaccactaagtgataatctgtgtggcactgactgtaatcaccaggagtctgggaaaacaggatggcattactggagtggttaggaaaggtttcgctgagtggaagaaagaactttaaataatttgtatagacagagagaaaaaaggagggaattccagcagcagggatcagcctaccaatgactcaaaggtagaaatgagcatgatgtgtatggagaaatggtgagtaggctattttttttttgcaatagatattctagtttgtgaaatacagaaaataaatttgggtaaataagatgtggggcaagattctgaaggacttaaaaaagctagtcacatgaaatatccagaatagacagatccataaagatagaagcagattagtgattgccaggggctgggggaaagaggaaaataaggagtgatgacttaatgggtgcagagtttccttctagggtgataaaaagtattctggaactaaattgtggtgatggttgtacaatactgtgaatgtgctaaatgtcactaatggcaaatcttatgtgtattttactacccaaagttaggcagaggaatttacacccaaagttaggcagaggaatttagatttaatgtagtaagtaacaggcattatgggttctttgttaggggagtattaagatgaaatggaattttagggaaataattactagaatactgttaacgaacaactttagttttcagaatattccctaacagcaaactggaagatgatgaactacttcagagtagttattaagtatttattaaatgcctactgtatgccagttattttattaggtgctagaaataagtactacacttgtgtgtattacctagcatgtaagaaataagacaatttattgataagacaaattctaaggactaaacaaacccaatgaccaatgacaygtgaacctcttgtactttactgcattttcattttcaaaaggaattaatataatagtaatactcagcaccatataattaaatgcttatgtcagtagaataccatctgtatcttcagaaatttacatcatgggaaaatatgtccattactgaaaatcttcatcatggaaaatttcaaacacacatttaaaacctaccttatcacaccaataaaattaataataattccttaatagtaactaatatccagactgttcagttttcaattgtctcaaaaatgtctttttacagttggtttattcaaatctggattcaaacaaaatctaagcatttcatttgatttgtatgtttgtcttcttaaatctgtcttttgaaatctgtaacagttctcccttctttttttaatattttctttttaaatatataaccgttctcctttctatacttttcacatcatttatttgttgaagagagtgggtcatttgtcttaaaagactgcttagtcttctagatttggctaattgtatcacaatggttttatttaacatcctctatgcccaatatttcatgcaaaatgggtgttagatctagaagcttgattatattcggtttcagtgtctttgggagaatacttctgaagtgagctatacatttttgatgaatcataggctcataggctaacgaggtagaaaaacaaagttcttgaggctccagtcatttttcagataatattttatttggtgattgtcggctaagattgattgattaaaaaattatacaaagagaaaagggtgttgacttatgacttttaattgatggatttctctggtttattgtatactttcttatcacagaactacatcaagatcgttcttctcccccacctcctctcccagaaagaactctagagtccttctttcttgccgatgaagattgtaagtggtagcactttctctcaaaaaaatcataaaaatgaamatgytaaaagattaacaataaagtaggacctaaatggaaaggtacaaaaatgattacacaaaagaatacattttaaaagcccctaatatatagtcaaaataatgcctaaaaaagccaagctaacaatttattatatgtaacatgaaggcttaagaaggtatgcaatggaacatgtttttctcctttttttttttaaggtatgcaggcccaatctatagaaacatattctactagctatcctgacaccatggaaaattcaacatcttcaaaacagacactgaagactcctggaaaaagtttcacaaggagtaaggtaaagaagataagagttttgggaaacatgccggaaactttcccttactgaaagtttccccctccccagcattaagatggaaaattagattaaatatctttattaaaactaattgttgatattataacagtcaaaattaatagaaggaaacgaaaaagaagaaaaaatacaacttaaagaggcatttgtcagagggagaggaccagaaaaaatacctattgggtactatgcttattacctgggtgacaaaattatctgtacagcaaacccttgtgacacacagtttacctacataacaaactggcacacatacccctgaacctaaaataaaaattaaaaaataaaaataaaaataaatgaagaaaaaaaaaatccacttctccctaaggttgatttataaatgtaaaagatgcccaaggaaactaccaacttgtttatttctggaactagataaactgaattcaaagttcacatgggagtagggggaagcaggactagtcagaaacctgcaaataaataataaataaaaatagtttagataaatgtctttctaaaataatttttaaaaataaaaataaataaaaagaaaagcaatgaaagagagtcaccttagcagatattcgaatatggcaaagcctcaattaaaatggcatgataggcccagcatggtggctcatgcctgtaatcccagcctttgggaggccaaggcgggcagatcacttgagctcaggattcgagaccagcctgggcaacatggcaaaaccccgtctctaccaaaaatacaaaaaattagccgggcatggtgctgtgtgcctgcagtcccagctactcaggaggctgaggtgggaggattggtcgagcctggaaggtggagactgcagagattatgccactgtactccagcctgggtgacagagtgagacgtcatctcaaaaatttaaatataaatataaaatggcatattagtgtataaaaagaaacatatacgagcagagtaaaagggaaagttctgaaatagatccaaatatatgtagaaatttagtatacaatgaaggtggtatctcaaaatcaggggataaagatggatggtttaataactgttgttggatcaaataaccacctgaaaaaaagcagggtctattccttacatctatactaggataaattctaagtggctaaatgattaaaatgttaaaaaaacaaaaacaaaaacctcaatccatagaagacctaaagaaacttggaaagagtcttttacaacctgggagtgtgaatgacctttataacttactcaaaatccggaggccataagaaaagagatagataaattcagctaaataaaagagaaaatgtatgcatggtaaaacaatcaccttaaaaatcaaaagacaaagaacaaattggaggaaaaaaaatctgcaactggcaccacagccaaaggggttattactctaatagataaagaactgttagaaattcatagaaaataataacccccaaataaaaatgggcaaaaataggtgatcagatggtttgaagaaaataaatgagcatggtatgccctttatatatttgatatgttcaatttcattcataatgaaaaaattacaaattaaaaccacagtgacatattgcttttcatccatcagaatggtaaattccaaaagtttgattacactctctgttagggaggctatggggaaataagcacactcaatgttgttggtgagaatgtcaagtggtacaacttctttttacaattttttttttaaattagagatggggtcttgctatgttgtctaggatggggtctccctatgttgccaacttctagactcaagcgatcctcctgccttggcctccccaaagtgctgggattacaggtgtgagccactagaagtgaaatttatcctacaaatatgcttgcatacacatgaaatgacatgtataccaagtattcattgcagcattatctgtaagagcagattactggaaacaacataattaatagtgttaattgttaggggaactgattaaataaatcataaatcatgttatatccatacaaatggaatactgtgcagctaaaaaagaattaggactttctcaatatatttatatataatttattaacttttacttaaaaaaaggaatatgatacatatgtgtatttacttatatattcataagtaacactggaaggatactaacaacagaggataaaaaactaacagtggttatctacaggaggagcattagaaactgagtagtagattgaagacaaggatgggagcatttttactaggatttcctgacttgtaaataaatcatctattttttaaaaaataactaaaaatgttacaaataaataatgtattaaatatctattccatggaagagcacatttctgttaggtgttaggaaaacagaaatgtcataaaggataactatttgcccttgaaaatagtatagttaatctgctggaacagaacacctttgagaaacatgaaaattatcaagaagaataaaatgcctgaagcagattaaaaacatacatgctgaagaaatgtggagtaaagaagaaatttgggtaggttccttgaagagataaattagagactccaggccgggcgcggtggctcacgcctgtaatcccagcactttgggaggccgaggcgggcggatcacgaggtcaggagatcgaggccatcccggctaaaacggtgaaaccccgtctctactaaaactacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaattagagactccaccataaaagtagaggaaggaagtatggctaacagtttggaaggtggccttagtaaattgaatacagaatatgactggcaaaaattcttggctagaatggaaatggctgtgtatcatggatatattcagaagccattgtggattctgaaatggtcctaataaaggagggaagtgggaatttcatcccctctacccctctgagtcccttcccttcccttcccttcccttcccttcccttcccttcccttccccttctcccttcacttcccttcctctgtctctctctttctctttctttcttttttagacagggtcttgctctgttgcccatgctagagtgcagtggcataaatatggctgactgcagccttgacctcctggactcaagtgatcctcctgcatcagcctttcgagtggctgggaacacaggtctgcaccaccatgcctggctttttaaaatttttggtagggatggggtctcaccatgttgcccagtctggtcttgaactccctggcctcaagggaacctcccacttgagcctcccaaagtgctggaattacaggcatgagccaccttgccagcactccactgctccccgtcaatattctgatagcataattaaaaaaaaatttattggctggccacggtggctcacgcctgtaatcccagcactttggaaggccaaggcaggtaggtcacaaggtcaggagtttgagaccagcctggccaatatggtgaaaccctgtctctactaaaaatacaaaaaattagccaggcatggtagcaggtgcctgtagtcccagctactcaggaggctgaggcagaaggatcgcttgaacccgggaggcagaggttgcagtgagctgagatcacgccactgcactctagcctgggcgacacagcgagactccatctcaacaacaacaacaacaacaacaacaacatttattaatcttttttaaaagacatgttctcactctgtcgcccaggctggaatgcagtggtgggatcagagctcactgtagccttgaactcctgggatcaagcagacctcccgcctcagcctccctagtagctgctaccacattcagctaatattttttttactttttgtagggacaggggtcttgctatgttgcctaagatggtcctgaactcctgagctcaaacaatcctcctgccttggcctctcaaagtgccgggattacaggtgtgagccactgtgctcagcctctgatactattatttcaaaatatgtagtgtgatacttgcatgggtgatataaatagcaagataaaatcaagtagaggttttgcactgaattaaaaatggcaagatggaaaaacaactttgtacattttcatggctatttttaaggaaattaaattcttttcacttaagtctatatttctatttgattaaagtatttcaagtttcacaggaaaaaaaactaacatttttcctttcttttgtagagtttgaaaattttgcgaaacatgaaaaagagtaagttggtacttatgtttaaaaatatcgttttctcaattttgtaatttttatttatataaccaaccaatattgtgaaaagattaacaatattattcctaaacagagcctccatagggtcctatgaatcagaacaatcacccataggcctccttttttttttttttttttttttgctaggcttcacaatactaatattgggcagggagtaggcgatgagaagtcttctgtttaatacacaagaataataattagtacaatggcattaaaaaaattttaaatttatttttaaaatttattttaatagcagagatggggtttcaccatattgcccaggttggtctcgaactcctgggctcaagtgatcctcctgccttggcctcccaaagtgctgggattacaggcataagccactgcaccyggccaatgtttggtactttctacccatcctaagatgctgtcatacaattggattatttaaaatttccagcagtctaacctcagatgtattttctttgaaaatagtcacagcaaagcatattgtgaacaaatgtgttgacttcatgaaataagcaaagcattgacacatttccatttttactaagtattattagcaataaaagtctgttgcttactatttttgctacattgtaatgaaaataaaatccattgagtcctgaaactgtggaaaattatcttagaaatcttatttacaaataaaaaatataaaaaccatggtgatggccgggtgtggtggctcatgcctataatcccagcactttgggaggccgaggcaggtggatcacaaggtcagcagtttgagaccagcctggctaacatagtgtaaccccgtctctactaaaaatacaaaaattagccgggtgtggtggcatgcacctgtagtcccagctactcggaaggctggggcaggaggattgcttgaactcgggatgcggaggttgcggtgagccaagattgcgccactgcactccagtctgggcaacagagcgagactccgtctcaaaaaaaaaaaaaagaaccatggtgacaatcttaaaaaaatttttgatacatttggttaatcagtgaaagagcagttatttgacattaaactggtactatagggagagacaaaaagcactgagaaaatctgatgtaggtatagtctaagaaagaaggtttccttttgggttttcattctatctccctacccaaaagctccaggttcttgagctagtttgctatcactgccattatagctgatctctgacaccaactcatgatggctgaagtatagttggaaaacataccttttctcctaaaaagagtcaaaagagaatttaaacatttcaaatggaaattatggtaggaaacaggggaaataaaacagccaagtgcaaagaaatgagtgacttaaatggttaaccaaagattggtttgatccacctaactcagaaaacagttttctttctctagctctaactctgcctagaatatcaaataaagaaacagaaacttcaggtagatttaggttggcacagctttgaaggtatagtggaactttcagagattgagtcttatttctaagtaagagctcccagttcattctctggatctgggctgtgctgtatttttcagttaccttgatcctctggtcttttgccgttaaatgaagaacatctggctcccaaaattgatcctgaagctttagactgtacttcatatgtgtcctcagccccttccagatggttcatgattctggaattccatgtgttctccctgtagcctggatctcccactggtctgtaaagctggtcctacttttaatgaaattaggattcttcttctgttattttaagctagtatctaagcctagtgtcattcattcattcattcaatgaatatttgttgagtgtctactatgttccaggcattctgtaaggcacttggtatatgatggtgaacagaacagatatgggctctgcctttgtggaatgtaagtttggtgagggnttccaacattaaacaaacaacattaaacaaaatttggttgaccatattcacaaatatatacttaataacacatgataaatgctatgaaggaaaacaaaagggtaactatgagaggataacaaaggggatccactttagaatgagtagtccaagaaagcccccgctttttttgagacggagtctagctctgtcgcccaggctggagtgaaatgatgcgatctcggctcactgcaacctccccctcccaggttcaagtgattctcctgcctcagcctcccaagtgctgggatgacaggcgcacaccactatgcccagctaatttttgtatttttagtagagacaaggtttcaccgtgttggccaggatggtcttgatctcctgaccttatgatccacccacctcggcctcccaaagtgctgggattacagctgtgagccactgtgcccggcccaagaaaccctttttaaggaagtgacaactgaacccaaaacatgaaggagcagccagccagccaaagggtccagagaagagtatttcagatagagggaacaaaatctctgaggtaggagattttggtgtattgtagaaactcaaagggaagccatcttagatgcagggtagtaagtaaagaggagacaggagtaaggcgaagctggaaagatcagggaggagcagttagatttttatgggtcatgcatggtaagtagtttagtttattctaagtgtaatgggaatccataaaagggttttaggcagagatgttacatgctctgtttcctatttatttttaaacatgcttcacagaaaagtataaaacgatcacactggctgctacatacagaatgaattatagagtgacaagagtggaagctgtcaactgttggtgggaaactttaattgctcagaaatcctttagttacaagtgacagaaaacctaacttaagctgacttcagcagaaaaggggaatttactggcttgtaacaatggtccaaatgatgtaatcagaacctaaattctcatttcatgtctctcaggttagtctcactctgtgttaactcattcataggcaggtttttatcatgtgagttcaggcttatgatggaaaaaaaataactctttattggttttcaagccacactgtgatgactagtgccaactgggtctgattgtcttgacttggttcatttgcccatccctgaaccaattatagtcaatgttctgattaggcaggatagtgtcatgccctaatatttaacacttattacatgtggacantgtccaatcaggaatgaggtcagacctatacatctggtgtgaccatgccaatataccaactgaaaatcagccctagttataggtcatttccttaatctaaaggtacaatcagctctaatggaagcacgggaactgaaaactggggaggggtagtttcctaaaggaaaattcaagttctattatcagaagagggaatgaagtttaggcaggcagcataaatatatccatgataggccaggtgcagtggctcatgcctgtattcccagcgctttgggaggccaaggcaggcagatcacgaggtcaggagtttgagaccagcctggccaacatggtgaaaccccatctctactaaaaatacaaaaaatttacccgggcgtgttggcatgcacctgtagtcccaggtcctcgggaggctgaggcaggagaatcgcttgaacctgggaggcggtggttgtggtgagccgagattgtgccattgcactccagcctgggcgacagagtgagactgtctcaaaaaaaaccccaaaacaaacaaacaaaacaaaacaaaacaaaaaaatccatgatgagccaaaataacaaaatagcagtttcctctgatatatatgtgtggaatctgtgcctcctttgtaaaaaaaacaatattctcctttgagacaattttgttttctttctgaaggatgtatataactttcagctcctatgcagtatacagattactgatatctcctgaacttcctcacctttactactttctattaatgtctctatcttcagtgcctacagcaatgcttagcacatagtaagtatttaaatatgaatagtattttatacttatactttatattaagtattttaatatattaagtataataattatacttactatagtaatatagtaagtacaaaataaatatgtatcttaattagatctgattgaaattcagtatgtagtctagtgattcatactcaggtacctcctcgaaaaggaaggtgtttctagaatcctagtattaygtatgcatgtgcaaatatgcatacctaatatgcatatgcagttcacacagtgcattctgaaaatgttgaaaacaacacaaaaacacttaatatcttcccatttatatgcaatttgttagaaagtttatacaaacctgaaattatctttttccattgccaagacagagaatgtgcaaaatgtggacaaagtttttaagggactgttttcaaaactgcagaaactgatacatgaatatatcaatgtacatatatgacctatgagtaacttataagttaacttatacctataagtaactaaaatagcaaaacaaagcagcataacaatgcttttgggagattattggcctaaataataataattattatgtttttttgagacagggtcttgctctgtcacccagtctggatggagtgcagtggcgcaatctgggctcacctcatccctctgcctcccaggttggatcaatttttgtgcctcagcctcccaagtagctgggattagagatttgcaacaccatgcctcgctaatttttttttgtatttttagtagagacggggtttcaccatgttggacaggctggtctcgtactcctggcctcaagttatctgcctgcctcagcctcccaaagtactgggattacaggcgtgagtcaccgtgcccggttatgggcctaaattagaatcacttataattagaaaaaaatcaggctggaaagtggaataaaaaaagagattccagggtagaggattatataatacaaataaaagacttgtcatggatgaattattgtggagaagaaatgatgtaaaaatgtactaagagtggccagaggaaaaagtaatatgaagtccaaagccaaaatgtgaatttcaaaaaaaaaaacaaaaaaatgctgattcatgatatattggatcttatttccttagcaattttctttagtgttgggctttactatacaatctgtttgcaaagaaaagaaaccttttaagaaaaaaaccaaaaatacaaatgagaatattatagtgtcaacccatttgtaagcacctacattttgttaacatttgacagtgatatgtttatttgggattattaattactcttaacaattatatgtgatctgatcaacagtcatctgagtctgtctttagtctttcccttatatttttttcttttgattctaggtatctgtaattcttgcccaccaaacaagcctgcagaatctgttcagtcaaataactccagctcatttctgaattttggtatgtgtgttattttactgaagagttaaaaaaattacctaaattactcatttacagtataactgattcaactttaaatawgattttaggttgcatgtataggtccttatgtttatattcttttccatgcaatttatctttttatttttaaccttaactacctcttaacatctcacacagaactaaattatctagtatatgtggaaaataaagctaggtaaccaaattattgtgttggcatgtagtaaataaatatgactatccaaatggagaaattgagatgctgtgatattctggttcatatctaaagcaaatttataaaaaacatagaagtatgataaaaagaacagcagttgccactatttaatcttatataactaattcaatagtaggaaatgaagcacaattctgacggttttaaggtttgcttacccaattgctcctaagtataagctataaacttaaaacaataattttatattcttctaagcattctattgtcctatgtgatacatatttatgtactatttaaagtagtatcaggtataattttttgtaagaatagcaattagtggtaggctattactactaaaaattattattaaccaatccccttgaaagagtgtgaggcctccaggagtccctgaatcacactttgagaactgccacttaatggtattgtccttacttacacaatcaaaattaggttgccgccacatgcagactgtaggtggcaagaaaagaggaaaaagtggaggtgtggcctcctcttcttactcttctggtcttcaaaggcactggcctggaaatggccagatcatatcagctcatattcccttgaagagaacttagacatgtgctataactaaattgcaaaagagactgggaaatgtaatattgctgggcagacagacaaaattgcctacacacaattctatttgaggaagaagcaaagaagatattggtggatggggagcaatctctgccacgcctaagttaagagtccctgtgtcatcttcacaaaatgtttaactaaaatttctggatctgtcttttttgccataaaattttgtttggatttcattaactctgaggtttaaaaagttataatttaggctgggaggggtggctcacatctgtaatcccagcacttttggaggctgaggcgggcggatcatgaggtcaagagatcgagaccatcttggccaacatggtgaaaccctgtctctactaaaaatacaaaaattagctgggcatggtggtacatgcctctaatcccagctactcaggaggcagaggcaggagaatcgcttgaaccagggagtcggaggttgcagtgagctgagattgcgccactgcactccatcccggcaacagagcgagactccatctcaaaaaaaaaagttataatttaaaaaataagttatgatttatatgaaatcatttagctaaaacattcacacagaatattgtaaaaactatgaaaaaagcaagccaggtggttcatgcctataatcccagcactttgggaggttgaggtgggagggtcccttgagcccaggagttgaagaccagtctgggcaacatagcaagaccatctcatttaaaaaaaaaaaaggaaaaaagaaaaagaaaaaagctcccaactttacctggaacataaatgttctctgcttccttctttactctaaatcagtgatacaacttgagtactctaggcctacctagcttaacaacagtctacataatctaatatgaggataaaatattagagagctgcctccatgttgcttcctctcaaatatgcctagatttgaacatttttcctacttaaaaagcagcattttcatgcctgtaattccagcactttgggaggctgaggagggaggattacttggggccagaagtttgagaccagcctaagcaacacagtgagactctgtctctacaaaaaaatgttttttttttagaactagccaggcatggtggcatgtgcctgtagtcccagctactcaggaggctgaggtgggaggatcacttgagcccaggaggttgaggctgcagtgagccgtgatcatgccactgcactctagcctgggcgacagtacaagactctgtcttggaaaaaaaaccccaaaaatcagcacttacttttttaaggcaatatcaatttaagtgcatgttactcaaaaaagtacttaaatctgaatgaaaaaatttatgattcaggtttattttccctgaattggcccacatgcaaaaaaaggtagctcgaaactgttttaagctactgagaattgaccagtgaaagagatcaaatatatgcattcctaaaattttaggtactcaatactaacatatgtccttatctctattcctagtccacttgggttacaatcaagtgatctgtactgacaggatgattctgactattgtgtgtgaaactatttaaccaaaagtattccttccatcttctttcttgccactcggaagagtaaaatgtacatcaactaggctgtgtgtcccctccaccaatttttttttatcatcaccattaacaaatttgaatgtgcttttttttcttgaatcttctttccccttccctactctccttctcttccagttctggcatagttttctaggttggtaattttttcttttttaaattgagatggagtcttgctctgtcacccaggctggagtgcagtggcacgatctcagctcactgtaacctcagcctcctgggttcaagcgattctcctgcctcagcctcccctgtagctggcattacaggcacccgccaccatgcccagctaatttttgtatttttagtagagacagggtttcatcatgttggccaggctggtcttgaactcctgacctcaggtgatccactcacctcagcctcccaaagtactgggattacaggtgtgagccaccacgcctggcttctgggttgaaatttaagcaacatttgagtagttaccataggcttgaattcctggccccaagctatcctccatactcacctccaaaagtgctcggattataggtttgagccaccatgactggcctgaggaacatttgagtacttactatgtgccaggcattgtgctggatgctgtttttttttttcaattctttttttttttcccctctgcagccttgacctccctgggctcaaatgatttgcccacctcagcctcctgagtatctgggaccagaggtgcaagccaccatgcccggctaatttttttgtgtttttttgtagagacaaggtttcactatgttgcccaggctggtcttgaactcctcggctcaagcgatccacctgccttggcctcccaaagtgtgggattattcaaaggcatgagccactgcaccctgccccattcgctttttacacaaatatctcatttgatccttacatcagttttttaaggtagataatacaatttgtatgatgatgaaattaaaggtttaggtatatctttgagtttttcattttattattcccctatacttcaaacatttcatttcttactttaagtccctaaagttgctaagtgtaagataacttaaaaatacactgccattaggcctggctcagtggctcacacctgtaatccccagactttggaaggccaaggtgggtggatcacttgaggtcaggagtttgagaccagcctggccaacagggtgaaaccccatctctactaaaaatacaaaaattacccaggcatgttggctggcgcctgtaatcccagctactcaggaggctgaggcaggagaatcgcttgaacccgggaggcggaggttgcagtgggccgagatcgcgccactgcactccagcctgggcgacagagcaagactctgtctcagacaaaaaacaaacaaacaaaaagacactaccatcaaaaagaaaagtcataaagtcacatgttgctgaaatgataaagaaccaacatcatcaacatgcacatcttttgaaagcatccagaaatagccttcattagttgtgaaaaattttctcatcctccttctttggggtggggtagggggaacaagtttgaagaagaaagataaataataatgtttacttacctacttagtttttcaggattgtttattttttctaagattttcaaacataatctcttggtaaattgaaggatttctggaccgacatagaggtataactagatgtaatacaataatgttataagtaacggtgctatatttttgtgaaattaaaatttcctgacttcatttaatgggatggagtggatgacaaaaagtcatagacaaatgatattatatactaaattatcaaagcctatatataaccagggtcctacattctattattaccattattaaatttgtaagtgctcttcaaatttaaagtgttattagtattctgttatcatttaagctttagattactanaatccctttataatctattactaaactggtcaagatgctgcctaacatttaaaaaaagaccatgtatttgcatatattataatatactctaaaatccaagtattcatttctatacttaaaacatctttcttttcattcaactttatttttgttcccaggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttytacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatmtagttcaactctaattttatgtagtaaataaattggcaggtaatygtttttacaaagaatccacctgacttcccctaatgcattaaaaatatttttatttaaataactttatttataacttttaraaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactgacttcattgcagtagtgtttaggtaatacttctccagaaactagtgaaatcaaaccacagtaattttatctgctgagtatatatcattgtaatcaattacttccaaatgtctttatcaataaacaaatatactaaaagaattctaggtaaccatgagttacttagggcaccatgagtgcatctgtagacccagctactcattccttgagcccaggagttggaggccagcctggtcaacagagcgagaccttgtctcttttttttaagagtcagggtctagatctgtcacccaggccagagtgcagtggcgcgaccactcctcccaccttagcctcacgagtacctgggactacaggcgcgtgtcacgacacccagataatttaaaaaatacttttgtagggacagaggctcactatgttaccaacgctgatctggaactcctggcctcatgcaatcctcccgcctcggcctcccaaagctctgggattaccggcctgagacaccgagccccgccccgcccgtctctaaataaatacttaaaagaaccccaggtaaaagctaaagcgaggatgaaattctaaatgaatttctgagcaacaactatccgtagtgagcagtgatgatttttggtgtgttctccggtaggcacacttttcaaatttatgcaatcttatccttaagatttgaaaaaaaaaaacttataaaaaatcttaaacgtggttttccatctacaatttttcgcaactgtagggatatattcaaaataaatgctggacatttccaggcattagaggggatgtggccggatggcgaggaggggccgtcctcaccaggactccaagcagttctcgcacctgacttcgtaggcctgtagttgtaaccatagcaatgccccagatgcttgaaaacatttctgaattgcggccctatcatatttttacagcaaaaccacccttattttacatattactaaatcctcttttcaccttcatttcatccctcgtcaaagttaaaaggatgaagattcttttatctcacaaaggttatgagagaaatattaaatttaaaatcactgtggagaccacctcctccgtgtaaaatgaggaagggtcacaggaagatgataatgggaacgcgccgccagactctgaaagccattaacattgtttcggccgttagggcggttggcggcaactcaccgcccagcggcggttgcgtcgcagccagaagcgtgacttcgcgcacgctccctttccactcctccactcagagccggggacgcggcgggggcgcggcggaactacagctcccatgacgctttgcgcggcatagggtgctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgatgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagaggtgagagcaggcaaactgcccggcttgggttctaggtctctctcagttccgatatcccgcatctttaggactgaaagacgccaaacccctgcttaccttctgctgctgtacttctctaagctcactggggtggaccctggatttcagatcgttgacacggtttgatctaactacttgaggcttctcgctccgaggccgagctgtcagttgctaatccctttaccggtcccccggagcctctcagcatttgttttcaaattctgcaaggtttccgcgccgcgttagattagtaggtggggtactaaaaaatgcctttccaaagaaaaggcatgttcctaaaatcccttctccttgttttgcttgctggagagctttagttatctgctctcccttgctccagaatagtcaggggtatggttccagtctttcaggagggaattcatataaaggttacacgactcactggttgacttagcttctgcaaggtaaaatatcagacgcagtttatcttggttctttttaatctagaggtaaaaatcattttaaagttttcatattagctatttaaattcttagaataggcatgtggaaggttttctctaccctttgatactaggaaataggaccaacagtgcctctgaaaagtgggaatttgtgcagtagatagtagaggccggaatttcagttgcatttgattctgtctagcacactttgtggatctgttaattccaatagccctcaagaatattttactagaaaatgtcagagtatccaattaaatgtggattctagaaaaattagattggccagaactgatgtcttcctgttcccaagtacctgtagcatttatttatattctttgtggaagaaatgtgatgcttttgattatgccgtatgtttgtactttatatattattttatataatttactagttgtttttcctcaggaatatttgaaatacttgtttcttagtactggaccagttaggttattacatgttaatgagacaatctttcaacctaaagttttgtgagtcttgcattctttccacgtattgagtcttaaggctaatcattttttttggtggtgctatttccgaatactgtagttcgttgcaaataattgctcaataagtatttattgaatagcattaaatttttattcatttggtggcatccaaatcttgggagtagaacttgtggcaagatgacaggactgccagttttcaccaccaatatgcaatgatcttgctctctttttatttttacttttattccctactttctcatttcttgtgtgtgtgtgtgtgtgtgtgtgtgtgtgttttaactgtacagaactagagggaattagtgatcctctggcttaaatttgtattgtagaaaaggaaactgaggcccaaagtagtaaagaggcctgttcaatcaaatcacagttaattcgcatgaagtgcaaaaaaattaaatattttttaaaaaggtgaatattggcataacaggcagtagaacccaggctcctgaatcctgcttcaagcttcatctccaggcttcatgatgttgctttctcttcctgctattcattttttccactcctttgtttaccttttccctgtgctttgacattacagtggctttatatcatcgaggatctctgacctggccccgttttatgggggatagtggcaataacatgtgtaataatttacaatctttctctgaagattgcacaggccccatgttctttaaaaaacacacttctgacctaatgctgactgatagaactttctcagatgatggaaattttctgtatttgtgctgaccaatatggtagccgtatgtggttcctgaacagacttgaaatgtggcatgattgaggaactgaaattttgattttatttaattctaattaatttataattagtcacatatggctagtggctaccacactggacaacaccactctaaatatctgtagtttgccaacatgtgaagaagagaagtgggttaagataagcccatttaaacattttaacttttggctgagagattgttggattatatacccaaactatattttgggtgaaaaagaattttttggtcaaatacatttgagaaaaactgtgtactgtagccttctacatatgtaacatgaattggcaaactggcattttaaaagttttgaaaaccctacagaaaataaactggtttaactttgtttaatccaggcttttgcacatagtttgactgatatcttttttgtcctctgaacatctttattgttacagtggtatgcaggaggcatgcctctggtattaatctgagtttaaatcatggctctaacacttactgtgtgagcctgaacaaattgctttaccctctctcaactgcacttttcctgtctataaaatggggttgtggtatttcatttataaggaacttgtgtggattaaatagggcattgtgtgaaagtacttacagcagtgcctggctcattgtaggcacttacttaaaaccggcctttattattttattatgcatggtccctaaaacaactctaagattaataaggagagtgggcagattcttgttacttacaaagctatgtccttccttcgcttatcctcatatttttggaaactattttaactgttttttttttttagataattaatgattcacaggaaattgcaaacatagtcaagtccttaccttttaccagtttccctcagtggctacatcttacataactattgtataatatcaacaccaggaaattgacattggtacaatgtatatgtagttatatgctattttatcatatgtagattagtgtaaccaccactacaatcaagatacagaactgttccaccaccacaaaccctttacagccttaggcactccctctgtctctctactgtccctgtcctctggcagccactaacctgttttgtcattttgagactattatataagttgaatcatacagtatgtgatctttggagattgccctttttcactcagtgtgatgtccctgagatccatccctctttttcattgccgaatagtgttccatggtatggatgtaccatggttcacctattgaatcattcccgtataagaaaggacattttgattatttctagtttttggctattatagatagagcttctatgaaaattggtgttcaggtttttgtgtgcatgtaacttttcatttctttggtcgtatggtaaatacaattagccctctgtatccatgggttccacatcaatggattcagccaacctgggattgaaaatattttcaaaaaaacattgtctgtactggacttgtgcagactttttttttcttgtcactgttccctaaacaatacagtataacaattatttatatagcatgtacattgtattaggtataaataatctggagatgatttaaaatataggggaggatgtgcataggttataagcaattattatgccattttatatgaaggacttgatcatcttggattttgttgccctgggaggctctggaaccaatcctccatggataccaaggatgactatatatatttattttgtttgtttgttttttaagatactgccaaagtattttctggagtgtcggtaccattttacattcctgtcagcggtgtaagagaaatccattttctccacattcttgccagtatctggtattgtcactatttttattttagcaattttaatagacgtgtggtgatacatcatcatgatcttaatttgcatttcccaaatggctagtgataatacacatcttttcatatcatcatttgctgtctatatatcctggtcagtaaaatgtctctttataccttttgcctattttctaattgaattttgtgtgtgt

SEQ ID NO: 10740 - DNA, 59933 bp, Homo sapiens
  misc_feature (1)...(59933): n = A,T,C or G, or insertion/deletion polymorphism (see Tables 1-2)
tgtgtcatcttcacaaaatgtttaactaaaatttctggatctgtcttttttgccataaaattttgtttggatttcattaactctgaggtttaaaaagttataatttaggctgggaggggtggctcacatctgtaatcccagcacttttggaggctgaggcgggcggatcatgaggtcaagagatcgagaccatcttggccaacatggtgaaaccctgtctctactaaaaatacaaaaattagctgggcatggtggtacatgcctctaatcccagctactcaggaggcagaggcaggagaatcgcttgaaccagggagtcggaggttgcagtgagctgagattgcgccactgcactccatcccggcaacagagcgagactccatctcaaaaaaaaaagttataatttaaaaaataagttatgatttatatgaaatcatttagctaaaacattcacacagaatattgtaaaaactatgaaaaaagcaagccaggtggttcatgcctataatcccagcactttgggaggttgaggtgggagggtcccttgagcccaggagttgaagaccagtctgggcaacatagcaagaccatctcatttaaaaaaaaaaaaggaaaaaagaaaaagaaaaaagctcccaactttacctggaacataaatgttctctgcttccttctttactctaaatcagtgatacaacttgagtactctaggcctacctagcttaacaacagtctacataatctaatatgaggataaaatattagagagctgcctccatgttgcttcctctcaaatatgcctagatttgaacatttttcctacttaaaaagcagcattttcatgcctgtaattccagcactttgggaggctgaggagggaggattacttggggccagaagtttgagaccagcctaagcaacacagtgagactctgtctctacaaaaaaatgttttttttttagaactagccaggcatggtggcatgtgcctgtagtcccagctactcaggaggctgaggtgggaggatcacttgagcccaggaggttgaggctgcagtgagccgtgatcatgccactgcactctagcctgggcgacagtacaagactctgtcttggaaaaaaaaccccaaaaatcagcacttacttttttaaggcaatatcaatttaagtgcatgttactcaaaaaagtacttaaatctgaatgaaaaaatttatgattcaggtttattttccctgaattggcccacatgcaaaaaaaggtagctcgaaactgttttaagctactgagaattgaccagtgaaagagatcaaatatatgcattcctaaaattttaggtactcaatactaacatatgtccttatctctattcctagtccacttgggttacaatcaagtgatctgtactgacaggatgattctgactattgtgtgtgaaactatttaaccaaaagtattccttccatcttctttcttgccactcggaagagtaaaatgtacatcaactaggctgtgtgtcccctccaccaatttttttttatcatcaccattaacaaatttgaatgtgcttttttttcttgaatcttctttccccttccctactctccttctcttccagttctggcatagttttctaggttggtaattttttcttttttaaattgagatggagtcttgctctgtcacccaggctggagtgcagtggcacgatctcagctcactgtaacctcagcctcctgggttcaagcgattctcctgcctcagcctcccctgtagctggcattacaggcacccgccaccatgcccagctaatttttgtatttttagtagagacagggtttcatcatgttggccaggctggtcttgaactcctgacctcaggtgatccactcacctcagcctcccaaagtactgggattacaggtgtgagccaccacgcctggcttctgggttgaaatttaagcaacatttgagtagttaccataggcttgaattcctggccccaagctatcctccatactcacctccaaaagtgctcggattataggtttgagccaccatgactggcctgaggaacatttgagtacttactatgtgccaggcattgtgctggatgctgtttttttttttcaattctttttttttttcccctctgcagccttgacctccctgggctcaaatgatttgcccacctcagcctcctgagtatctgggaccagaggtgcaagccaccatgcccggctaatttttttgtgtttttttgtagagacaaggtttcactatgttgcccaggctggtcttgaactcctcggctcaagcgatccacctgccttggcctcccaaagtgtgggattattcaaaggcatgagccactgcaccctgccccattcgctttttacacaaatatctcatttgatccttacatcagttttttaaggtagataatacaatttgtatgatgatgaaattaaaggtttaggtatatctttgagtttttcattttattattcccctatacttcaaacatttcatttcttactttaagtccctaaagttgctaagtgtaagataacttaaaaatacactgccattaggcctggctcagtggctcacacctgtaatccccagactttggaaggccaaggtgggtggatcacttgaggtcaggagtttgagaccagcctggccaacagggtgaaaccccatctctactaaaaatacaaaaattacccaggcatgttggctggcgcctgtaatcccagctactcaggaggctgaggcaggagaatcgcttgaacccgggaggcggaggttgcagtgggccgagatcgcgccactgcactccagcctgggcgacagagcaagactctgtctcagacaaaaaacaaacaaacaaaaagacactaccatcaaaaagaaaagtcataaagtcacatgttgctgaaatgataaagaaccaacatcatcaacatgcacatcttttgaaagcatccagaaatagccttcattagttgtgaaaaattttctcatcctccttctttggggtggggtagggggaacaagtttgaagaagaaagataaataataatgtttacttacctacttagtttttcaggattgtttattttttctaagattttcaaacataatctcttggtaaattgaaggatttctggaccgacatagaggtataactagatgtaatacaataatgttataagtaacggtgctatatttttgtgaaattaaaatttcctgacttcatttaatgggatggagtggatgacaaaaagtcatagacaaatgatattatatactaaattatcaaagcctatatataaccagggtcctacattctattattaccattattaaatttgtaagtgctcttcaaatttaaagtgttattagtattctgttatcatttaagctttagattactanaatccctttataatctattactaaactggtcaagatgctgcctaacatttaaaaaaagaccatgtatttgcatatattataatatactctaaaatccaagtattcatttctatacttaaaacatctttcttttcattcaactttatttttgttcccaggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttytacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatmtagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactgacttcattgcagtagtgtttaggtaatacttctccagaaactagtgaaatcaaaccacagtaattttatctgctgagtatatatcattgtaatcaattacttccaaatgtctttatcaataaacaaatatactaaaagaattctaggtaaccatgagttacttagggcaccatgagtgcatctgtagacccagctactcattccttgagcccaggagttggaggccagcctggtcaacagagcgagaccttgtctcttttttttaagagtcagggtctagatctgtcacccaggccagagtgcagtggngcgaccactcctcccaccttagcctcacgagtacctgggactacaggcgcgtgtcacgacacccagataatttaaaaaatacttttgtagggacagaggctcactatgttaccaacgctgatctggaactcctggcctcatgcaatcctcccgcctcggcctcccaaagctctgggattaccggcctgagacaccgagccccgccccgcccgtctctaaataaatacttaaaagaaccccaggtaaaagctaaagcgaggatgaaattctaaatgaatttctgagcaacaactatccgtagtgagcagtgatgatttttggtgtgttctccggtaggcacacttttcaaatttatgcaatcttatccttaagatttgaaaaaaaaaaacttataaaaaatcttaaacgtggttttccatctacaatttttcgcaactgtagggatatattcaaaataaatgctggacatttccaggcattagaggggatgtggccggatggcgaggaggggccgtcctcaccaggactccaagcagttctcgcacctgacttcgtaggcctgtagttgtaaccatagcaatgccccagatgcttgaaaacatttctgaattgcggccctatcatatttttacagcaaaaccacccttattttacatattactaaatcctcttttcaccttcatttcatccctcgtcaaagttaaaaggatgaagattcttttatctcacaaaggttatgagagaaatattaaatttaaaatcactgtggagaccacctcctccgtgtaaaatgaggaagggtcacaggaagatgataatgggaacgcgccgccagactctgaaagccattaacattgtttcggccgttagggcggttggcggcaactyaccgcccagcggcggttgcgtcgcagccagaagcgtgacttcgcgcacgctccctttccactcctccactcagagccggggacgcggcgggggcgcggcggaactacagctcccatgacgctttgcgcggcatagggtgctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgmtgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccnacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagaggtgagagcaggcaaactgcccggcttgggttctaggtctctctcagttccgatatcccgcatctttaggactgaaagacgccaaacccctgcttaccttctgctgctgtacttctctaagctcactggggtggaccctggatttcagatcgttgacacggtttgatctaactacttgaggcttctcgctccgaggccgagctgtcagttgctaatccctttaccggtcccccggagcctctcagcatttgttttcaaattctgcaaggtttccgcgccgcgttagattagtaggtggggtactaaaaaatgcctttccaaagaaaaggcatgttcctaaaatcccttctccttgttttgcttgctggagagctttagttatctgctctcccttgctccagaatagtcaggggtatggttccagtctttcaggagggaattcatataaaggttacacgactcactggttgacttagcttctgcaaggtaaaatatcagacgcagtttatcttggttctttttaatctagaggtaaaaatcattttaaagttttcatattagctatttaaattcttagaataggcatgtggaaggttttctctaccctttgatactaggaaataggaccaacagtgcctctgaaaagtgggaatttgtgcagtagatagtagaggccggaatttcagttgcatttgattctgtctagcacactttgtggatctgttaattccaatagccctcaagaatattttactagaaaatgtcagagtatccaattaaatgtggattctagaaaaattagattggccagaactgatgtcttcctgttcccaagtacctgtagcatttatttatattctttgtggaagaaatgtgatgcttttgattatgccgtatgtttgtactttatatattattttatataatttactagttgtttttcctcaggaatatttgaaatacttgtttcttagtactggaccagttaggttattacatgttaatgagacaatctttcaacctaaagttttgtgagtcttgcattctttccacgtattgagtcttaaggctaatcattttttttggtggtgctatttccgaatactgtagttcgttgcaaataattgctcaataagtatttattgaatagcattaaatttttattcatttggtggcatccaaatcttgggagtagaacttgtggcaagatgacaggactgccagttttcaccaccaatatgcaatgatcttgctctctttttatttttacttttattccctactttctcatttcttgtgtgtgtgtgtgtgtgtgtgtgtgtgtkttttaactgtacagaactagagggaattagtgatcctctggcttaaatttgtattgtagaaaaggaaactgaggcccaaagtagtaaagaggcctgttcaatcaaatcacagttaattcgcatgaagtgcaaaaaaattaaatattttttaaaaaggtgaatattggcataacaggcagtagaacccaggctcctgaatcctgcttcaagcttcatctccaggcttcatgatgttgctttctcttcctgctattcattttttccactcctttgtttaccttttccctgtgctttgacattacagtggctttatatcatcgaggatctctgacctggccccgttttatgggggatagtggcaataacatgtgtaataatttacaatctttctctgaagattgcacaggccccatgttctttaaaaaacacacttctgacctaatgctgactgatagaactttctcagatgatggaaattttctgtatttgtgctgaccaatatggtagccgtatgtggttcctgaacagacttgaaatgtggcatgattgaggaactgaaattttgattttatttaattctaattaatttataattagtcacatatggctagtggctaccacactggacaacaccactctaaatatctgtagtttgccaacatgtgaagaagagaagtgggttaagataagcccatttaaacattttaacttttggctgagagattgttggattatatacccaaactatattttgggtgaaaaagaattttttggtcaaatacatttgagaaaaactgtgtactgtagccttctacatatgtaacatgaattggcaaactggcattttaaaagttttgaaaaccctacagaaaataaactggtttaactttgtttaatccaggcttttgcacatagtttgactgatatcttttttgtcctctgaacatctttattgttacagtggtatgcaggaggcatgcctctggtattaatctgagtttaaatcatggctctaacacttactgtgtgagcctgaacaaattgctttaccctctctcaactgcacttttcctgtctataaaatggggttgtggtatttcatttataaggaacttgtgtggattaaatagggcattgtgtgaaagtacttacagcagtgcctggctcattgtaggcacttacttaaaaccggcctttattattttattatgcatggtccctaaaacaactctaagattaataaggagagtgggcagattcttgttacttacaaagctatgtccttccttcgcttatcctcatatttttggaaactattttaactgttttttttttttagataattaatgattcacaggaaattgcaaacatagtcaagtccttaccttttaccagtttccctcagtggctacatcttacataactattgtataatatcaacaccaggaaattgacattggtacaatgtatatgtagttatatgctattttatcatatgtagattagtgtaaccaccactacaatcaagatacagaactgttccaccaccacaaaccctttacagccttaggcactccctctgtctctctactgtccctgtcctctggcagccactaacctgttttgtcattttgagactattatataagttgaatcatacagtatgtgatctttggagattgccctttttcactcagtgtgatgtccctgagatccatccctctttttcattgccgaatagtgttccatggtatggatgtaccatggttcacctattgaatcattcccgtataagaaaggacattttgattatttctagtttttggctattatagatagagcttctatgaaaattggtgttcaggtttttgtgtgcatgtaacttttcatttctttggtcgtatggtaaatacaattagccctctgtatccatgggttccacatcaatggattcagccaacctgggattgaaaatattttcaaaaaaacattgtctgtactggacttgtgcagactttttttttcttgtcactgttccctaaacaatacagtataacaattatttatatagcatgtacattgtattaggtataaataatctggagatgatttaaaatataggggaggatgtgcataggttataagcaattattatgccattttatatgaaggacttgatcatcttggattttgttgccctgggaggctctggaaccaatcctccatggataccaaggatgactatatatatttattttgtttgtttgttttttaagatactgccaaagtattttctggagtgtcggtaccattttacattcctgtcagcggtgtaagagaaatccattttctccacattcttgccagtatctggtattgtcactatttttattttagcaattttaatagacgtgtggtgatacatcatcatgatcttaatttgcatttcccaaatggctagtgataatacacatcttttcatatcatcatttgctgtctatatatcctggtcagtaaartgtctctttataccttttgcctattttctaattgaattttgtgtgtgtgtgtgtgtgtgtgtgtgtatacatatacatatatatatatatataatttttttttttgagacagaatttcactcttgttgcccaggctggagagcaatggtgcaatctcggctcactgcaacctctgcctcccgggttcaagcgattctcctgcctcagcctcccgaatcgctgggattacaggtgcctgccaccacacccagctacttttttatatttttagtagagacggggtttcactgtgttggccaggctgttctcgaactcctgacctcaggtgatccacccgcctcagcctcccaaagtgctgggatttcaggcgtgagccactgcgcccggcccttgaattgtatattttttattactgggttttgataattttttgtagatcacaggtgcagcttctttgtatggtttgcacatattttctcccaatctgttgcttgtctttccatcctttttgtttgtttgcttgtttttattttggttgtttttttttttttttgagatggattctcactttgtcacccaggctggagtgtagtagcacgatcctggctcactgcaacctccacctcttgggttcaggcgattctcctatgtcagcctcccgagtagctgtgattacaggcatctgccaccatgcccggctaatttttgtgtttttcagtagagacggggtttcgccatattggtcaggctggtcttgaactcctgacctcaggtgatccgcccgccttggtctcccaaagtgctgggattacaggcatgagccaccacgcccagcctgtttgtttttgtttttttggggagggtctcactcagttacccaggctgcagcacagtgatgtgatcatggctcactctagcctcaacctctggggctcaagtgatcctcccacctcaacctcctgagtagctgagaccacacgtgtgcaccaccacacctggctaatgttttttttttttttttttttttgatagaggcagggtctctctgtgttgtccaggctggtctcaaactcctgggcttaagtgatcctcccgccttggcctaccaaagtgttgggattacagacaggagccactgtgcctggtcctttctaccttctcagtgggatacttcacagagcaaaaattttaaattttgttgatatccaatttactaagtttttttttttctttaatggatcatgtttttggcatcatatctaacataccaagtcctagatcccaaagattttctcctttgttttcttctaaaagttttataattttaacttttgtattttaatctgtcatccatttgagttaattttgtacaggtgtgaggtttaggtcgccattttttttcttcttgcctaaggatatccagttgctctagcaccttttgttgaaaagattaatcttccattgaattgcttttgcacttttttcaaaaatcagtacaacctgtaatgtaacaatgattttttttttttttttgagacagagtctygctctgtgccaggctggagtgcagtggtgtgatctcagctcagtgcaacctccacctcctgggttcatgggaatcttatgcctcagcctcctgagtagctgggattacaggcgcccaccaccacacccagctaattttgtatttttagtagagatggggtttcaccatgttggccagactggtctcaaactcctgacctcaggtgatgtgcctcccacaagtgctgggattacaggcatgagccactgtgcctggcctaacaatggtttttacaatttaaaatagttggaacgaccttgtagcgcatggaaatcatacgaaatttaaactgtgtccagaaataaagctttattggaatatagctctgttcattcatatatattgtctatggtagtttttgcactacagnagcagaatacagtaattgagacagagaccataagacctgcaaagcctgctgttcggctctttagagaagtttgccacccttgagttcacttaagagacatgttccttcctgcacagcagttcaacagtatttaatctgaattcatgtggagactaattacaaattattacaatctcagacatttggagttgttcataaacagttgaaacaaaaatttaatctgtaaatgctagggtaaacttgttcatctttaaaacagaaagaagtgattttcagagagatgaagtgaaatgcttaaaattttttagttggtgatagagctgaatacagaactcaatttttttccctcatggcccagttgacctctctttctgctrtgcacactggggttgattatttaacagagatatttaaatgctgtttttatttcttatagggaataagcttgagtgtaactaaactggaggttacctatgtgttttgaaatcttaatttttttctctccctcttattgctcataaaaacataggacaggccgggcgcggtggctcatgcctgtattcccagaccaaggtgggcaaatcacgaggtcgggagtttgacaccagcctagtcaacatggtgaaaccctgtctctacgaaaaatacaaaaaattagctgggctacttgggaggctgaggcaggagaatcacttgaacctggaaggcggaggttgcactgagctgagattgcgccacttgcattccagcctggtcgacagagtcagactccgtttcaaaaaaaaaaataggacaaacatacttccttaaaaatccatgaaaagaagtaatgcttctttttaattattcttagtaaattcatgattttaatatgttgttaaaaaggaaagaaaggaaggacagcccccataggctgtcttctccaatgtcattacatgaccggattgctcatatgtatgctcttgtgagtcatctttcttatctcattttttttttttttttttactcttgaccagttgcctaactgctatcaccgagtgtaagtgttcctgagccagatgtttaatggaaattttctctcatgtcaaaaagcagggattttaagtccagaaacacttctttttgatgttagcaatggagaattattgggattataagggaattgaaataaacaatcttatttatcagaacaacaactgtagggactaatatttttccctgctcaccctgagagaggcaaaaacacctttaagggcacgaaaacttttgaaatggcactaagtaagatatttgttgaagtaatactccctttattccaagctacctcaggtccattaattgtaaccagataatcttagttgatcatctaatgggagtgttgcagggagatgtctgatagtggaggcggaaaggaagagagtgtagggtgcagtatgttagaagaatttgttttggagtcagataggtgagaagtttgaatcttggctgttgtgtactagctttgtgacctaatataaattacatatcttgtttcaggctgtttctttctccgtacttcattggtttgaggattaaaataaaataacatatatggtccctattagacatttggcaaatacgttttctttcytctttcagagatctttcttatgtgtttctcttgataatcaagatgataagagacttattgtgtgtcacatattgtgatgagggccttatagtcattgtctcatttaattcttaaaataactctgtgagatagactctagaattaataactttttkttttttctgagacggggttgcccaggctggagtgtagtgaagtgattatagctcactgtaacctcgaactcctgggctcaagcgatcctcccacctcagcctgtagctaagcctagctcactcctgcagctaggactacaggcatgcaccgccaagcccagctaactttttttttttttttttttttgtaaaaatggggtcctgctgtgttgctcaggctggtcttgaattcctggactctagcagtcttcctgcctcagtctcccaaagtgctgggattacaggcatgaggcactgtacctggcctattataacattttaagatgagaaaatttagatttaaagagatttatgagcttacccagagaccttagtaaacaataagagctgggacattgacttaggtctatctaacagtacagcacctgttcttatcttaaatagtacactctactgcctctagaattcaactgtttttggcaataatagtagttatgatgtattgagtatttattatgttctaggactattataagtacttcacatgcgtttttcatttactctgcacamtaattttataatgagatactgttctttcctccggttttaccaatgagaagcagtgcaaagaattaacttgcaaaaagatatgctatctcattcattattgttgggaatacaaaatgatacagccactttggaagacagtttggcagtttcttaacaaaactaaacatactatacgatccagcagtcatactctttgatatttaccccgaggagctgaaaatttgtgtccacacaaaaacctgtagataggtgttcataataggtttattcatagttaccaaaacttggaagcaatcaaaatgtccttcagtaggtaaatggataaactgtggtacatccagacagtagaatattattcagtgctaaaaagaaatgagctatcaagccataaaaagacatggaggaaccttaaatgcatattaccaagtgraagaagccatcctgaaaaggctgcacattttatgattccaattatatgacactctggaaaaggcaaaactatcaagaaagttaaaagatcagtggttgctaggggttttagagagggttgcatgaataggcagagcacagagcattttataggacagtgaaactactctttatgcaacttaattaatggtggatacatgtcatacatttatccaaaccctcagaatgtacaacaagagtgaacctgaatgtaaaccatggactgcgggcaggcgaataatgatgcatcaatgtagacttatcagttgtaacaagtattccactctggctggrggtgatgataatcagggagacagactatgcatttgtgggagccaggtgtggttatagttctaggaacctgaaactgctctaaaaaaaaaaaagtaaaggcttagggaaaaaaaagttctagaaagtatacttctagaaagtatactagaaagttatagaacagggatttaaacctagacagcgctcttaaaacaccataatatagagagatggtgggtaaagtaaggcagtgttaaaaacatacaatgattcacaaatgtttggctttcaaaatgagtagttttttgtttttcctttttagtcaggtatttatatagaactggaagaactctcaagaagactgaaaataatttattttcaggaaacaactttagtcctttaaaaaatcatgaataataagatgtaagcaattacacttgttttgcttttgttcatctactgtgatttttacgaactgaagatactaccttttttttttttttccgacttctaagccataattagagtataagaattgctgttaagaccttaagttttgtaggccgggcatggtggcttatgcctgtaatcccagcactttgggaggccgaggcggatagatcacttgaggtcaggagtttgagaccagcctggccaacatagtgaaaccctgtctctaccaaaaaatacaagaattagctgggcatggtgatgtgcacctgcagtcccagctacttgggaggctgaggtgggagaatcacttgaacttgggaggcagaggttgcagtgagccgagattgcgccactgccctccagcctggatgagagtaaaaccctatcaaaaaaaaaaaaagaacttaataatatagaaagctgtttttttgcattaatgaaaactttcaattgtgtgaaatcagatgacattaattgataatattggtagtattagcacatatgaggatcttattaataacgtcatgtattaatagttacctttttaaagacagccagcaatttgtttcttaagtgaatgtatcttcctctgtagaattatgtatttctctttatatgtaatcacacagttggataggtgaaagtttttcttaatcacaggtatagtgtaggttggctctttttctgtaaagaactgtagtcaataaattttagcttttgcactatggggaaatactaaaaatgtgctgaatagattctctgttggaaagctaaaaccagaaatagaaaagttgtgaagaagactttggacactgactttcaaataacgttttaaattcaaggcagggcaattgttatttttctcataaagcaacagtggccagtgtttgataataacctttnataacttgtttatacatatgccattctcaattagttgccaccacggtaattcaataataaattttgtttactcatggagatttgttagccagtatgaaatgggtagtcttaaatttctctgtaaaaaaagtcaagctttctgtatcttaccctaagttagataaaagtcaaaagctgaggccgggcgtcgtggctcacgcttgtaatcccagcactttgggaggctgaggtgggtggatcacttgaggtcaggagtttgagaccagcctggccaacatggtgaaaccctgtctctactaaaaatacaaaaaattagccgggtgtggtggtacatgcctgtgatcccagctactcagaaggccgagaggcaggagactctctggaacctgggaggtggaggctggagtgagcagagatcacgccactgcactccatcctgggcaacagagagagactctgtctcaaaaaaaaaaaaaattgaaaaacaggattagtgagaagatagattgaaatttacttcatatttaaaatttttatcatgttgatttatgagattacaatgtaagattcttttctttatacagtggttttctctttttttgttttttttgttgtttttttttgagatgggccatgttggactaattgaatggttttcatataagtgaattttgtgaaactcgtataagtgaaacccacagagacttgaccaagttagaaataccactggaaagttgatagtaatatagaaaatgtgttacaatcaacgcagttctttcttggtgctaatttcagtggcagatctaggtcacaattcattttctgcataccaaatacctcttccgaagcttaaaataacaagatctatttggagatattttcttttcttgttttcctgtgaaattgctaaaacattaatagaagagagtaattagatgactatttttaaattggtctaacctttatattgaatggcattaacatttagttgcttgggagaattgcctaaattactgatttgatattggggaaagtatttagatgaattttatttggtaagaagtatacttcttaccaaataaatgactattactaagtgtttaattctcaaatatctcaaatatttagttgtatatagaataaaagatgactttttctcttgccaggttaacagtattctgattaaatgtaaattttgctatcttattacagtttaattacaagtgatatttgcaaataaacggttttcattttattgttcttagaaggaaatattatttggcattagtaaagtctttgacttgcttttttaagtattttctttagaaggtttcgtaacccttgtagtagctaattgacttgaagtgattttatatggagtattggaactgtcatatatttacatattgtaccaagtaaattcttaactctaaaatttgttgaacttgtttttctagatgtaaaaataggattaattggaatatttgtcttaactccaaattacttcaattatgttagaaaaaacgattgtttggtgggtaaattctatgcagtaaatactagaccaaacttgaaggttcgtcaggactctacctggtatttaatcctgaaagtttcctgctaggtatattttccaattagtaaacaaaagatgccattccatcttgggcttgtcaatccatgataatcctttaaaacttaaaaataagtttttaaattataaaagtaatatgtttattttagaaaattagaaaatacagataagcagaaaagctagacatttagaattctaccaccaatagataactaccattaatagcttggtatatatttctccagatatttttctgtgtgtgtgtgtgtgtgtgtgtgtgtgtgtgtgtgtgtgtaaagcatctatagatcagacagacttcttcatctctttaggtccttttcttctttctgggaatattttctcctagacctttacatgcctggcttgtcttattctttaggaatcactcttaatgttacctccccaaaagagcttcccccaaacttaatgcatcccacttatcactatctggtactttctttttcttgtacaattagatcataagacccaagagatgccaggcaccatgggtcacacctgtaatcccagaacttagggaggtagaggcaggagtatagcttgagccctgcctgggcaacatatggagactccatactcctcaaaaagcggggagaaaaagatccaagagattggggattgtgtatgtcctagtcagcattatggtcctagcacttagtaggtacttaaatgtttggatgaattaatgtttatataaaaatgggatcagaatgtacatgtgttaagtgctcaggagagaaaggtaaggtatacatcactgaacttagattgctgacagtctaggggagggtgtaaaatgaaatgttaataacacagagtataagtgctgagatggggatacaaagcttaagggagcccatagcaggagtagctatccagattgggtggggaagaaaaggctttctgaaagaatgagtctaagcattttgtaaccttctaatttttatgtcagttttttcatctataatatactttacaatggctgagtagtgttttataatatgtaactaccagagtttaatcagtcccctgttattagacatttaggagcattccctgttgtgtcgttttaaataatactgtaatggatatctttatataatcttcarttattttcttagataacttttacttggaagtggaatttctgggtctgaggattagaaatattttttaagacttttaacatgtatcatgaaattgcccttcagaaagttgtaccagtttatacttccagcagtagtagttgagaatgaccagaaaccgcagactttgccaacttgataggaaaaaatgatatctcatggcttactttgcctttgttgatttacctgtatgtatcatagtaattcataggctgacagcaaaatatgcctagcttaaatttaaattttatgatgataactgaacaaaagaatctatgttgttacatagatttcagaatcatcatatttagctatcgtataatgtttcataccattgctatatcatgatttatttaaccattctctgttttttggatgtgtgaattatttctgatttttctccattatcagtaatatactgctttgaaaaatggataccttcaattttattcttttcttcaatccagaatattattatatttaagatctctgtctcatttgttttctaaacacgtaagttgtaatagcaaattcagagaaattgaggataggctatttaatgagatcaagtaccttaagaagcttgtatgttgacactagtcctagcaactaacttctttttaattattgtggccagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtaagataaaaattgttgttaaaaattatttagtaaatacgattctaaacagaattaacctctttctgtcgcacagcacataccagcacatttttgataacaaatttatggtaataaaggtgcttcaaattgtttgtctcttcctctaattgaaaaatcttaattactgagttcgggtggggcttcttctttactggagggaatgctttatacatgttatacatcattacaaatcttyatggaaaactagcttgaaaacttacctggtctttcacaaatcgggtaatgttagtatggaggatgtgattgagatctgttagtctcaggataactttagttaagatttgcttttatatcataataaaacacgtgagggcatgggcctgtttatatgccaggtttttggagtttttatatctctttcagtaacttgttggcagtccatcccagaaatataccccatttatgtgacttggaagtgtcattaggaagaccgccatagcctctgctccttctgcctatacattgttgtaggtgaagacattttttgaagccttgcatgggcagctaggcttaagtcagcagggaaacgtctgcttcttaaccagtggttttaaccaaacatttttttcagtgaagttattttagggaataagaagttaataatgtgtcctagtttttttcttacttgcttttctcgtaagaattgaatataaatggtcagctataagtttctgcagtatatattataaattcaactttagtggagactttcactttttaaacttttatgattatatgttctgttttttcaggttgtctagtaatttgctgccattcttttcccttaatatatatatatttttttaggtaaatagattgttgccgtaataagactctcagctgcctgaattatagtggtttcaagccacttagatttatttgaaacctcctctaacttgaatctttttagtgagtcttaccatctttgcctccaatgaggggagtatccagtttagatttatgagcttcagaatttctctaattgaagttctctctgcagtagagagagcaggagcagccaatgtggagaggtcgcaagatggggctgcccaagatgttggaacaccatgtgcaataaagggcttcgtcttggattttggccttattaccacaaccaggtaccgaagtgctgacttttgtagtagattttcttttttcattttcattttttttttaagttttgccctttgaaggtcaaggaatcctatttttataaatattgcagatgagacygaaaacatttctcctaatatagtccataatccccataagttccctatttaacaaggaaagatattgctgagagcagaatcaacatgctctatcatttttttagtttagaaaaatgcagcaaattttctcttttgatagaccaacaagcatttctgagaaataagccagaaatttgggggaaaactgtcccagttttgtaagggtgtctttttaacattcatattagttaaagtggatcaaatttgtatgtcaacagacagtatccagtctaaatagttaataaaagaaaatatcttgaaatattccctgctgatttttgtcctccaattaattttttaaaatggagctgaaatttaaatgactgtaccaacaacttaccttgatacttactttgagatttaaaaaataaccactttttaagaacatttcagattatgattaaattagatattaaacncttcaaccacataagaatattgaggactgttgaatgagtcctgtgctctggtggtcctggaacttaattttatttatgaattttcagtcattagagaagagtatggtgtggatatgggaggttggattagccgactaaactttgaagtttgcaactttagcagatgttgggatagaagttaacacagtagttcaaattgatttcgcacttcatggtttatagaaatgctttcacattcatatctgaatatttgaaacaacctagtgggtaggtaggtaagcaattttatctgtgtttcccatggaagaaactgaggctgggagatgttcattgtttgttatccaaggtcatatagctagtaagtagaagagtccagatgcaaacccaggccacctgaacaatgttcacatcattttaccatggagaagagattagtgcttttatttgtctaacactctggtcagtgaaattaaagtatctccgtgtgaaacagcatgcaaaaggctttgtttctaatatttttaacaaatccctttagatcgttgggaattaaacaaatacctagggcagtgtggacttacctgaagtcttttgacattttatgaagttctgttaaacctagaaataaagtcaaataaattttttattgctttagagacatagttattggaagttatttatagtttaaatatgtagccataataattattcgtgactatatttcaagatagtttattcagcaagcacttactgagaacctaccatgtactgggcactgtgttcttaaaaggactaattgatgagctcagtctagtgggggagatgagtaaaccagcaattataatacagagtactacttgagtagaggtacgcatagggaaaaccctgtaatagagggagcactgtctgtgttacctaatgcagacttgaggtaattcgaaaaggcatgttaagccatgtgatgcttgagtacaatcttgaaagcatgttaatacttaacttggtaagaacattttaagcgaataacagcctatgcaaatacacagaggcatttgagaatgcggcacttagagggagctacaaatagattgacatggcaagagtatgcactgactgttaagggatggaaggagttgagaccagagagagagagacatgattaggattgtgaagagccttagatgacatgcttttaaaaagttagtactttttcctaaagataattgggagtcattggtgaattttaatagggaaatgcttgctatccatttatgtttgcaaagattacataatagtgtggaggatggaattggtggtgcaggatatgagattggaagcaagaataccagttagttacgatagtaaccatgtcataaatgctccacgtccaaactggtactgacattagagagaaaagaaagaaatttgagaaataattagaaggttgagatttaactagtcttggtgagagagagagatagtcttcagatgtggtttggacaaatgggtggatggcgatgctggtcaaagccaatacatggttgaaaaagccggtttctgtggctagagggtgttgatgagctcagtttgagatattttgagttgaaggtacctgtgggaatttacggttagaaataactgttaggaggctgggcatggtgtctcacatctgtaatcccagcagtttggaggctgaggtgaacagattgcttgagatcaggaattttgagaccagcctggtcaaagtggtgaaaccccatgtctactaaaaattcaaaaattagctgacatggtggcgggcgcctgtaatcccagctgcttgggatgctggcttgaacctgggaggtggagtttgcactgagccaagatcacgtcactcactccagcctgggcgacagagcaagtctcaataaagaaaaaaagaaaaaaaaaaaaagaactcttaggaattgaatgtatggatccaagtttgagagatgtgtctaggttggagatgcagaagttgaacccattaatgcaggagatgcggagatgcagaagatggaaccagcaatagcagtggaaaagagatgaaactaagggtggaatcttgtgatgcatccacaagtaagtatgatgaacatgggaaaagaccaaaaagaaaggcaggcagaagaaagactagaagttttctgcattttaagaatgaagtgtttattttatccatatgaaggatccagtaagtaaggatgggaaagtggtaggtttatcaattaggaattgaattggagacatgatcaagattagtgctttgcaaaccgtggacaggtaaatactattgtaaattatgccttttctttagaaccttgctactaaaagtttgctctatgtatgaatttggcaccaccagggagcttgctaggagtgtagactgggctcttacccagattttctgaatcagaatctgcatttttaaaaggtgattcatatgcacattaaactttgagaagctttagaactcagctcctctaagcaggagaaagtaaaatgtagattttgtgcaagaaaaatgaaaacttctgttatttttatatttttaaattattgtggtggctaaagctaggatccacatatagggttttcttttaacattctagaaaactcaaatgttctaataccagagcagaaaaatttatatgtccattgaaacagtaagctgatccttgtttgattacttaactcttagcagttgatacaggataactttataaagttgagtttccttccttcctcccttccccttcccctcccttcccttcctttctttctcctttctttgatgaggtctcgctctgtggcccaggctgaagtgtgatcatgaagtgtgatcatggctcactgaggccttgaactcctaggctctagtagtctttctactgtttcttactccactgtaccccagtacataaacttcaggaagtggtggaactcaacttgttcttcgctttcaggtgctatttccagtgcctcagcctctagagtagctaggactacgggtgtgtactattacaattggctaatttaaaaatttttttatagagccagagtctcactatgtcgtctaggctagtcttgagcacctggtctcaacggattctcctgctytggcctcctagcatgttcggattacaggtgtgagcactagctttgcttatagtctgcattttctggtgatgctgatgttgctagtaaatggaccaccaaggccatataggtctcaaaatctgtacataaattgcaagcgcaaataataacaaacactaaaaatacagtgaagttaaaagggaattgttttcaatatcacctctgagatcttctggcaactaagtaattgaaggatgtacatggagaggagtgtgtgttatgtgtttgctgggggtagggaagattggcaaatctgcatgttttaagtatctttttcaaaaattttcatatataattttgaggtttcactgagaatcaaagctttttaactttaggtagttttatttcttatattacttttaktactctataaaatgataatgttctgtagcattggcgtgtataattttagtgtctacggttccagagaaaaacaaaaaatgttattccctcgttgtgtgttgggacaaggccttatatgggcttgttatatgcactctgatctttgattgattaacattttataatgaattggtaatactaataagaatagaactagtagagtagtatatagcttgggaaatagctcagaaacccttaaggaactgtatgcattattagtgtgttatagaaaaggagaaataaacattttaagtagcaggttttataaaataaaatggcataaataaaaatggtaggcttgattcttttttttttcctcttattttaagtactcactttgacccagtcacactgttttttcactatatattttaaagtaggaatgcctttctattcacaaggcacaaggttaggaagatcgctggctarttttttcctttctgtgttttaaaaagtcagcttgaataggcttcttcctgaaacgtgagttctgtggaataatccacacccgctctcaacccccatacacagggttttccacatagtgcttttttagcttggtgttctcctgagttattaacagatttataattgtcctttgtagaagctctatgtattggggacacagttgagcttacttaattcagaaattcatacaggataactgtgaagttgagtttctaatttaaacactacatatgtattgacagcagtatatatattcaaagataattgtttaacattttatagatattataaagagaataaattttatgcaaaactattattttttttaataggcatatttctctttgatgccacatccttctcccctccccactttgccttctgattttaccaaagactgtgtttttcctgttggcgttatgtctcctgcttccatggcagctttagttttttctgttctttggtctcgtacttacctccctccagtcctcccaattctgtttgttcctccactgtgctccagtacataaactccggaaagctgtagaattcaacttgttctttgttttcagttgctatttccaggccagagtttcccaaacttgccagatcctaagaataatttggggttgctagttcaaatatacattagactctcaggttcctcttctggaaattttggttcatgaggtctggagtgaggcatgaaataagtaccttgaccgacttgattcctatgatcaggcaagtttaagaaacactgttttaaaccatataccatctaccattactctagttcctttcatttgacctgtagatagcatctttttagaatttcagagcatcataaactaagagataatcttatctgacctctacaaagtgcaaattttaaaaaatcatgttttgattggccatcactggggactttgtctcttcatgacattttataatgcttcccattgggttgtcaacattgcctgggaagcctacttcttttctttgtttagcttgtttacctgttcttcataaatactatttaaactttatctgtatacatcttttcctcattctctcctgttacagtagagaagatattctatctcctcctcaaaggctaatttgtcaggctaatttgtctacttgtgttatgaataccatcccttagcctgctaaggtttttaaaaaactgttgtcaaatatacacaaaatttaccattttaaccattttaaagtgtataattctgtggcattgggtatatatattgttctattaccactaccgtttccagaactttttcctcataccaaacagaaactctatacccattaggttaggatctttgatgtcagttacccgctactacccctccaacctttcccttctccattcccactccccacgtaactaaaagtataaaatatattaagcgaatttctgcttcgtgtctttcccccgctttttttttctctaaataaacttttcctttctccctagaagtaaatctttattctgaatttgtggcttatcatgtcgttttatcttttaacattttactaataccaaatgaacataaaaacaatacttgtacctttgtattttaaaactacagtgtattgtgtgtatcattctgcaggttatttttgttcaacattgtttttgaagattattttgatacatctaactctacattaattttaaccattatatttggtattttgttgggcagctgtatcactgtttttgaacactttacttttcctctgctctcaaacaacagcaatcaacacagaagacttctttgcccaaatgtgggagatttctcccccacaacaagcaagcaatcagttcttcagcagacaccagctgggtgtcatccaattcaattccgacactacccagagtcagttttggatcccagatagagggctcagtccccaggactggcctctccttcccaccagtcacaagtccaggcctctggaacttctgaccaactggcttcaagttggggttcccacgatcccctctttgagttcagtggatttgctagagtagctcagagaactcagggaaatacttatgtttatgggtttagtgtgatggatatgttaaagggtgcaaataaacagccatatgaagagatacacagggcatggtctggaagggtcccgagcacaggagcttctttccccgtagagttggggtatgccaccctcccagcaaatgtatgagttcctgttgatcttcctgtctgcttccacatgttcagctatccagatgctctcagaacctcttcagtttttatgaagccttcattatgtaggcttgattgattaagccagtggccgttggtggtcagcttgacctttagcacccctccctggaggttgggggtagggctgaccgtccaaccctctaattgtacctttatttttcaggtgaccagccccgccctaaagctgttagtcaatattagcatacaaaaatagagctatttggagataacaaggagtttaggagccctacctcaggawatagggatgaagaccagatacatattgcacaatatcacactcactatttattctcctattcttggacattgaggttgtttacagttttataatattatggtgttacagtaagcatttgtgtaaatgtctttttttgggtcggggtgggggcaaggtagagggtcttcctgtgttttccaggttgatgtcaaactcctggccaagggatcttcctattttgataggtctttttatccacgcatgtatcctggggtttctatttgtcctttctcctgtctggcattccatgactcttgcctgaattcagtagctcaattctcacatctgaagaatttttctttaactgtaacatttgattgatgggtcatttttcttagctttataaaggcattgcttcagtgcctttaaacttacagtgttgctgttgagaaatccaatgccataatgattcctgattttttttagctgttctgcttttttctctctggaagctttcagaatttctactacagaatgtctgagtaccaaggataatgtgccttgagatggatcatttttctttaaaaaaaattactatgaaatatttcagacgcagatataaagaataataacaatcactctggcccaagaaataaaacatcatcagtgcagttgaaccctaccccccaccacccttttttatgtggaaatccatcctttatggagttttttcttgtattacttgttaattttctttctcagttatcgtttttttctgaaacttttattaattgtatattaggcctcccgattcaacctcaattttcttatctttcctattatatttttcattgtcttttttcctgctttctgggggtagatttaactagcttcttaatgttgattaatgtcagctgtaatgttttcagtttgagagcttgttcttgttctctgtcccttttttaataacttcctattgtttcatggatacaataccttttttcatctctctgatactaattatacttgtttttaagttttcttttatactcttaagttgttcaagttcttttttatttttattttagtcttctggttatgttttcatcaaacatggtgatctgttcatattgaaacatgagtcgttataaaacattagaaactcagtgaacacgtgggtgggatttgtcatttgaagactggatagggaatgtggtcatattgtgagaaaagctctaaatattagtgtttaaagatattgtttcttgggcctttagtttctacagctaaaaatctaccacatttttgtcaggggatggagtaggttacacacctgtctgctagaattcttggaaggaggtaggcgattgcattgttaaataactgggattttgcttaattccctgcttccagtgtaatggttctctcccttgcttgtgccttgtatccttgtgtctgtagtcrtttagttcacttttaccacaaataaggtgaggaaaaaggagcatgggataggaaggtagaatgtaagtggaagggtctcactgactcaagcagattttaaacccaccttttttgtttttagttgcatgctttgttcttgccttctataaaagttagccagagttctcagtttgcaaatttccctgtacatttttcaccttccaaaaacattttgatagcttgtatctgtagtttttacttctgttctctttgactatctgggattttagccttgatattttattctcacttgagtgggattttgacaaggaatagaaaaaaatcatacatccagtctaccatgtttaaacagcagtcctcttcaccttttcatctttatcagattcttcctattagtgttgaaacatgatcacacaaaagaggacttaaatggaaacatatattactgtgttcctggggaagaagaatcaatatcagaatgacaatttctcctaagttataaattgaacaccatcccaataaaatagaaatagttgttttttgagacaaccaagcagatattgaagtttatatgcaaaaataagtaggcaagaacagccagaaaagaaaaagtaacgatggaggagtgccttacctggtaccaatatattctaaagatttaattattaaatcagtgtaattagtttatgagctctgttcagcaagatagaaaatttagaaatagactacaggcactcaccaccacgcccggctaattttttgtatttttttagtagagatagggtttcaccatgttgcccaggctggtcttgaactcctggactcaagtgatccgcctgccttggcctcccaaagtgctgggattacaggtgtgtgccacagtacctggcccccaaacaatggcttaaaacaacgcaaatttagtttcttacagttctgaaggctctgagggaaaaaaatcaagtttttgccttttttagcttcttgtgtcttacatttcctagcttgtggccccttcctccatcttcaaagtatattaccccaggctatgcttctatcatcacatcgccttctcaaatatctctttgcctcagtctttaaaagacacgtgttattacatttaagcccacctggataatccaggagactctccccatctcaggatccttaatttattcacatctgcagagtccattttgccataaggtaacattcacagattctggggattaggttctaggggttaggttctttggaagccgtttttcaacctatcacatacttctggctcatcatgtccaaaacagtgaaacctgatcctcctccagaagagagagtagttgctctttcaggttccaaagtacagaacctggtagtcatctttcatacttctttctcttatctatcatatccaatctttgtccacatcttgacaattttatctcctgtataattttcagatctctttgtttttcttttaaaaagaagtccctatttaaaatcaagttattagcttagcctaacatttcttatttggcatattatagaatactcctagctgatctctttactttttgtgcccctctgagaaaactaaacaaacaaaaaaccaaaggcaaattgggtaactttccttcttttcagatcctttagtggctttccagaatccttgatgtgatcttctaggctctccataatccagctacagctgatttttccagtctcatctttatttttctcttttgctttctgtgtttattatcattagctttcttttagatcttggaaagggcaatgcttaagagattttgtttccctctgaacttgttcttcagatttgagctcaatgttacttcaaggaatactttattccccggatcaggatcccatgttctttttcatagtgtcatacatcttacattctgaagatcaaagtttataattaaatgtttatttagattagtgtctgcctctccttactagactgtaagcttcaagtggccaggaataggtctggtttgctatacctgtgttgagtacagtggcataaaatatatgtttatgtgctatgtagtgacgtttcagtcaatgacagactgcatatgtaacgctgactccataagattataatggagctgaaaaattcctatcacttactatatttactataccttttatcattattttagaacatacttctacttattaaaaaaaagttaactgtaaaacaccctcagacagatctttcaggagatattacagaagaaggctttgttatcatagcagatgatagctccgtgagtgttattgcccctgaagacttttcagcaggacaagatgtggagatgaaagacagtgatattaatcattccaaccctgttgtaggcataggccaatgtgtgcatttgtatctttgtttttaacaaaaaaggtttaaaaaaagtaaaaaaaaaagtttttaagtagaaaataccttacagaataaggacgtaaagaaagtatttttgtatagctgtacaatgtgttttaaactatgtgttattacaagagtcaaagaattaaaaaactcataaagtttataaaaattacagtaagctaaagttaatttattattgaagaaagaaaaattttaaaaatcagtgtaacctaagtgtacactgtttataaagtctacagtagtgtacagcagtgtcctaggccttcacattcactcaccactcactcactgacccataacaactccctattctgcaagcatgggaagttaaatgtgtttagatacataaaaacttaccattgtgtttcaggtatctacggcaggggtcctcaactgtactggtcccccagtactggtctgtggcctgttaaaaacctggctgcagcaagctataatagcattgctgcttgagctccgcctcctgtcagataacctgcagcattcgattctcataggagtgtgaactctgttgtgaattgtgcatgcgagggatctaggttgcacacttcttatgagaatatgactaatgcctgatgatctgaggtgggtcagtttcatccagaaccatgcctgccaaccccctgcccttttccgtggaaaaattgtcttccacaaaaccagtccctcatgccaaaaagattggggaccactggactacagtattcagtacaataacatgctgtaagttttgtagcctaggagcaataggctatgtcatatagcctaggtgtgtagtaggctataccacttagatttgtgtaagtacaagctgtgatgttctcaaccacaaattgcctaatgacatttctcagaatgtatttctgtcattaggtgacacatgactgtacaataaacttgtggtaaatgaatgacacctgctttcctgtaactcatgttacaggcctccaagtatttgaagactgttgtgtccctcctttaatcttttcaagttaaatacttttgaaatacttttgatttcttgcattcttcctccattttgtatggtttgcaagtccctaatcactttaaatgttctattttgggtgtgccctagttatagatattttttaggccagatcgggagatcacaccccagatgatatctctgtgcaatgcagaatattgcctccctcattacaaagtatacaaggtataggctaaaaaaccataacaatgaggaccaatgtgcagtggctagaacaaaagtttgtctcttgtttagcagtcccgaggtaagcaactctgttccttgttgtcatccaggatgctagtttccttctgtctttaatttttgtcgttcctactggtgttgtcatgtgcatgattgagactagctctttaccactctgtgttgcagccctcaaaagagaaaaaggaagtggagggcaagccacttccttataaaggtatgccctgaagattgcatatgtaacttatgtgactgtctcattggcccaaacttaggcacaggccgcatttagctgtcagggagcctagcttattggccatatgcccaggaaattttcttactaaaaagaaggaatactttgcttgtttggcattagtttcctacagttggtgaatgtttttttgttttatctatttttttctctctttttttttttcttgtcagccttttcaggttgaaagttggtgcatgttgaatttgtggtcataactgctgttcattgttatgctgttaattatttaaatgtatcacaaacatttgcatttattaaatttttaaatgcaagtgatagactggtaatcagcagttcttcttctcccccyccaccccttttttttctttttgccagagtttgtggttgattacttcatttctagccttaacatacagaaattcaacaaatatttatgactacataccaggcactttgtattacagatatataatattgaataatacagattgttctctttcacaaagtttgtattcaaacatattgcttgatttcttttgtgagtggtttaaattgggggttggcaaactttttctattaaggaccagatagtattttctgccctgtggcctaaaatttatgtaaataattcaaacaacccaataacaacaacaacgaaataatctgatttaaaagtgggcaaaagacctaaatagacattctgaaatttgaagacatacaacaggtatatgaaaaaatgttcaacataattcatcatcagggaaatggaagtcagaactacaattagatatcacctcaccccagttctggctgttaacaaaaagacaaaaaataaatgctggtgaggatatggaaaaaggagaacttttatacagttaatgtcaatctaaattagtacagacattatggtcaacagtgtggatgttccttaaaaaattaaaaatagaacgaccacatgaccaagcaattccacttcttggtatatgtccaactcaaggaaatttaatcagtatgttgaagatctgcatttccatgtttattgcagcactattcataacagccagtttgtttttcttaaaaaatagttgtccttgaccatttttgaaacgttattcttacatcattttaattgcattacttcttaactcatcctttcacaatttctttagctaactcttcctcctgtctgtcaaatatctgttttcctttaagtgcagttcttggttctgtctctttctattctttctctcaagtcttagtcacttaaaaaattatatgttatagacaatttccaaatctatgcatctattccttaccttttttgatctagttataactccaaatctaacttacctaaaatctgtaaatgttatgtactttcgttctttgagcttgaaaccttattttgagtcattttataccatcaaggaaatataggagttgtaaaggtggacaataacatgtgaaaacttgtggaggcagcagaaattatttagaatttgcgaaatgtatatttagaatgtggcaaatgtggagaatgtggcaaatcttggtctgttattcccttggaataatagatcaggaggggctttgtcttccttaaaaaggattttctagtttgatgctacaggtaatatggagctactaaaggatttaaaatgggaaggttgaatgataagatgttttttcctagattatttgtagcagtatgtaggatggctcttggggataggaatcctgaagcaaggatactggttaagaggttttacaattaggtgagaaatgataatttcctgaattaaggcagtggtactgcagatttagttagaaggatagattttgatttaagtgatgaggaagagggatttatcaattcctgatttaggacctgagaaaatgaatattattaaccggcgaagtacatacagaaggagaaaaagaaggtttgggaggggaagggaaccttacaaaaaaacgagctctgttttgtaggtattaaatttgagggtgtctgtgggctgcccaggaggcatttgtatgttaagatctgaatctgaggcagagttttaagttagagatgtagatatggaatgtagtagggtacaggtggtagttaaatctgtagtataattgaaaccacccacagataatatgtggaatgaaaactgggccaactctgcaacaaccacgttttggagaggaggaagcctggaaagggaaatcaagaaagcaggtgattgcaaagcattccttgaatttggttgtgaagaggtcatcagtgatttgtttcaggggagtggtatgggcagaagcctgattgcaatgatatgagatgtgaataaaaggtgaggtgaggcaatagagacaggtactacagactagtattacagaagtaggattcttatgtgaaaaaggtatatatatcttggtgcttttgatggcaagttgcaggatagtcaattttaaaatgggcttaaatgatgaaagagatttattggcctatggaatggaaaagtccagaggtgggatggatagtttgaatgtttcaggcctggggtttgcaggcagggctggtggaaggactgggatagaggatgagagtgtgtttatgagagagggataaaccttgaggtttagactagatatggaagcagctgaaagaaggaggggactgatactgagaaaaaaacgtaggtcacagaaagctagaggtctaatttcatgtaagtaaaggaatgaaaacaggaaggttgtggtttactaataagggctttctctagctaggctaagttagctacagttatccaaataggctttatacattgcagctttcaaaatccagtcctagtattttgtagcatagttgtttacttgatggctcttctgccaggaaataaaaattgaacattgttaattctttgtcactcatggatacaacattggtrctcacacaaaggtgtgaacctgaagatcctcgtaagatgagaagcttttctttgtgtatatatgaaaataaacatgttggtcttggcgaaattatgaggtcgctatattttgtggtcataccctttctttgtcttctgttgctcccgccttcctcttttttaggtttactttttattctctttgcaaataggaaaagatgcttcatatttattcatgtcacatgttgattattctaggtgtttacctttctaagttgtcttcaagttcagtgctgttgagtttagtggtgtttgaattaggtaaacttggagtggtgtgatataagaatattaattcagtctcactttgtgtgtaaaatttaaagtagtatgaattccttcaaattaataatgcattgagttgtataatctcaggccaagtaaattgaaaactgccacatggcagtgtacttctttaggattggtcttgagttttggctgctttaaattaggataggtcttaagagtcacttctggctgggaaaaagattttaaaaagatcatgataggtctttaggacatttgtcccataaaatgcctgtatagagagaaagcctttcttagtaaaggaatttctgagactgggaatagttgggagaggtgtttgggggagactgatatttctttttttttttttgagacggagtcttgccctgtcgcccaggctggagtgcagtggcacgatcttggctcactgcaaactccgcctcccatgttcaagcagttctctgcctcagcctcccgagtatctgggactacaggcatgcaccaccgtgcctggctaatttttgtatttttagtagagacgggatttcaccatctcggccaggctggtcttgagctcctgacatcatgatacacctgctttggcctcccaaagtgctgggattacaggcatgcaccaccgtgcctggccgagactgataatttcttattacccctaaaagcatatgattcctagaaatgttgctgaaggttaaatctactttagttgttttagagtgcttagaaaggttagaataatgatttaaaaagacttacctttcttccccttccttatctctatatcccatgatgagcctttgttccatgctgccacccctggctttttatggcatgatgatcataccaaacttatggaaagtaattcatatgaatatatataaagtaattctggcctgggtggctgctgcttaagaatcatctaaagtgatcttggggggaggatttgtaaggaattaaaaaatccctacccctgctatttgagaacaagatctacagcctttttttctgtgtatatatgtgtgggtgatgttaaattgtctatggaaaaaaattgattctaaaaatgctgctaaagaacaaatggtgaagaattgtggtaagatatcctagatggtcatttatgtagactgtttcctattaaggcaaaataggtggtatttaaaacatgacagtagattctttaaattttttttaatgttcattaaagagccattttatataaaggtacagctatatgttaggcttttaaatttaatctgcattttaacagaggtagaaaatgctaggtaactgatctgaagtggaaattctggttaaatacagcatttctagtctagtccattgctatgtacaggatccatctctctatccttgagaaactctaaattggagattacataagataagaacatacatgaaatgactagaggaatagtatcagattgtatggaattaatgatagattccattcagatgctagataggatgctctgggctgcatatttatgtaggatatgtcctaaattcactggagagttgatatagagaaaatatatgttgctcataggtaacattagacttcagagaagggagagatcatggagtgtgaccagaaagacttctggaaaaaaagagcttttgaactgctctttgaaagatggatacgatttgggttgacagaaaagaggacattccagattgggcagattcaagagaaaaatcactggaggtagaaataagtttgtcataagttgagtagagaaaaagattggggccaggcttggtggctcacacctgtactcctaaaactttgggaggccaaggcgggtggatcacttgaggtcaggagttcaagaccagcctggccaacgtgttgaaaccccatctctactaaaaaaatacaaaaattagccaggcatggtggcgcacacctgtaattccagctacttgggaggctgagggaggagaattgcttgaattgggaggtggaggttgcagtgagctgagatcatgccattgcactccagcctgtgggacaaagagtgaaactccatctcaaaaaaaagraaaaaaaaaaaaaaaagattggcctgtcttggtaacagtgagcctcgtatcctggtatctgggctaaagtgaagactttgaagctagggagtacaaaatgaacatggaagattaatatgactatggtctttttttctccctgccctgatgattttacttttatatgtttttttcttaaataaagatcacactctaaaatattacaaagttaaaaaaatcatttttagagaagtttaagtattaaatagatattaatgtcttcaatgtttctttgagatcttcaggttaaatcacacattgaaatttgcttgtggcatatgtattagtgtatttgtcagtgtgcttgggtgcctctctgactttattcaaggtattgaccattcagttcttagtttgtagaagaaatggcaacgttggaaacaataacctattttaattctttaattatattatagttgtacctcagtccatttttccctcttttgttttatcttaggtcaacaggacatactgctgtggcacctaccgagcaggtcctatgcggcagataagtctcgttggagcagtagatgaagaagttggtgattatttcccagagttccttgatatgttagaagaatcaccatttctgaaagtgagtgttaattaagattattaaagttttgatctttacttaagtgggcactttatatgttgaagagtatttagctaatattgcctattgaaattaaatttatccagtgttttgcacagaaatgttyagatagaataatattagtacaaagtacttaaattcaattattctttttaatataaattactatgtaaatagcatttatttctttatatacagttgtaaaaaagccttcttagaacttttatttgggtgggaggattaacttataaatcattgaaacaattttttaatgtgactaatccgtctgatttctagatgactttgccctggggtacactttctagcctccgactccagtgtaggtcccagagtgatgatgggcctataatgtgggtaaggccaggagaacagatgatccctacagcagatatgccaaagtcacccttcaaaagacgacggtaaatatttctttttctcaaataagcaaaactacttttttttagttggttgcttataaaaatgagcacagtttgaaaaccatttgtcttgggctcccttaagtaaatgttttagttgtcggttcctcttttcagtccaatcatcacagttatcacagtgaggcatttttctaaaacacaaatttaatttttacttattttttaaaaacctgtgccctaactgcctgcaggataaaagatcaaaccccttagtgtggtttacattaataatcaggtcaactgtacctcttctagatgtatctgtgtttagtcttctccrgccataccgaattcactttccaaaccatagtctatcataactctttgcttttgcactattttttttttttttttttttttgagatagggtctcactctgttgcccagagctagagtgcagtggtacaatcatagctcactgtattcttgaacttctggtctcaggagagcctcccaagtaactgtggctataggtgtgtaccaccatgcccatctgattaaaaaaattgttttgtgtattttatttttgtagagatggggtctcaccatattgcccaggttggctttgaactcctggcctcaaatgatcctcctgcctcagcctcccaaagtgctggggttaccgtcccacagcaaacttaatacattttcaaaacttagcttgagctgggcacagtggcatatgcctttagtcctagctacctggtaggctgaagtaggaggatcagttgagcccaggactccacgacaagatcctgactcaaacccaaaccaaaaccaaacaaaacttaacttggacgtcacctcctttgtgaagtttttctttccttccttaggtaattaattgttccctacaatgttctgttcattaaagttttgtttacatgtttttattttctactaacatttgaggtgtgctttgggaagacagggactattttattcatctttgtcctcatgacatatactaggtaaccagtatttgctacatgaaaccaataatgttctataggaccgagcctcagtaattcatattgtgctaacatgttttgtgtttcagactttgaagacaaatgtagattaactcactctctagtactttgaaaaatctaatttaatgagactgaaaatgatctatacctgcttagactacgaaaatagcaattcaaaataagtgcccagaagtgagttttaatggactaatctaaaccttaacttaaggctcataggagaatgatacttgagctaagtatggaataatcttaggtacttgaaatgtatgaaaatactttgaaaacattatgtacgatgcagggtggtggcatggtaaaaacccaggagtcatttgaaagttctgcacattgctagattatagcagtttttgttgcaggatgatgacgaatcttgaaatcttattaaattgttaaatactatatacattttttgttctgtaatctttcctcaaaaaatgaccatcatttgtttcctgatttttataaacttaagaaaaaagtaataggaaagagtaaaaagagggcaggtgcagtggctcacacctgtaatcccagaactttgggaggctgaggcaggcagattgcttgagtccaggagttcaagaccagcctgggcaacatgacaaaaccctgtctctagtaaaaatacaaaaattagtgtggtggcacgctcctgtaatcctagttactgaggtggttgaggcatgagaatcgcttgaactcaggaggccgaggtcgcagtgagctgagatggtgcctctgcactccagcctggacgacagagtaagactcatctcaaaaagaaaaaaaaaagaagagtagaaagaaggcaggctgggcatggtggctcacacctgtaatcccagcactttgggaggccaaggcaggcggatcacctgaggtcaggagttcgagaccatcctggtcaacatggtgaaaccccatctctactaaaaatacaaaaattagctgggcatggtggcagccgcctgttatcccagctactcgggaggctgaggcaggagaattgcttgaacctgggaggcgaaggttgcagtgagccgagattgtgccactccactcaagcctgggggacaagagcaagacttcatctccaaaaaaaaaaaaaaggtagccaccatttaggcatattaacctttcaaattatatatagccataaataatctttttacaaaatccattctttgtgtgatgtttactttaaaacttgggaatttttactgtatggttgtatcaagatttatttaaccaattcttggtttttgtttttgttttttctttgagacagggtcttactctgtcacctaggctggagtgcagtggcatgatcagggctcactgtagcccatctcccaggctcaagtgatcctcccacctcagccccaccaagtatctgggactacaggtgcctgccaccatgcctggctagttgttttttgttgttgttgttgttgtttttgagacagagtcttgctctgtcacccaggctggagtgcagtggtgcgatctcggctcactgcaagcccctcctcccgggttcacaccattctcctgcttcagcctcccaagtagctgggactacagcctcccgctatgatgcccggctaatttttttttttatttttagtagagatggggtttcaacgtgttagccaggatggtctcgatctcctgacctcgtgatccacccgcctcggcctcccaaagtgctgggattacaggcgtgagccaccgtgcctggcctgttgttttttttaattttaattaaaaaagagttggccctcaccaactctttattagtgtaattttttcccaggttttcaatgtaaacagtattttgaaaacatgatactggtgtgctggagccagtttgtacctgttcacaaaggccatcattagcatcactttccagttccacattgcgtgatgtcacgttagtaactggaaatcattcgtgttaggtgtatttataccatagaaatcagcaaatcagctaaaatcagccacctcccctgaccctcaagtcagatgtaaagtatatagagcataccactgattgtatatggatggaagtttggtagatatgtatgtttgtgcatatgcgtgtttgttttctttttttttaatattttttgagatggagtctcactgtgttgccaggctggggtgcagtggcgcgatctcggctcactgcaacctccgcctcccggattcaaatgattctcctgcctcagcctcccgagtagctgggactacaggcatgcaccaccatgcccagctaacttttgtatttttagtagagacggggtttcaccatgttggctaggatggtctcgatctcttgaccttgtgatccttctgcctcagcctccccaagtgctgggattacaggcgtgagccactgcacgtggccatgcgtgtttatattcttagtaaaaattcctaaagtctcaaagtatacacatttctaatgggcttccagaaatataccaatttatatacccactcatataatacagttccctttttctcatactctccactaacattttaaactatattgatctgattggataaaaatgtcccattttattttattttaaaaaattgttttagacagagtcttgctctgtcacccaggctggagtgcagtggtgcgatcttggctcactgcaacctctgcctcccgggttcaagtgatctcatgcctcagcctcccaggtagctgggattactggcgtgcaccaccaccactggctaatatttgtatttttagtaaagaggggtttcgccatattggccaggctcgtcccaaacacctggcctcaagggatctagccacttcggcctgccaaagtgctgggatttcaggcgtgagccaccacgcccaacccaaaaatgtctcattttaatttgctgttttttgaggggtttcttattttgtctttggtgatttccttttaatttcctttatacatgtttctattttggtgtttttcttttgtaaaaatcccatatatattatgactattaagctttttttcccttctgttccaagtttttatctttttttggctttcagcttcggtgtttttttctttacttacagaagtttttgtttatatgatctatcctttgaggtttctcctttagcaataggcttagaagagccttcttttattcagtgttataaaatactcacctacattttctcttagtacttctgtgctttcagtatttacatatttaatccacctggaattggcttcagtatagaggaagagatttacatgtttttccaggtagttaggcagctgtaccaacatcatttatttaataatgcatctgaggtgccatcaaattttatttctgttggtattaaatattcttaagtgaggcattcagaagcattttgaattagaattgaatgaatcaaaatgtaaatactaatgtccatctttttgtgttagtgaaaacttgtggaaaatggtggaataaaaatgtgagaagctgttcagttaccaaggacactgctactgaagctcatctttggatttatgaactctagagttaaagaaatatgtgtacagagttttttaaaaataaaataatacagcaagacttacaatggaaaatcctgcccacttttccttcccagaggcaaatatatttttacgagaggcaaaacccatttgtttataatacttttttaaaaaggctttggcagggtttttttttaattaaaaatttttttaatcttgtgtatataatagttgcatatatgtatgatatacatgtcatgtttttatacaggttttgattttttggtatgatagcaggtattccgtcctcttacatgttctctgaatagttagatgacccctactttatcctcttcctcctcatttcttctttcagtcagctgtccctacacattgctggggttaattcatattctgtttttaaaattatcattaggtcttacatgccttgtcaataagtggattctaaaatattatggctagctatgtttactgcagacccagctattaagttattaattcatattctaaggtttcaatgttatatcatcactcaaaggaagaatatgcaaaagcatctttcttttctatatttcacctacgtacttaaaaccatgtcacattttttgaaagttttatatttggtaccataacttctttwaaaaaaaagtcttgtttttcctgcagtttctgattgccctgttttttgaggtaggaacataaaaaagtgttctgtttttcctgcagtttctgattaccctccttttttttttttttttttttgaggtaggaacataaacttttcttgaccatcctaaatatcttctgttctctttattgcttcccatctttttatttattgcttccattctccttactgcttatagggttagagttaaggtacattactttcttccagaaccacgctgactttctcatctgtttgactatggctttcttttataacctttttttttttttttgagaggacattggtgttggtagttacctagcattctgttcttttatcatatcctcatgccttttagaatttttttcatactgtctgctgtaacatatcagtttttttatgtggatatcttttggaactctgtgttctgcctatagaaggcttatttcagttatccacctaggacttcctatttaatgcttttctgcattaacctatggttgttgttttcctagatttatttccttctcttgcttaaacacattctcaaggaatagtcttaagaaaaaggaggtattctgagttattatatgtctgaaaatttctttttctgttaataaacatgatttataatttagctgaagtccagaagttgtgttgtctcttagtgtttttagcagtgctctgttgtcttctggcatctaatattatttatgagaagtcctaatgctagtgtaatttttattcttttgtaggtatcctatttttttcttgtctgcaagcttatagcatcctctatcatcagcagtctgaaatttcacaatatgtcttgagtctttcattcttattttttaattatactttttgttgtttagtagtcaccttaaattgaaagattcatgtctcctttcctttctgataatttttcttacttaattggtttggtaatttcttcttcattttctcttatttctttctgaaactactattggttgaataatagagctcctggtttgatggtcctcatatttcctattatctttttgcttttgattcggagacatttactggacttttgtcttctaacctttctttggtgttttaaaattttagcattgttcattttggtttttctctgtcaggctgctatcttcagaagctggtgattctcggttgacccattcatatgttaaaataaagcattgggtctattgtgagttctatttatattttggtgagtcttgtcaacaggtagacaattgtcagttgtcaacttagagtgaacaggcatagaaatggacactaaatgatgtgcccaaatttcagaggattatgttctatttttgtggcaatttccatgtgtttagagaatgtgcagtttttctggctgaaagtttatcaggatgtttttggctataagcaacaaaaattttggttcaaacttgtttataaaataaaatgtctgtcttgtatatcgagaagtccagagaggttggttctaggcaccatatggtcagtgtgtcagtgctgttatcaagggaccagattctttccttttctctgttctaacattctcttggcttaggctatttacttacactagctccctttatagttgctagatggctgaggcagttctagacatcacatcttgatttggctatatctaatagaagaagatagtatcttttcttgtacttctttcttaggagctaggaaacttcccagaagtctcttcagcatatttcctttcatactattagacagaatcagttcatgtctattcctaaatcagtcactgtcaggggaaatgagcttaccataatttaccagtactcatcagaaattaactctggagcttgtgaatgaggtcacatacagggcagaatgagatgcctaatnaaaattagggttctgtcagggaattaaaggggaggaatggatgctgggtgggtagccatagtctactccatgtggggctaaatgtctgtctacatttctacctgcagggatgacttgtttatttgcagaatttcactttaattccccttttctcagcctcacttcatttctgttcatcattattatgcctggcttctttttggactcaggcttttccaaggtctgttgggcaggtctgctgcctttttggctgctgatcccttcttgtgtattctatgcctgtggctttctctgcacagttttattagtctcaggtactaggatcattttccatcttgcaaaagtttgttgatattgctcattcattaattcatttcctttgttgcttcttattcactatcatctttagattattatatttagaaattcttgagcacataaaaaagcagaaaacaatataataaactgctgtgtgtttaatatacaatcaacagctgtcaactcatggctaattctgtttcatctgtactctaatccattctcccatctaatccccacttcccctattattggtttgaagacttttactttcattttaatgtagaaggagataacatggatgcctggtttgcaatcttgaatcagaactctagtttaactataatagggtcattgcctgatgcacatggcaagtcagtacaccaaaacagcagactgcaacagagaaagtttaattgtagggccactaaaggaggagatgggaggaaatctcaaatctgtctccctgaggagtttgggggtgagggtttttaaaggttttggaatgggctgatgtgtggagatgtttattggtccgagagtacaaagtgaagtcatggacaaagggatgaataaactattatcatgctgattaggtttttctgtgggggtctttaaattggttggcagcagctgttttgccagaattcaggatctgcttaagccattcttaacatcagagattctatcttaaacaaaagccttatgatgctaacactagaattcttttttaaaaaaagtatatatatatatattttttttttcacaaaaaggttttcccacttccaagaaattctatctgtaggaacaacagggatgcaaatggtcagtatctagtgttacctgacttttagttataagaaagtgggtctaagtgcagcctgattaatgcttaattatagctatatttccatccagagtttttgttaactgtgtgagggcagcctcactagtagcatattttgagagttggaaataagatgaatgagggtaaagaagccttaaactttgacttttattttctgttgctagaacagaagcactacatttgagcctaatctaagatatattttcagctttattatggcacacagggagaggaaggtaattacattaagcattataatatagtgtgttaaatgstaatgatcataatcattgaacccttctcagtcctcatcttatttaaatctggtattttagcagacttttttgccttactgctattaattaatttttttttggtctctttcttccttgcttaccctttgtttaacaaccaaatcaactctagatcaatgaatgaaataaaaaatctccagtacctacctcggaccagtgaaccccgygaagttctctttgaagataggactagagctcatgctgatcatgtcggtcaggggtttgactggcagagtacggctgctgttggagttttgaaagctgtacaatttggtgaatggtgagttaattgaactcaactgcaaggttggttaatattgtataagacaatgtggactctatttaaaaggtttaggaccagttttttaaattgtggtaaaatacacataaagtttgccatcttaaccatttttaaatgtacatttggtagagttaagcatctttacattgttacgaaacagagctccagaaccttttcatcttgcgaggctgtaactctatactcactgaacaacaattcctcttttactctcacccccaggctctggtaaccatcattctactttgtttctatgaatttgactactttacatatttcatatagatggaatcatatagtgtttatctttttgtgactggcttatttctcttagcattgtcctcaggattcatccgtgttgtagcaagggtcagaatctccttccctttttaggctgaataataattcattgtatgtatataccacatgttgttaatcagtttatccatcagtggacacttgggttgcttctaccttttggcttttgtgaataatgctggtgtgaacatgggtgtataaatatctcttcatgtccctgcattcaattattttggctatacacccaggagtgaagttgctggattatatggtagttctatttgtaatgttttgagaaactaccagactgttgtccacagtggctaaaccattttatattctgttggggcccagttttaacaaagctcaggacatggagatacaaagtggcgagaggactgcaaatgcaactagtttagaataaaactattctttttagccatttttgttttaattttacaacagcaaatctgatttttatggctttttaagctttagtttttttcaaattaaaaaaaaattgtatacctagtccttagaaactatgcatctatttctctgctggtagaagcatttccaagaacaaaagaactgaaatttgtcatcatttttcrttgtgagatgtttgtctctgaaacttaattttgttaatcttaggagtgaccaacctcgcataaccaaagatgtgatttgttttcatgctgaggattttactgatgttgtacaaagacttcagttagatcttcatgaacctccagtttcccaggtaataacttatgttttatcaccatttgcgatattagaagtaaatatctatacccattttattttgaattttatcttacagtctgatatgtgggatagtgagtttaattttattactgttaaagactggggtgggggtggtgctgaaaatcatttaaacagagcttccctagcagaatgcttgaaatcctttcaatctttgggataccaggtgggcctgggatggttagaggtcccaggcggctcagttatggccatgagctgtctcacttgttaaccccattgcactgtgtcccctcaactgcaaaaggctgaaagacacactaaaagaaaagaaaacatgttgcctttatgtgtggtaaagaatattgatacttagctgtactttgaaatacttaaatgattctctaagccattctgattttaacctgtactttgttactaaagaggtagtaaaataggaggaaaataatttcccaggcattacaagaatttttagagagttacctatcatttagtgttgcttaattttaatttgattattgttatnacacattttgtttctactgttttcctttgctaattatttcacttgactaaattattacatattttaaagtctcacgtaacttttttctttcttcagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagactgtctcctgacagccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaaaaaagaacctttcactagctagcacatgccagaggttcacatctgttttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcagctaagactttttttcctgtggcttttatttatctaagaggtctttgcatatagatgaaatgtatatttgcctggcggactatttgcgttgtgtggccttagtttgtttattgacattaacgagtgttttaaaaaggtttttaatgaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtcctttactggtgtttcatcacaaaatgcatagcatatgtgagttctaaatacctggaacctgtttttagaggacgaatccctcacctactgtatcccctactacttcaaaaaaaatttttagaaaatcttatgacttctttcctaaagatgtctggggaaaattccatccatattgagatgcaattagtttgggggaagaagaaaaaatacacttgacatttgttgtagttaatgcctcttaattgcttaaattggtgtgtatctacttaaaagaggacagtcttaaatttttattctggtgatgtggattttcttgaaagtgcattgagtattaatgaagatggcgtatagacttttatgtcattgatgtattaatgtgacacaacaaaatggatttctttcctcatcagtttttgtgtgaagttatctttaattgaggtacctgtcctaagcactgatagcctttggttctgtctaggaaaggaaaagaaagggacttcacattttttgagtaactgccatgggccaggcagtttatatgagggtttctcatttaatcctcacatccttaagaaggtgactatctccataatacaggtgagaaaacaggcttgttagttgaataaattgcttaagatcacagattattggttgggagcaaggattcagaccttgttcgctggtagccgcaggaagcactgaatagtttccaacagggcacctgaaaaatggtttactacttaccactattctctaatacttcttacctgattcagttcctccagacactccctgaaaatctgtgtgccaaacagtgaagtaaagtacttttgctattaatgtaattgaggttaaatatttacgtgtgcaaaattcgacgtttttcacttgtcatttatctcttttttcaagttggccatttgtcttgaagctcaacagaattgtaatgtttagcactaaggaaaggaaaagctgtcaaggagcaaaagcagaaggaaaccactgccaatgtgtgcaatataaaaataagggtaaaataatttttactttatttgagacaggtctctgttgcctaggccgaagtgcagtggtgcaatcatagctcactacagcctcgaactcgtggactcagacgatcctcctgcctcagtcttcgaagtagctgggactacaggtgcgcgccaccacccccggctaattttttttttttaagagacggggtctggccatgttgctaaggctggtctcaaactcctgtgctcaagctacatttccgcctcaggcctcccaaagcgcccagattgcaggcgtgagccactgcgcccaggctgggtgaagtaatttgtaaaacttagtcctgtgggagttattttagcttagtcgattttcctcatccgtgaaatgggataacttccacctggtgcccactcaatagataagaagaaataatgtctgcaaaacattgagtacagcgcctcttaggctttcttaagtgaagctatcatctgtcattagctttctctgacccagatgctacacgctgtgggctagcaagaacacggcttcaaataaggtggggagaatggctgtaaggggacagtgttccattaatggccaaaaaaaaaaaaaaaaaaaagcagcctaaaaatccttttaacgtatccttaaatattcacttgagggttcaacctttctttcctttctcctgacctctatcggccctaattaacctgttcctgccgccacctaactttaccctaatttggaaaaagctgtgactgcccaatacttgttcctcttttccccctacacctttgagcactagaaagctccagacccagagctgctgaggggcgggagaggaagggagtcactaagccgcagcctggcccttcctcccagggcagcgtaaattcacgcaaacattgattcgttcgctcaacaaacattgggaacctaagtgccaggcttgtgccaggccccagtctctgacctcatggagcccacagcccactggggaacagagattaagccatgaaacacgaaaatgagtgccacaaagacgtgagctactagagtatcaggaccgacctcctttagaccgctggatgggagagtcgtttgtgaggaagtgacttttaagctgaggcctgaagggtgatctgagggagctgctcttggccatcgatatgccgcgcgactccccaggccctcggacccggagcctggaccaaggctgggcgggaaggccccgggccaggggcggagccacctcggcggcgaaagccggaaagcggaagccgaaggctgctgcccggtggtcggctgagcggctctagcccagatctcagacggctgagtcactgcatcccggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaaggtaatacatatatatattttttttatt

SEQ ID NO: 10741 - DNA, 116733 bp, Homo sapiens
  misc_feature (1)...(116733): n = A,T,C or G, or insertion/deletion polymorphism (see Tables 1-2)
gtttccacattcttgtttgattctagaaaggtacatggatacaacgcgtgtgggtgtacgaagtgtatgcatgcttatgtgtgctgccggataaacatatggctttgtgtagtcacacatgatacgtgcatgacgcttgtacttagcttcctataaaaagtatatggtagttgctgatgtacccgtatttttttcggggtgcacgttggggcctcaaaactcgccgactttggattgggttttatggtgctgctaagcaatcccgaactcctgagagtgcagaatgttaccttccagcattgcggaagcaaggcaaaggagaggggctggagggcttcccaggaagccccttcacctcgcacccaaggcctgtctttccgccttggtaacctgaggcaggctcctccctcatgctcagtgggctcagctcaggctcgaagttacgcatcctgcatcctgcgaaggcaggcaggaccggagctggcgcctggaacggcgggcgcaccctgcagtcgaaggtcgggctgcggcgttgcacgaaacgccgtggggaaagagaagctgggcctgggggaacaggatttcctcacctcttgggcgcggccgctccggcctggccacacaaggctccctttgtggaggggccctgctcctgcgcagaccgaagtcagcgaacaatcgcgcaattttgcggcccgccggccccggctctgccggccacaccgcggcggccgaaggcgaggaaaccgggtggcgcttttttatagtcacaaatataaaatcggggcttccccccccttttcgctctcctcttgccccaatgccgatagaacgcagataaatttatgaagggcaagctaagagaataattacagggtgaaggccgttaaattttatttccagtcccaaaggcaaaacctgcgattttattgcaaacatctggaaggaccaagggatgggcacgctgctggtttaaaataaaaataaaagattttatttcgtgaaaacaaaaaaacatcattaaagacctttcacccccatggacttttatttttaaaaagtgtgagggggtgcttgaatagttaacgacttatgcgggtcccgcagctctctgcgacttaaaggagcgactggaggtgcggcccgcaagagtggacccacgctacctccgcggcgctggccttgggcgggcgtttccagaaatccactccctctccccatctcaccacgcccgagggttccagatcagttatgctgtcccatttcatgctcctgtgttttttgttttgttttgtattgttttgctttgttttgctttgggggcaccaatttgggaaaacatgtgaaaagtggaatcgttgacctcacattcccagaagattcgatcacagcaataataaaatctcagatctgtccagccccacggtcgatgaccttgcctgctttgcttagttgtaaagttttaagaaccctttcactctgaggataaggaaactgaggcatgggccattaatcgacttgccgaaggtcacacagtttggaggtgaaccagacctggtcactaggctccagctcgccttgcagtctagatggtttcttcccaccccatagacgcctcataatgttttatacctaccttgatgggcgaattcattgtaattctctcacccccacagggtgccttacccacgtgtttaagggcagcctaatatgtccggctggccaactatttttaactttgttttcaattactcactcaaaactctgaaatcaaagccggctggtggttcaccttggtattgaggcattagcagtggtgttatttaaggtgctattcagtgtggggtaatgggaggaaaagacaggtatgtggaggatgtgggcgctccgtttcttggaatgcctatttgtgtttatgactctgatctgttgtcgcatgactctgctcttcctttgaaaaatcaaaatatctggacctggtcagttgtaggtgaacagttactgtattgcctttctctttctaatttttccccttccaagactaggcctggacctccacccctctgtaagcccctgcaggtagcctgtgaaaccccagggctcctcagacttcccaggtatccaataaccttcgcttccttttgggggacctgcagggggtaagtgggaggcagacatcttgcttggtctttgtcaatcagtttcaggccaaaaacagccctgaaatggagtcatttcagggtggatcgcctgtaggatgcactcagggcgaaaagttgaagcctgtagcagggaaacctaggtagtgcctagggaattagcctcataaactgcggaccccacccttacccataaaggttaaaagagagataagctggggtaatgaggagagacttttaaagcccgttgatgtaatcagtagaaggaaaatttgtatcacacttgcagattcttacatgtaatctcccaaagcctccctcaactgcacacgagtgtacacctaagcacacatattaagccatcctgcttactctttctccagattttccttcccatcagcagtcacccaccaaggagtgcatgcttctgggaaaaacctyacattaactcctatagagtcacgggagttttcactgctcctcccatttacttagaggaaaccccttattttcaagactgttaaaaaccatcctgctttcatttgggttcggttggttttagtggcctaacctacaattccaggatatgtgtgtctgtggaatgggggtgggagcagcctatgtgcaatctgaaggaggggtgtggaaactcttctggctgactcctgactctgcggagtgcaagcttcggagaggatgcagatgcatgctgttgaaaccattgctcattcctctatgtatgcctctcagatgctgcgtctttggacacacaggaacaatcgggcctctggacttgcaattatgttcctagataaccaaaaagtcctcctttttttttttttttcctttttttctatttttgagaagacaggttctcactctgtcaccgagtctggagtgtagtggtgcaatctcggctcacttcagcctggacctcctgggctcaggtgatcctcccctgtcagcctcctgagtagctgggactacaggcccacaccaccacacctggctaatttttgtattttttgtagaaatggggtttctccatgttgcccaggctaagtcctcctttttgagaaaattccatggtctcagagagggtgaggcatatggtgtacccgcttctcagtccaaaccaggcctgtgagaaactgtgaaaggcaaaaggctgccagagagagatgggagataccggctatggggatgagaaaagagctgggaaagtctagaggccggccccattgctaccccaccaagcttggtaggggcaggctccagccgcaggcggaaaacgccgggcgacaccagagttgggaggtgagagagaggccccagccgctggggaaggaaattgcgggttcccgtctgccttgtctccagcttctctgctgaagcccggtagcagtgaatgcgcgctgactttcagcgacgactcctggaagcaacgccaaatgctgactgaagtgggagatcctgcgcctctccatccgggctccccaagtcctctgggcagagctgcaggaggcggggaccagtaccctgcttccagctccccagagttcatgttcgtgctccctggggacctccaagcctgagacacaggctccggggaggtcaggcttggctgaatcacactcatccggtggcttttccattgttctttttgcattcgcctgggatgctagcttcctgacatcctggttggatcctaatttggggcgggggtgaaggaagggggcaaaagtagcctcttgtccaaagaggcccaaggtgaattcacaacactgtggttgccttcagcaccagaacacttccaactgtaataataaagactagatttccctgggcccctccgcagtccggcagagaattcggcgtttcagaggcctgacaagtcatcttttcttgccgcaaggtgggagagctgattctcccgggcctcgcgaaaacaacaacaagaaatcttaacaggctgtgggccccctaacctaaactttcaggtttggagacttctaagggcctggctgtcgtcacgactggcctgcttggcctctcagtctgtcccccgcccccgggacccagctctttccggcttctttgcaaaaggatagaaccgtctcgaccagggcactaggactggaagatcgggctgtgtctaggccgctgtccgcgaaatccgagacgttttttcagcttggctaggaccgacttcgctgccggtttgagctttctctgcactcgggggtctcctgccgtcctcgaccggtggcgtaacttgggaagaggtgtgggaattaagaatggccaggagcgttggattttttaattccttagaaatccatgttgaatgcagtccttagagatcgcaaaaggcagggggcggccaggggggagatcagctggccgggaaagccatggtcttgaggtaacgggatttgcagggaattttgaaaaagctccttctcttctgttaaagttcctagctgttcttgcctgtcacctctccataggttctctgcaacaagagcccggaacaggcgaagcgcagcccagcgttcgggccgtagggaaagagagtatttgcggcgtgagggggcccagctggaatacgcctgaggagctcgccctaaaccccgcgctccgccgcccgccccttgctctcaaggcgcctgtgtctccttctccaccaggtagagctggaaggaggaagcggtctttgaattttcagttacaagaccctggttagtaacagggctttctgtttgtttgtttgtttgtttccttttgccttacccagatttgcttagaaaacgttcagtaggaacattaaaacctgtgtggcgaaatccaggaggaaccagaatattctaaagcacctaggggctgacgcgaaattatcagaatcgttttctggcattttggacaggttaacattttgtcagagccccaaaattccagatctgcaactaaagtgactctggacttgcagcgtctatgagaccagcagatctggaagaaaaacgtatggatttgggatttgcaggagtttgtaaaggcgcagatcagacctcaactttcaactgtcctacctccctcttggagtaacccatggggaaaccgggaagccaggggttaaagtcggcccaggagcatccaggggacgactggcgctgcgctttggcccgggcctcagtctctcccttcctctcattggttcgcgctctcggagtttctcttgttccctcctcgctattggttgggggctggcttttttccccctcagtctttttcttcctccccctccctctccctcacccctcggacaggagcgcaccgcctgccccctgttcctcgggaagggaggaatttagcggaaaaaaaagtttcccagaagtttggatcacagggaggacgggaaggcagagaggaagagagagagagggggaggagagaaaaagagagggaggggagagagagagagagagagaggagagagaataataataataacaaaaacaagatgaagttcagtggacacagtctgtgagcgcctgccccggtgggtgggaagcaggactcgggcgctcatgcagcgagcgggcggcgctcggggcgctagttcctagcagctgggccagcgtaggggcgcaggtcggatccggcagaggagggcggaggaggacgcagggggagggtggagagacccgcgagccgcagtctcagcctcgtccgacgcgcctccgcctctcccgggccgggcccggtgggcgctcagagcttgagggcgccggctgctccctcggtagcgggggcaagcggaggcaggggtgtgggcggctaaaatgagtgaaaggagaagatctgcagtcgccctgagctcgcgagcacatgccttctccgttgaagccttgatcggctcaaataaaaaacggaaactgcgagactgggaggagaaggggctggacctgtctatggaggcgctgagccccgcgggcccactcggagacacggaggacgcggcggcacacggcctggagcctcacccgggtgagtgcgtcgcagccgaccgcgggaggcgggcggagaggggacgccgaagggccagtcrccggtcgcgggtgaggagcyaggccctgccattgacgccctgccttgccccaacataggtttctgtttcttcgcgcaaatgccctgagcctccctaaattcaccggaaccaatttttggggctggactgagccttgcattttcgtcgccagcctaagcaaggagtcctgtttgtttgcatttctttttcttttgggtggagagcgcagctttctgggtgtccgtggatgaagggctgccggtccctgggattgggaggggcgcgggccgaaggcaacggcgggagccgagatctaggactcgcttctgagaactcgggaggactggcgcggcgttctccaatccaatacctcagtcttcggggaatgaccagttgtctcatttagccttcaacctcgtccttgcctttctcccaccaacttttcgatggtggaacataattatatttctactcctttggcgtttacggaaacaagaatggatgttagaccccttactccttgggtcactcttcagggcccacatctctgtgtatttagggtgtgggtacgattgatttgtgtctcagatcctacagtaacccatgtatattatgtgcacggaacatgtaaaaagcaggggggatgtcatgtctgtattttaacagaaccctaggaggggagaagccaactttaacgttttgtgttaagtgccaarattwcaactgtgcaaaaacagcccgggggaacagctgttgtcggaagaatcttgagtgtgcgcgcgcgcacatacaacgctcgcaacttggtttagcggtttcagaagctttccagcccggacttctaaaaccatgctggaaggtgctcctgctgaacagccagagctggggagtagaccccgcttcacacgctgacaagcccggggagggggcagcggcctgcactgggatagagacggtctggggctcaggagcttggggatctcagccacaaagctgtccaactcagaggagggacagctgtcgcttacattttctctttaggcagtgacagttcaatttccatgctcccgaggctaataataatgcgattagcgggtgacctgcagagatagagttttatgaattctccgtgtttntgtggcccgttacggtatttgagtttagtgctggggaattatttttattagtcgatgaaaagaaaattaaaaggagatttatttcgaccgtccaagccttttcctgtatttgaatgcaagtgcttgtccacgcggacccctgcgtgggcattccagaaaggcacccagggctactgtgtgtttcccttcgctggccagaccctatttcctcagctcatttatctattgtcaaaatctcgcgtgggccttcatacagttagaagttcttgcaggggttatgacgccttagaatttgtaaggttcttttattttccccacggcggaaaaaacagaagttgtttagctgcgcgtggcagacgtcctgtcccggggaagttttctcttgggaggccccagatcgcacggagcccgtctagggccttatgttcaaatgggtaatacatggggtcataattagagattcagatcagagtttgctctttctgccgttctccttagcctgagctccattcaggaggcagaagagagaaaacttagggaatgaggcaaaaagaaaccattccagagcgtgaacctggggagctaagctcatgaattctatttactcgctcccgcgggatgggggtggggtggaagatctaacagaactaactttatgtaacagagttcggttggtcatttcccattacgttatcattttttaaaaaakaaaaagatgggtatttggattagagaaaacgaaatatatttgtggggcaagtgtctaggaggaagaagctgaaagcccagcaccctctggctttctgcggagctgggctacaggccgggcctagccttttagtgggccgggggaatccttaagttggagcccccgcaatggctaagcctttcttaacgatttgctgataggatgagaaaagatcttttagtaaaaagggcgccgtggcgtggagacgcggcggtccagggagcagaagaggtggagctgtcggctccagactcaggcggtagcgaaaggcgcgaccagggctgggggtgtttttaggcctttctttttctgtaatacagcaccctaacgaacacacacagggacacatttaaagatgtgtgtatggaggagtaatgcaggcgaccctattgtgcccagggcagcgtctcttcccgggtgagcctcattgttttaactcttttgtccttagggcccagaagccgctgcgtggttctcccgccctaggccgataacaaaccgggaataggaaaaaaacaaaaaattgttttgcgggaagaatgaaacacacacacacacacaaacacacacgcacacgttcatgcctagagtattctcaccatctctcatagcaccgttttttagtccgctctgccggagcttcaaaattccgcgatctttagacaactctagggtcagattttaatgtttaactttcattcaaagacgaggccttttgctttttcacagcccatttttctttccgcgtctggacagagctggctttagttggcgcccgagcacccgcagcttggggcaccaacctgcagcaacgggggatcagtccggcctgcgcgttgtaggcactcactccacagaggaaactatgtatttcgaaagcgtttcaaaaattccaccgagcctggtggccccgaaaaaccccaaggcccgccagactttggagaagggtctgtgaggtaccctcactgtcatacctacgccggcactctcagtcttttggagaagctactagagaagtgcctcaagaccagcctcggaggagcctggctctcgagcctgctckcccccgccctctcccagagcaacagaggaactttcgagctaggatcggctggaacagctgctccggctgcggccttgcaagtatattgctgcggccttgcaagtatatttcaggcgctcggcggcgccatctgcgctcggacctcagcccctgctccacccggagtcctcagctagggcttgggcctttcccgccaaaatcttctgctaagtgctgccgaagccgggtctcccgcggagcgaaataatgtaaaccttctgtggagggatttcctcctccagaaacttcgggccgggccacacagcagctgcgttccagaggcctggggatgtggtggcgcgcgcgggtgggcacctagacaggcacatccaaggacacgcaggcagatcgacactccgcgtacacgtgtacacgtggcaggtctcgcattctcgcacgcacccgtcagctcaactgctagtgaaatgagataggaaaagcccttgcagaaagcgcggccgccccagggcactttcttctttggagttatctagatcaagtggtcacatgaattaatctgccagtttatggtttgtttgctcaaaataaaactcagagattttaattctgacatcacctctctaccaacctccaacccccaatagggtaacagggtgaacacggaggaagtgactctttactgacgtttaagtaacgaataaaaagtgatgagttcaagccagcgggggagaatgtgtttgtgtttgcgcggggcaagcgccagccagggcacaggccggagctcagaccgcagggacagggtgttcggcgaacgcgtagagtgagatgccggagggtctgctggggttgagtccagggacaaggaaccttggtttgtctctgccgtgcacgcccctgcactggtgctggcctggaggtgcctggctccgaggagtcaagggtgaggcctggtggacttacgcaaggtactcgcttgtcaggttaaaacggtcttccacggaggtcacccttttggtaagtgaccttgtgtgaagggaagcgagagggatctaaggcccgagtttgtcatgggccagtgaggattattgttcgctgaggggatgaccgccaagggcctttttctgcgcactgatcggatcttactaaattagacgccctttgggtgcgcggggctgggttcccgggcagcggggatggttatgaagacattctatgtaaaactccggccccggcgcggtggcacaatagaaaccagtaggcaaagggaagtaattgtaacctgttcccacccaaagaaatgaccacagcaaactgcactagggcaatgggaagttcagagaatgggaaaacccagatgtagagtttggactgtgatagggaggaaggtaaaatgtgctatggtttgcatctccaaaggtcccttcccaccctaggttccygcgcttcagaagccagtaatgatagacccagggatcacaagggggtgtgcgggtctctccttttgctgccacgaagtgcagggcgacccctcacccgcctctggcgtccacctctgcacctcagagacccgctggrgaagcacaaacctcatgggcagsgaaggctttcctaggcaacttcacacacagtctaccgccgctgcaattctaaattcagatctactcccaactcaacgttatttcttgctgagcactatatttgggctctgagcttgccactttgggtatcttgatttgtataggtgaaactcccagaaggaagatttcatgggggcaaccttcatgcagggaggaagggagaattaaatttcttaaacaggagttcagactgaaatgatgctgacacaaatcgtctgccatttttctgacacctcccataccaatgacttcaaatggttaaaaatcttttaattatgaaagaaaatttgtttaaaatcttttaatatagacagcatgtgaggagtgaagaatggcatgcaatgcctaaactggggaccaaaactaaaaatactgggtattgtgttttgtgttccccatttatctgtataatgtgcttcatgagtgtaaacatggaaacgagttcctcgtcattaaccctcatattaggccacaaggagaaagggacaactacattttggcttagaaggcctaaacattgtgttcatccagtcctctcttagggcatgcaatgctattattgagtgaaatatttccggtccatcacaatcgttctattgccaaaaaaattataagatgagaggatcgctttgagatcctgattatagactctggtagaactttatttctcacacccgggagaaaaacaattacctcttaaatctgtgaattccttctcagggtggctataattttttctttgttttttgttttttaaagcaaggccgaactgtacaaattccacagggataaagggcagattggcatgctatatacctttctcctttctggaaacaggactccattcgattattattctgggagtgcagctggttattgctttcttactctcaaaagataaagttgttcaataggagaaaatacttaaatgattttcccatctgagctttatgttttgaccttttgagatacttttcacaaaagggaaaactaaggaactggtggaatgtggaatctcttttccttactctttctcatccgtgtagtttatttttgctttgcttttcctggtttctagtaagtctggaattttatatgtgcatgactgacatactcaggggtctgcactgggaacagcaattagcaaatttataaattagggtcctgtttacacttctttgggggaaggataatcattagttaatttaagtgaggcccttgctctaagtgtcagaggtggaaaatatgatttagtagggaggacccgctgtgaaatgggaaaaggggaattcaagaaactggtgaggaccaatcaacatttcttcagtgccactaatggcttcacttttaggcaggatatcttgctgactgcaaaactgatgatgagcttttgataccagaagtgaaaacaggccttgcaaatgactacttttcattttatacttttaatattagctagtgttttatttattttatagataagtgtataaaacatatgttcacaaatgtatgtgcttatacacaaacttatgtgtgaacaccataatatcaccagaacactatatctacatcaaaatatcagttctgaattggatgtagacaaaatttgggacaagaaactgccattgtgtgtgtgtgtgtgtgtgtgtgtgtgtgtgtgtgkagctagtttaacaaattgggaatgtataaaatttgggaggccaaaagttttgtcacccctaggtatcatgggacgattctaaagcatcccagttttgaaacttccaggtaatgggcattttcatttaacttgtaaataaactgatgactgtgaccaaagtcagaagtaccagtcaaggccaggctcatgcctgtaaccccagcactttgggaggccgaggcggggggcggggatcacgaggtcaggagttcaagaccagcctggccaagatggtgaaaccccatctctactaaaaatacaaattttagccaggtgtggtggtgcgggcctgtaatcccagctacttgggaggctgaggcaggagaatcgcttgaaccagggaggcggaggttgcaatgagccgagatagtgccactgcactccaacctgggtgacagagcaagactccgtctcaaaaaagaaggaaaaaaaaaagcaccagtcaaaataccagaaattgagactgtacagatgctatttaaaagaacaggaggagtggaaacttttccaactaaatttggcatttaattttgtaatttgtattaattttggatgggcagaatgctactttttattctaaaaagtggtttcatgttcttccatgtagaaagtaaacggaataactaagataaatcttaataataaaaatggcttatagaaataactagagaaacatcgtgatttggggaaattaatttaagaacgtaagaaatgcatgtaaaaacgtcctcttatttgtcttcttacattttctacaatatagttgccaaggctcaaatgagctgacagtttccaaaatgttgccatacactttagaggattaaaaaacaaaaacacaaaccacccactacagatgacgagtagagttcccttggaaagggaacattagagaggtcattattatagacctagcccggagccttggagtttttttagcttttagttgtcaactggatgaaccgattttccgaatcccctcaccgctgcgttctctttactatcccacagctgggagcgtgtagtttaaactccggatagggtccgggaagcagttaacccccttacttgccactcacttcccctcccccaattttcctccacgcacgatgaaaacgtccaattcttccccctctccaagaatttcagatcccgtttcgccgcagaaggaactgggattgcatctcttctcttcaacccatctctggaaaaacagcgcagtttcggtgaccttcagaagtcagaattaggccgtggccgcgtctgcccgccctcggcccctcggcccctcggcccggccttggaggcgccgcggggccggaacggcgaacgggtcaggcgcggcttggctgcgaggcctcggtgtgccagcccgagttcctgttctcgcgcctggggctcckcgctggccccaccgcctcgcctcgcctcgccgcatcgcgccgcgtgcgcccggggttatcgcggggccttggaaacccgggaccctggaaacccgggacccggaaccctgagggatggcggctgttcttagctctaattacatcctggagaaatgtggggaccctgggctaaccgggaaggccctggtgaaagacaccccccaaaaaacagaacagaccaaaacaaaacaaaaacaaatcaggaacccgccaacgacaaaccagaaatgcaaatggaacccaagggtctcacacctcgcgccctgaggggagttcgagcttttgctttcatcaggcagaacaaatttccgaggaatcaaactgacttcaaacattagcaattagaaaccaagaatccgctggcttgaagaacttttaatccctaaccatttccaaatgggtaaatctagggtcagtatatatcgtagctagtctgttaaaaaggaaagtcatcctgtgggatcgtgacgtggaggatccctgggtgcctaagaggcagggacgctgacgcccagaaagcgggcattgcccaccgagacaaagaaaagcaaatgattgtccttcccgctgctcttggggattaaaaaacaatgaacgaattcttttattaaaaaaaaagaaagaaaaagaaaccaaccaagtgtaaaagcagagtgagaagtgactactagtagctgaaataactgcgttcttttaagaacccggcgggaatggcttccctttggagggaagtcctgtcccgatgcatccttgctccaaagctttaatctctccaggatacagggctccgaattgtaaacctaggggctaggtgcctcgggtggtttagttcttccactcttgctcctgaaaaataaataactgattttcacagtggggaggggcaaacatttgagccaacaagagattgtgaacacagcagtgccttccctgggttcagaaatgttttctcaatttagaaggttaattaataatttgatattttttggcatcaaagggtgggaggggctatacgtactatttagaaagaaggatttagttaaaaaattaaaggtataaacaaacttgcaaaggaatactgaattgtaaaatatatcagaaactttacttacttatgtggatatatatgtcttcactctcctgcaaagctttcaacacagaccttcatgttctgtattatatccatatttttatggtagaaagagggctgaaggagcttaagttaggagtcctagattctagtgctagctttgaaattgatgttggaaccagggatatttgttttaaaaycagacatattaatgttgaaaaaaagtttcaaaattgttttatagccactgatgaggcctcagtgcctcatttgtgaagtgagggagacaaggctcaaatgacttctgaggcccctttagctacgagattctgtgatcctaactttggttttgctttttgaaatattaacattttctcctaaagtactttggtcatcacttgacccatccttactttgttggaacgaaggaattttactgcagttgtagaaattaacagcaatagcaacacaagaccaaaaaataaaaataaaagagagagatttttagagctagaattaaaagctttggtaaagttcttgaaaaagtttttatattaatatcacrtgttcaacagtcctggatcagtgatttccagtccttgtgtatgatgtaacctattgttgcttgcgtgaacgctgttgaaagggttctacggcattagcgaatttaaaggaaatgtaagttatttatgctttgaacattttctgtgccattcccagaaataactggaaaaactctggatttgaaaaatgagggttgaaaaaagcaacttcatcactggtgagttgaattggtgggctaataaaaatcagttgccccctcattactatttgagtctgatggaaagcactagtaactattttccatgtctagtctgcttaagccgagatcttgatctggcagagatgtgagaatgctaaaaggatgacttagtaacaggcaaaacgcttgtcaacaagatagatcagaagacagcttagcattcaaggcctctattcatagctgctgaacttgagggcagggtcagatgcaaaactgtgcccagcatacacctaggagggtttctagtgtttctatctgtaggactttatttccttacagagttctgcaggtgggttcaaactccagtgatggctccccaccgtcatctgatgtccacattctgcacagcccctgtgcagacttctgcaatcatggaacctgtggatttactagttgtcctctgtcgctactaccctataaactactgtaggccaatgaccttgtcctcattgtttttgtatctccagaacctaggacaagtggctgttacataggaagcacttaataaataacaaaactataataatgataacacgataagaacaacgataagaaacagcaacatttattaaataggcactctgtgccagcccctgtgctatatatatatatgtgcatatatatgtgtatataacaattatatgtatatcaaaacactcacaaaatactctatcttattatcatttctatttggtgcaatgaatgaatgaattatacagtgtagtggttaagagctcagattcttggggtcagacttcatgtgtctgagccctggttttaacacttgctagttgtatgaccttgggcaagttagttaatcaccctcaaccctagtttctgcatctatgaaattggaataataaatgtgttcactaaaggattacttgagaattacatgagatagttcacatacaggaacaaaagatttagcacaaagcctattattcctgtcaattgaattgacagcgattactcaccttagtgagcagcttggataagaaattgtttgcaaattataatctatagcagccattgcccctctcccccattcttttgctttaaatggaatgtgtgggacttgaagtggaatccccactttgtttatagcccgcagttagaaacagtacagaatttgagtacctgtggctaataaagacgaaaggaattttgacagctcttgctattgaatgttccactgaggcaaaatgccaacctgagtgagcatctggggaaggggtggggagtagctggctggcatacagtaggaagagggggtgagcagaagccgggctgaggagactcagccttaccaacttccccaggagctcagctctgagaagacaggagggcctttctgaatgcagggaagtggaataatgcaagcatgtttctctttggttagtttttgatatttcttcccggagctcagaaatccccaaaaaaccagactttaccggataggaaatagaaggattcattctttgtctgtaaagccatattccaatgtacccccaggattctgggaaaaatcagccagttgccccagttagttgaagctgcagtagaggattagtgggtgttgcatggctgaattaaaacaacaacaacaacaagaataaaagaagaaagagactaaattaaaagaaaacctataactgagctgaatgtcggggaggaggaatctgggaagtttttttttagaggaacaacagaaaccccagctctgttttgccatgtttacggctggacaacccacatttggcagccctggtttgcccagttttcttccttctgtaaaacagaagcctggatttgatcatttactacttttttaaaatttttgtttcaccctagactttgtttatattatttcctggcaacagagggagaaggtggcttccctaggaaagaggaacagagaagagatcctttcctcagcctccttcaagaagcccagggcccttaagaagaagtgctgaggtcctgaccatccagaggaaaagggagctgcactttccttctggaagccaggtctcagtgttcaaattagactctgccctatgttttatctccaagacagatgttactatacttctccaattttccaagcattgtctttgctcagtgtccacaactctaaccagcagtagctttcatggattgagagcacactctgtaccaggtactgtgtggatggttttattcacattctctcattgcatctacccaataggccttgaggaaggtaattctttccccattttaccaatgaggaaattgaggcttaacagattaaatagctcacccacagttgcacagttccagtatactttaagtgacccagccagaatttaaactcagccctgcgtggcaccagaataatatccttaaccactagattatattgcctgccctgtagatgatgcttaagagctctagggagaatgttgaacctttgtaggtggaaatttatgtttgctgctcacgttgtcaccaaaacagaaattgttaaattgtgaatgagagagaggttatttatagtttccaggtcttttccttccttgcttgtcattcttagttcctctgctcctaaggtgacttttccatacctgctagtaaaggtctttttgtggcagtgatatagggttgttttctaagccatggtctttggaatggcacacgtgcagccttcccgacatgacctgcgtttctttgactttaatgcacaaaaatctcagtgtctgaagtgtagtgactacatattgaattttatctaaaacctctgcatcctaaatctcctcatgcagtgaaattcgggggaaaactttaactgttctgttttacccattcccttctccattcacaatgggatggatggaatctcattggtaattgattcaaaatggaacagcttagaaacatatcagttgcaatgacgggcaattcgtgcatttctaagtactgttgacttttttcaaactcagtaatcacagctgaaatccctttgccatggattgaatttacaaaggaagagattctgatttccacagtggcttctttttaatgccctaggattaggaaactgccttgaggacccacggcaagtacacccgctrttagggtagaggttttaactttaacctctgagtgactgctctgattcatttattttgtaacarctctatttagagtagccttgtttggtatggtagcagttatttgcagaagtctctcttctcaatgaacacttacaccctgtgctccattactcttctaatgctgtaagtggatgagatgccagcagtgagtttcagagaacttaacagcaggtttcatgcttttctggcacacctgttcactgtctttccattactttttctccactccaagtaaccttcctctcttaggaagtctgatgtctccaacagggatttkaagaaaatccagccccctgcccctgttttggtgcgtggattttagcattaatgtgtttcttggctgtttagttgtacagtctgtcatattcctgtctgttgtgcccagtgattaaaaaaatggctttcagaagcaaaaaagagaaagatgtaaaatccatctctgttttaaagctttgctttctcctgttgccagcaccactctatgcaggcaactgattgatgggatttgatacgctcttgcagcaatagaagcatatgaatctctgggtccatttcctttcctaaggaacccatagagagccaaactcttgaaatatagaatgtggcagaggatgagatgaacactgcaatcttgggtgatttactggatctcatccatcagatctatcacattagaaatgtagattctgcaaggtatgcaaccagccaggccttggtcatttcattttccctgcagtgttcagagcactagttgcatgaccaacattaatcctgggaacattagatcccatctggtacaactgtgcgttacccagattagactgtgacaacacagagatttaaggcatctctgtgatattctgactgggtggtaggtactgtaggaggtgcttcctgaagacacaggccaatttgatggctctaggggtgagcagagagtaaaccaagcctcagccagtgtgtgtgcgtgtgtgtgtgtgtatgtgtgtaggggagtgttgggggcggtgctgaggggtgttatggagaactgggtgtaacagttccctarcctgcgtgggtgaattggttccggatgttaacatttttttctttggggcttgactacattcttctttttctttgccagtctattttcctgcccaaattcttaggcttccacagctgtgtggctcattgctggccagtgctgagaatgaaaaawctgctttattataagggcagtttttgggcatgtgtataggtttagacttttgagaggtttttattcagcgccttttctgaattctgagggctttttttttttgcccataatcttgtcagctgagtactaaccctgtagtgtattggatggcctctgttgggagatgagcatgagtgtgagtatgaaagcatgaaagcagacagccttcatatactagaagcagagaaagctggttggtatgggaaactaagacagtagatagaggccaaagaagtagcactgaactgcagggaggagtcagggagacctgatttgagcaactcttctggctgtgactttgaacacatgacctgggcacactgtacctcagctgtgtacatgtcaaatgagggcaataatattgctgcagagttgttgtgagaattaagtgagataacaaatctaaggtgcttggcatagtacctggtacatacatcatgtcaattaacgtttatatcaaattacccttttccatcttagaatattcctgtcatatttggtgcaaaattagggagtgctcaatattatcatctgtctaccttgctcataattatacttttcatacattgagaccactcagacactctttagtgtttttatgagaaaccatttggccgggcatggtggctcaggcctgtaatcccagcactttgggaggccgaggcaggtggatcatctgaagtcaggagttcaagaccaacctggccaacatggtgaaatctcatctctactaaaaatacaaaaattagctgggtgtggtggtgggcacccgtaatcccagctacttgggaggctgagggcaggagaatcacttgaacccgggaggcagaggttgcaatgagctgagattgcgccgctacactccagcctggatgaaaagagtgagactccatctaaaaaaaaagaaaagaaaggaaaagaaaccatttggagagtgttggcacaagatggtcccaaactaccaaactaccctcctcgcctacttttcactgctgccctattcacagctcctctccacacaggctttttctcctcttccatgccattattgctgctgtctggagcaccgttcckcctgctttttcccataaaattctttctaaagaaagtttattctactttcaagatctatcttgagcaccaaatatgacaggatcattttaagaaggaaaagggcaatttgatataaatgttaattgacatgatgtgtaaatccaaacatataatggcttcagaacattacatgtgtccatgcagagctcatatgtttgggtatactgtaatggaggaaaattcttggatgcaccaattttacctttaacttggagttggctaaagggagctcttcttttagggatgtctttttggtttcctctcaaaatggcaccagggtgtttctgtggttttgtggtcacaaaagagccccagttaagtattctgcaactctcaaaggtgtagccaagattgtacaaatacaagggtccccctttggccatcattatcagctcctcttggaaggaggtcttcaccaagtaacctgacttgaccattaatcaaggctcctgtcctgcctttatcatttatagaataactgccggctttacactatcaacaggacagtaatctggttttaacctgttattttcttggcaggatgcacacctattctattccttttgccctattagattgacattaactgttagacttttgggcaattgatgcctatacccaaggggttgttggctttggctgtccctcttattctgtggccatctttgtgcacatgtaaacatatatgcacactcacacaattgttttggttgatcttttctacattttagaattggtcgtagatgaatggataagttagaagcctttaaaaattaatattttgtacctttcttatgacatccaacatatttttccttgaattataactttttggaagaaatatttattttacaagccccaactagactgcaaaaccctggagagcactgtgtcttactcatctttgaattcctgttggcactcagttaacatttgtaaaactgaattggtggttgtcaaactttagtgatgggttttgtgaccactacagccactttacagatgacttggcttcaagatgatcctggagcccagcatgaggtgcctgccagtcacctgtaggtgtgacctggaatgtgtctgttgatctctctatattctggaatctctataataggaataagacctctggacttagagaagaaagaaagaaaggacatttaacatttttgtagatagaaattgttgaatgctcatggagtcttttttggagcttttgcctgatgaggtgttagcatttagaagcataattagattgtgggaacctctctgcctcctcttttcctatttgtttcaggattgtgaccacggcagcctctgttttctgcccagcaagggagaaaaagaaatagaataaaaagcaatctgaaactatctagtgttcttaaacagaagtgcaaaaaagtttctaagtgaaagacagatagtgtgtgttttcctgagagagcagaattgggttaacttgaagcagaatgacagaaattttttctggcttttccttcccaagagcagtggggaatatgtgcatgaactgacaggagatcccagcttagggctcagccacatggtaccagggarggtagattgtcaggagaaggaaggagaaaaacccctcaaacacagggtaatcactgagcaaatggaggggtgagaaatatgaggcagctctgtgagaatgcattaaaaaactgcacagtcaagagtcagccgcagagatccacagagtgccaggtgctttttggtcctgtcaaattacatgtaaaatcctcagtactgttttggttctgacacagatggtcaaggagaaaaacagcctcactttgctatttcctttcttcttttatgccttatgacctgccttcctgctgctgcttggaaagagatgttctgactactatgccagttgcttttcatgacttgcaagacggtttctctttaacccagatcttgttaacaatccattggtttagaagataaaggtctccttgattcagtgtgaactctcagctagtatgcccacagtggcagtggactgctagggctgacccagtgtcattgtgggttctgcaggggtggtggtttccaagccattgttatattctaaatcccgcaaagtggagacaggtgtggagggccaaacttacacaaggaggctgtactagtccattctcacactgctataaagaactacctgagactgggtaatttatgaagaaaagatgtttaattgactcacagttccacaggctgtacagtaggcatggctggggaagcctcaggaaacttacaatcatggcagaggtgaaggggaagccagcatgtcttcacatggcagcaggagacagagaacacgcagggggaagtgctacacacttttaaacaacaagatattgtgagaactcactatcacaagaacagcaagggggaaaccccatgatccaatcacctcccatcaggtccctctcccaacactgaggattacaaaacaacatgacatttgggtgggaacatagagccaaagtatatcaaaggccaacagactggaggtgaatggatgccttgagctccaagcatgggaaaagagagtttctctgcacttaatatgtaaatgatcagaataacctagtctatctttctctagttgagaatccctgatcctgaatcttggaggatacttcttcaagatacatttgtgggtttctaaatgttaatagccaacagactctaggaattgttgaatgacctagtgtcttctgggagaacgccactccaacatggttcttattctgtatcctctttagaaagggagtctgacccaggactcaacccaggaagggttgtacaagatgactcaccaagatctgattataggtcatgaaggacccaatttgatgcctctgaagaacaagaagtctcttcagatgctgaactgctttctgaggatatatattgtccataaagatttgaaagttcattattcattcatctgnatgctgatccttaaggcttacagaattctcttataggcttcccttcaggtctttcatggtccagaggccagaatcaacaactccagagaataaccccagaaggtcactgccttgacacccctataataatcacacagtttgagctctcctattttctgtttcacagtgaaatgggtcctattcagtgatggagaagatgggatgaacctgaaccataggctactgggagaggtctatcctttgagctcagtaggtacagggaatgagtccatttgtccacgatgctaaggaacatggtgcagataatctggggcaagagatctgactgctgtgccagttgctttttatgacttgcaagaaggtttttctaacccagatcttgttaacaatccatgctaggtgatgtattgattatgccatttgggctgttctatcttaggaaaaccccaaaacctactttctaatcccaaccatattaatacttttcaaagaagctgaagtgcctggtattcacgatggasatagaggcctggtgtctttatctccctcctccctcctcaaaaagagggtctaggtaaacagggaagctccctgtgcctggctctggggctcactgtagactgtaatccaagtttcacatcatatggttctctttagatgggaagtggggcaccaacaccctcttttggaagcccaaatcagaacaaaccctcaaactagtttccatgctgagaacttctgggtctttccttcttcacccaacagcattggcaaaacaggctgtttactcacaaatgcaatatgcatatattcgcaatatatatgtgtatgtgtgtatatatacacaccattgagagaaagcatttaagtttgtttttcagaaaattcctcagacgatgttaggctgggcgtagtggttcacacctgtaatcccagcactttgggaggccgaggtgggcagatcacttgaggtcaggagtttgagaccagcttggccaacatagtgaaaccccatctctactaaaaatacaaaaattagtgtgatgcatgcctgtaatcccagctactctggagactgaggcaggagactcacttgaacctgggagatggaggttgcagtgagccaagatcacgccactgcactccagcctgggtgacagagggagaccctgtctcaaaatagaaaaaaaagaaaaagtcctccgatgattttgatggacagccaggtttggaaaacactgttctgtaccactctttttcttaggaattcccaggagaaaaagactgacaagtgtacatttggcaaaaatggtcacagtgctccggaaactgtatttgtaatgctattgtaatagttctaccagtatacaaacaaatgtcataactgagaatattcattactgtagctaagtcagaaaattactttttgttttaataggagggactatggctattgaaataacgtgagasgagtaagtaatgtctgattacaggctccctaagcaaatgaggcctgggatgtttttctggctgtggcaaatacarcttgttattttatagaggtcatggaaaatgaaactccttcagggttttaacactgacaacagaataccattctggaaatgaattaaattagaattaaatttaattttatgcaggttaactctgggagctatgctcaacatttgcaactcttaggatgatatttagacctgaatgaaacaccaaatcgaataaaacacaagtttaaaagtgaaacatttgggtaacctcttcttgtgtctacatggctttaaataactgctttgactattttatcttctacttgtccctttccttcacttaactgatggatttgatttgttgagttggcagatgaggtgctgtttgtacggaatatagctatctttgtcaggcatacagagaacataaaatcttagctcagtggtggcaaacacatcattttaaatcattttgtttgaaatattgcctaattatgctgctacttataggtcatttttatgatttttatatagcatttctaccactgtgaaatcttgacaattttagtccttcatttttgaaattattcacttagatgcttgactaagtgaaaacaatacaaagcaataaataaaaaataaagatttggtgaatctgcacgtgaaggtcaataatgtaggtgtctcgaggtcaacccttttctttttctcttgtggtactttgcttatacctctaacagaataccacagtgatggtattggagtacaattatttgtttacgtctgtcttcttcactagatctggtatttcctataggtcaggagtctgtctttatctctgtatgtctagttttcacaccatccctggcttgcaataagtgccctattaattaacatgtgtggcaattaatgaataatcatagttttggcttttgtctgtgctgagctatcagattaactgttttgactgaaccagctggctggaaaatttagtcaaatcactggcttttctccaaaaagatcacttgcataatactgctaatattttatatttgtatattagtttattttctcaaagtactgtctgtcccaggacagaaaatcatgttgacaattttattttattctctcaaaaacatagaagatgaaaccactagtcttatcttagaagcaggaaagcaaatgaagacagcttaagcaagatcacagccaggtatgagcagagctgttgggatagacctgttgctttcctgctaaaatgcccagcctcaatataccttcctttcctcagtatactctcctcctttccgtacctcatttccttaccctgggcagtgtggatggaagtttagaggatgtgctggaggcaggccgaataccattttacattctaagggcctctgaatgtgcaatgagttttcttctagttctcctaggaattgggttgagggccaggcctagaggcacacagtagtgatatagagggtttccttcacttttttttgaggagccagtgtttctaagcccagaatgtctacttttgtgtttcttcagctgctgcccagcaggcccaggagaacctgctctgcacgatttgtgaaatcgctgctgggtgacagcccattaggtatcttcttctgttcatgggcctccagttttccctgaaagactgaatcaaaacctcaaagtcacaagattggttctattcttcttttcatcttaaagtgccaggtgcacctctgtgcctgagaagattgtgttggccccagtttctattctctaataggctgtgatattttttacttattcttcttttttacttataaattttaaaaaactcagataatttgtatacttttaaaaaatccaaacagcccaaaatgaacagtgagaagcataaagagcaatctcccatccctagtttccgagcttatcccaggataaccactcttaccagtttccttttgcatcattccacatacatgtatgatatattatatgagtccttatatacacatacacacatatgtatatatacaaacctttaaaatgaaaagagagattgtggcataatatatatagtactttagactttataattttagttttgagctgttgtgttggagactgtcaaatagtcattcttgcaagttctccacttccccctcttttaaaagtctcatagaattccatcgtgtggatctttcataatgtttattgaacctattttgacgagccttcaggttgtttccagtcatttccttctttaaataagactccatgattatttttgggcattcttgtgatagcacttatagaataaattctagaagtagagtagagttgtacagttgaagtcatggcatttaaaattttgatggttattccagattaccctcccgaaaggttgttcaatttacacttccacccacagtgtatgacagcccattttcctatccatttgccaacartatattagaaaatatttttgtctttgctacctaatacccttgtatttgaagggtataatgcttgcaaattgatttcatcataaattctcttctgttctccctccaacttctccattttttccagatacagagcttaagtttatagatttgtagagtaattccttcttctctttaaacaggcatagggttttgtttgatatctcaggcttccctgttcctccatttattaccaatcattactttaactcattcttttaggatcctggggtgcaagtcttcagtgccggaggctttcaaggtgttgagtaaataagaaatggcagcaaacatttcttgttagtgagggagagaataaaaggcatgtcagtcagggtttctgggtgcaactttggttcaattatcttcagatgtttaaaataaaggctgtttccaaaccatttcaaagaacggcagggcaacctgctgagacctgtgtgaaatgaacaccctgttacaactaattagtgttactgttttccttgcagttgggggtgagaggaaatatatgaagggtgtttatctcttcctgtagtaggaaagaattggaaccactggaaaagcctggagggggacccaaaccatgactccagctggctattcccacctttctccaaagagtggctgcaagcagctataagccatgtggctgatttgacccagtgcatatgccttctttcaccatgcacagccttcaggttgtttttacaagatgcctgagacaaatagcccattcagtgaaatttgacaactatttattgaacacttacaatatgtagatgagtaaggaatagtccctgccctaaaaactttacaatctaggcagaaaggataattgagtagatgtttggagcccctggaagttttcaaggaggatagtggttatgagcttaggctgggtttgaattgtgactctaatccttattagctctgaaaacatgggtaagttgcttaatttctcttgacttccatttacttatctataaaggttttgtcataagaattaaagtcaccaacaattagtgatctattaatgtcagtaactattacataaccagggctatgccttaggaagattcatgtcacagtagtaaataggatgctaaagcatggaatggggaaagataagaaatggggagatatgagtttagtcaggataggttcagccccatggcaagacaaacaaaccctgaagtcttagtggcttaatatatacaagtttatttcttgctcactgtttcagttatcagtttctgtgcttagtgccttaaaacccttagtggcaccatttcatttgctcctgattctgtgggtcaggtattcagggcacagcatgatacatggggcctcagctggggtggcttaaatggctggctgagatgacctaatatgggatgtatgtctgtagtctccattttggctgtcagatggtctccaccgttcttctccatatggcttctctatgttgctagcttgggcgtcctcactgcatgtcagctgggctccaaaagcatgtgttctaagaggacaggctccagtgtgcaaacatgtatcaactcttgcatcatgcttacaaaagtccacttggctaaagcaagtcatgttactaaactcagggtcagtgtgggaggagactgtacaacggtacaaatactgagaagaagagttcattaattgagacccactgatgtaatagtctgtaatactgtgagaaatctggacatcttccagcatggctctcttctgagtggtgactcagggacccagtctgctttcattttatagttccaccatctcaacacatggcttccaatattgccatggctagggaagagagttacactggggccttagcctgtaagttaaatatgtcacagttcaaaactaatcatagccctgtctaagaacagagggccttagctatgtattctgatgctcaggagagggaaacaagtaagaatgaaactagaaatattttgtactatcactagggaaggtgcctgtggtggtccaggtaagcagtaatgcaggtctgaaacaaagtgtttaggaagacattgtaaaggagaggattgattcaatgaaagagccgttcaaatacctggttagtaatagttcagataaaacagtgtcctaaatcaactttttgctatattttttaacctcataaaaacacacgttttcttcatttctgtgagttaatattatggctgggttttgctctaaggatgtgaggtctgtcatggattattttatttacttagatgtatattctctacttttctttttcaacaagaatgttaggctttacagcataaaggttagaaagactttcagagactagacaatgtaatgataagcctgaatgaaaaactttcaaaagtgacttgtttcttatctccattttccaaatatgccatcttccttaaaagtttcattcttcccttttctagaaagttttagttttaatggaactgaggggttgtcataaactatttctgcttttgagatctctcctaccaacttgtaatttaattatgtaataaccatttctaaattaattcagttacctaaatggtcagtgttcaytgatatttttccaaagatcatcattgtcaccaattttctagattcccactgaaggctttattgtgtagctaagtaaaccgatacagtgaggaaactgtaaaggggtagagagagtcccttaaatcctagaggttacactttatggggacatgaaaacttcagtttagcacttggtttggccatttttgagagcactttgatatgatacactagtatttcataattgattagaggtagtgaggtggttcactgaagttcatgaagccttatcagttttccacttgtccatctaggatattttgaggctttggaacgagcatcattgtcatttaaatacagaagggggtgttgttggttgcttttggccacagagacaagagtaagtagcctgctttacttttgggagaagtgatgatagttacccttatcatcagctgaattgtcattacgcattgaggaaatgtaggcacgatttgaggttatgtaggcaaccagaagttgaaggctgtctttagggtttacctaaaaaagcgatagtcaattttttatttatctgatattggaacaaattgtaagctcacatagccaaaatnttatcagtgctggtctgtagtaatggacccttacacagttttccttagagttctacaaaaaatgaatgtgccttttgtgtaacactgtcctcatagaaaaaagaaattttgttggctaggatttgggcttaatgtactagaacttttgaaaaattggcatatcctcakgatataaatgttaatcctggcttcttgtagttcttctggaaaagtagaagttgactgtaacttaaaaagttcttcagtaaacatccatatattgggttgtaggaagaccaaagccattgtcatttgcttcggcatgggtaccaataggtaccatagcctgtcttgattataggagagggtcttatmtcagcacttggactgtacataccttgaagacagggatagtgccttaatcatctttgcattcccctcagagctcaccagagagtcccccaggtagcaggtaccaaggagatgctcatggaagtgactcagcttgtagtgggaaagaatggggttagacacatgatactcccagctctgctagtactagataggaaattttgagyaaatcacttttcttccctaggcctcaggattcayacttaaatatggggatctagtgagatgaaacttcttatccttttttggcctccatcatcaagcttctgcttcagagagtcagaggaaggctctaggaacctgaattttacatagtaaatggggcattcttctgacatctcccttcccctcatgcactttkagtaatgctccttctccccaaggaagatggctgcctgattcctagcagtactttgcaaacatcgagactgtagaagagtacatgctcaatttcagtggagagaatgaatcacactctcatcatagcaatagttgattcacttattcaacaaatatggtattaggtgctgggaggtataaagatgaataaacaccattctctgctcttaagaagacagatatgtaatcagacaagtgaaacacagggsgatgggtgtctcgacagaatatgaacagagtatggggcacagagcctgagttaggaagggggaaccaggaaatcatttttagtctcttgattcccatcaggtttcctatagcagggcctggatgaagaggaccttgcatgaattcccagtccttgggggccaccactctcctgcagttcctatagcccagcacaactgccactcacttcttttgctccccagcctttcctgctactgctgctgcctgcagatctctgtccatggccgcccagtgtcgatgacagcagcaataacaaattgctcctccctcacaccaagaggatgggttgggccaagtccaggatgattaaattgcactttgagccactgctgtgttgaccagacctcgactctgccctccctcctcccttcaaagcaacaagtagcaaacactggggatgattgagtcagagtggccgcttgtccctatttcctcacaccagcctggactttggaacacgaagccctgatcctgagggagactctgccggctcactcagtagcctgcctgggaggctgtgtcatctcctataaattaaaccttgtgctttctaccctggcaggccttccctgcagccattcctctcattgtccagtttggcctcctggtcgctcaattgtgttgtataaactttggtactttttaggactggcctcctcttctgggtcctgggaagcttgcagctgtggatctcaaagcttggagaagctcagtcactgagtctggccacccaagccattcgcttcaaaggttagatggaggtgcaagggcagtgaagagctgcaggtgttctctaggtctgatttgcatccagttgtttccattcagctgcaaaaatgcayggggctctcgaaactagagcttcctggtgtgaatcagatgaaacctgaactgggcggaaggtggcaagttttccagtgcaagcctagcggrtgtacttagttggaaagtcacgtcaggcccataaacacagcaagatggagaggccgccaaaaacagaggcagaaatagccagggggtcccccatcmcgcctcactcaaaccacaggctcctgccagacattcttctcccttgctctgacttcccttttctcttctttttttttttttttctctttctcttcaagttttgctttgctccagtgattcttcagctagccctgcagctgtcttgacaatttctaagttgctgctgggccttttcttggagtgcaggagagattcagagaagatggtttcagtctagggcttttctctgggaagccgcaggtgaaacatgcctctctactccaccccaaggtactatattccaggtgtctgtacaaggaggagaaattggctcctaactctggttgtaatcagagcatctttggatgtactgaatttattgcagacatttgtgcctattctgatttcgaagtcagatttcatctctttctcatttggtctatatgtagctcccctcgctcactgaactgagttcattcactatttaacaatgatgaattagggggctggagtaggactgacactgttctggagaacaaagctctatattttgctagtgctcagagtgttcaggtggttttagggaaaacacaacagcagtgaaacaggtgctgcagtggcagtaactccagggaaggctcagttcagcttggcagggctgatgtgtttttttccagctacagaatctggagcctctacagtgctgacagaggttaggtactggaaatatcaaggaccatcatctctcaggcctgaaacaccttgtacatttcatgttcagctgcagaagccttgaacacctggcagaacacagctgtctgccttccaaaggagagctgatggtctctcttgcagatgtctataaatacatattcttattcgcctgaaggctttctggcatggatcagggtgtatcctccacagcccagcattcatagttgggaggattcactgaggtaatgtgggaggtatctagcacagttcctggtgcagaagaggccttaattgttgacatttcccactctattccacattcccctttttcctttgttcttagtttctaccctctccctcaaggaatgttaccagagtatatgtttaacttcacacacacatactctctctctctctctctctctctctctctgatattataccttctgatgaccactaaggccttttcttcccaaattagagagcctccctattaattagtatttataatactggaacaataagcacggtcttctacccatcttttaccaatcttccttctcatttactattccagcctctgtttttgctccttctagggtgaaacagctgtttaatatttttcttcttttgaaccaggccatcagaaagcagaggaggtagtggccgggtagagttggtaggaattggtgagcatctcaacatgcctaataagataagacattggtgaaatgcagtcccaggaaccatgaggtttagctacttctctgggaggtgggaggtggggctggtgggaatatggaaggatattgtggtgggaatggagtcatagactgtgtttgttagggtaggaccaggaccatgcggaggcaaaaattatatcactgatcaagataaataatatttagtgcagtattttaaaaattcagaattaatgtaaaaaaatctatgttgaactaaacatcaaaatattggcgtgatattggaacctgaagcaaaagaaaaaatcaygaatactgatcctgtctgttttagtctgctcaggttgctataacaaaataccatagactgggagccttaaacaacagaaatttatttctcactgctctgaaggctaaaagtcccaggtcaaggtacagcagggctgggctctggtgagagctctcttcctgatttacagatggccatccacatggtagagagagagaacaaactctctgctgcctcttcttataggggcactaatcccactggaccaacccctacccttatgacttcatctaatcctaattacctcttcaaagtctygtctccaaaaactgccacattggaggttagggttttgacataagaattttgtggggacacaaacattcagtctatagcactatctttattttattaaatattttgataacttcattcatggcaaatttttgcattaattttaatttttaaaaatattgcattgagaatagtgccgcaataaacatacgtgtgcatgtgtctttatagcagcatgatttatgtttattgcggcactattcacaacagcaaagacttgtaaccaacccaaatgtccaacaatgatagactgsattaagaaaatgtggcacatayacaccatggaatactatgcagccataaaaaaggatgagttcatgtcctttgtagggacatggatgaagctggaaaccatcattctcagcaaactatcgcgaggacaaaaaaccaaacactgcatgttttcactcataggtggcaatggaacaatgagaacacatagacacaggaaggggaacatcacacaccgcggcctgttgtggggttgggggaggagggagagatagctttaggagatytacctaatgttaaatgacgagttaatgggtgcagcacaccaacatggcacatgtatacatatgtaactaacctgcacgttgtgcacatgtaccctaaaacttaaagtataattaaaaaaataaaatattgcattgaaatattatttatcttgattgctgaaatttttggtgtccctcaaatttttcactccaggccagtgcattgcccacctcactccagtcctggtcctgccctagagaaacccagctcctggatctggggtagagcagtgggccaaggcattactctaagtcaaaggggcaaggtctgaccctcactggattggtccgactctgaccaaattcttcatttcctttttcttccttgattattgtcaagtgcatggttgtgttttcaatgctcaatttttttcattgttcaacaatagtttgaattttacccaacattacaataattagttaaatataacattcagtagccaagtataattttctaaatttctcacaggaatggaggtaggcaggaactagagaacccattcggaatcttcagctttgttaggctgaatgttcttttgttgtgacttctgtaatcttgaagtgttagtggatttaatctattttttttttttttgagatggagtctcgctctgttgcccaggctggagtgcagtggtgcgatgtcrgctcactgcaaactccgcctcccgggttcatgccattctcctgcatcagcctcctgagtagctgggactacaggcgcccaccaccatgcctggctaatttcyggctaatttttttttttttagtagaaacggggtttcaccgtgttagccaggatggtctcgatctcctgacctcgtgatcttcccacttcggcctcccaaagtgctgggattacaggcatgagccactgcgcccggccagatttaatctatttttaaaagactatgaatatctttcagctctctgatgatgtggttattttttcaaaattgttgggatgattttccaaaatgattaaacattcttgaacttttaattctgatgtaattttaagtttacagaaaatttacagcaactattagaaggaactccttcatgtataccctttacacagtttcacaaattgtttatattttgctccatttgccatctctgtgtgtgtttttgtataaacatttatatataaatacctaacttttttctgaactatttgttagtaaactggagacgcatgcattratacgatctgttatttaacccagttggtatttacattttaccatttgtcctaatatccagtactagtatttttttttcctaatctaagatctaattcaagattattgtcttagtctgctcagactgctagaaaaaaataccatgaactgagtagcttataaacagaaatttatttctaacagttctgaaggctgggaagtccaagatcaaggtggtggaagatttggggtttggtgtctggtgagggcctgcttcctgattcatagatagcaccttctagctgtgtccccatgtggtagaaggggcgaggtcactttctggggcctcttttataaggggcactaatcctattaattagagatcttcaaggagattatggatggagaagccaggcatgacccacagctcataaccrttaggatgagaggtctttgaagacctaggataaactctgtgctcatttaccttgcctggaaggataactatttggtagacgatcttttatacctgaactataaatctccatgaggcacacatagggaagagtgggctgttgtaactaatccttgrgtcttactaaatttccatatacaagcattccataaactctagaatagggtcagggaattgaaacagaagaggatgaccttatgtgattccctgccttttttcactttctaatggccctagagcagggagttcttactctttgtaaaatgactctgagagttctttttctagactctagcggaaaatgtcttgactcgcagaaaagcagaccaaggttttcttctggctgaatagttttgtatttccacactgtctacacactagattgtaaaagccttgggagcagggccctgaattattcttattagcatcccccattattcawtgattgattggttttctgaaacaacaccaaatgctttgggatatgtgagatgggagatatagtgagatgctgacttgtgtataagtataaagtttttctgtgttagtttaatcttataaccttgggtggttctggagtttcccttgtatgagcaaaatcactatagcagttccagacttcacttttcctaaacatccatttttttttttaatcacattgttcatatttaaagggcagatggcattttaaaagaagggagcttctacatatttaaaagccccttttagataaaaataaacctgtgggctaactgatcttccatggtgaggtataggcaaacttagggcaggggaggccttcttggcaagcctaaagtgatgccatgtaggtgactcctatgccacccatgaagagggattctggaaaggtggcttacattcttcacactccctttgtgggtctcactcttgggcctgatgaagcctgaagcttgrcatattgtaattctgctagccaaggaggtgcttgggactcttccctctttatggtggggataggctctgaaggaacttgaggggtatgctcaacaagggcctataaaatcatgcagtgcttccagctgagatgcctgtgtgcatcagttgtggataccaacatttggattagggaaatcccccaacctggaatgaatatcgggttgagttattaatcccagaaatatttcctgtctttgagattggctggcaggccattcttgccttaatttaaagggtcagattttcccgaaagcagttgagctcccttgctattttgggtaatcatctctccacacacatatggttaatcaggagttggagcatagtgaactttattgactttgtcctgtgcctgaatcaggatctcttccttggccaagtgaatgctcttgatgagtttgcctccttctgtgatcctgttgtagggcttttgattagacattgctgtatgtaatccactctcaagttgacaagcattcctccacgtaaagataagatctggctcatgatagatgatgactcttttcctgagatctcctggggataggctggtgcttttagaactgccttgtgccttgatcttaatttatctgttgtattcaatatcattggaagccaggaaaaggccaaatacctgacctctggtccagggctgtgatatgccacccactccaagcttcctttgatccttgctttgcccagccaagcagggaaactccttagctttccttggtctccagaggtccatctgactgttgatttgngatatttagtcttcctattacagtttgatttgattatgtgttggggaagaagaaagctttgacagcccctggaaagtagctatttagaatggtgctcttccaagtgtccatgtgaagattagtgtttctcccatgaccacctggctgtcatgtgacaaatcttgagggatagaaccttggctttatttggtctggcctgrttataagaacttagaagggtaggcaaaggacactataggtagctcacaatattctcgttaagttcactgcctcctcaaataaagacaactccttgactgttcatttcagactgttcattaaaactaattcagatctgctgaaataatgtctacctttgtagggggcaaaagaacattcatcaaaaaatttcacatagtgaagagaattgttcactttcttgagagtgaaaaccaataaacttaaaaaaagaaaaaacttggaacaatcctgtgtataaagtgttggtactgggttaggaagacatgggtttcagataattcccatatgtgtaacatcaaacatattataggcacatggcccttctcatctcacttccattcccatctgaaatattattttgtaagctgtggaataatgaaatttcactttaaaatgygttttataattggaattttgagtgtcattcttacctttctttctaattggagtgaggctctgaggatcccaaggcccagagtgggaggttgggaatgagtgaaacagtggagaccccatgtttctcttggggatgtggagcagttggaattcgccaagattctatttaatctcttcttatttgtacattctattttgtatttattctatgtcttgtattttacgtttggttggctaagtcaggtgttataagggttaaaataaaaagtagcatttagaatgaattaaattccagtgactcatttatgagggttaggttcagaggacaacctaagaaatcactagtgtgaaaaaataccagtggccttaattaatttagtcacaaaagcaaatcttaaagagaatactgttagttggccacaggtgtattttttttttttcagaaactattccttggcaacatggaaaaatgtcagtattgggtttatacatttaaaaaacatgaagtgcctctctttcctccagccatcttttcctatttctattctgctttaagaagcctgagctgtgggtggatctaaatatgagatgcaccattccttcaagtgctaaaggcacttggctgacaacagtttttcctggtggtttcctgtacttcattttctgagatagcagaatttcaagtaaaataaatacttgatttctgtctcttgtggctcctagtgtagtttcttggccaaggaaaaagtccttattagctttctgagtcaaagagttactattatttattggtcaaaactactatggctagcccccttgggaagtttagccatactttatgcaggtgcctagtctgggcctctgtaggtatttagagctatgttagggcagactgcccaggagaaggagggattagacatcgggaactgatggttggcccaggattgtaaaatgtcttataaaaaaagagggcataagactgttgacactcagtgagggcactgagtgagatgagaacccacacttaaaataattgagaatttagagtcttggtttgaatctaaagacatggttggttttaaggacagaaarttattttttttctaaatttttctttctgtattattgacccttgaaaaatgtgagggttgtggtgctgactccctatgyagccaaaaatctcgatataacttccgattttcccaaaacttaactgctatagcctattgttgactggaagccttaccagtaacataaatagctggttaatacatattttgtacatgtattatatactatattcttacaataaggtaagctagagagaagaaaatgttaagaaaacctcatggaagagaaaatatatttactgttcattaagtggccgtggattatcacaggccttcatccttattgttttcacattgagtagctgaagaggaggaggaagaggaggggttggttttgctgtctcaggggtgacaaaggcaaaagaagatctacatataagtggacctgcacagttcaaatccttggtgttctagggtcaagtgtacttatatcaacttcaactgcagccctacattcctgccagctgaaggcatggatagagagtcacattcagattttgaacactggcaggagcagggccctcccacccttgcccagggatggcacagggaagagacataaccttgttggggctgtagctgtggagaagcagtgaggcccagatagggctgggacactaacatcaagttggtgaccttttgagtgtgtggtgcaaattggcagatataggagcaggaagcaattctggcccaggttaatggtgacctttaggttttgccacttggaatcaggaacaataagatgttgcaactgagggcatgaggcaaagtagaaaaaggcacctgtggttgcagcaggtgacctttaaaaattgccaagaagagctaaggaaccatttggagaccttgccaacaagagaggaaggaccagggttctgggtctccacatatctcctgcctctcctgccctgggctcagagccaatgactattattgttactcaaaacccctccactggactttctccagctgcgagaagtaggggtggcataggttatctctatttcttaggagagagttgtcgttgcttcttattctgggaattgcatgttagctgctaccttgtgtatcccaagaatttagaatgctgagccaattaggggaaatgtcttctacattgggaggtaaactcctttctcatgattttgttatccttttgacagttggagtttgaacatttctggtctctggataaaaggaatcttttttctcctgtcaaggaaatttatttcaagccaggtattttatgacattgaagatgtagtcatagtttgtagtttgttttctgtaatatcctattctttttatagatagctacatggcatctgaattgtgtaatgattctatcttttcttaaaactttaaatttgttgcagtatgaaaattgttcttctgcattgctcttttgggggcagtagatgccagtgtcttttcggagtgcacagtggcatgttggacttttttcttttagcaccactgcctcatttggtaaggaaccaagatgacatggtgatgtttggactgacccagctgatccttcgatgagaactgtgaggcatattgtgcttttatactggcaagcttgagaactgaagctggttnttttcttccttttttgtgatggtctttgaaacatagctgacattctgagttaagctttcctattagagaataataaaggcccatacttgacaaggtatgaatatcagatgttcatttaagaaacagaacagcaacaacaaaaccacatgagaggtcaggcagctcagtccactaccacttcaacaggcttttctgggaaggccgcagcctggccctgtacttggagtttgctctcagggaaggtgcttgtatattttcagctgctattgggagatactttaatggtccaacatggctcttgtcctcatttaaactatgtttaaggccaaagatgagaccacatcaagtggcctctgccccaaggatgcatgaagaaagagctcctctttatgtcagtgagtcttggctcagcatgagctggcttcatcttggattctgcatcctcaatcctgtctttgtctcttctcagtgaagcacaartcagacaagagcctgtcccaatgaagccagaggcctcaaagcagcagagaagtctctcctccagaagccacatatgcctaaaccctaagagtatatgactattaccatgaagagggggttccttctgccactgaagagcagtcttttacaatttcttccttcatcctccctatttgcttctctgagctgtgtcatgtagccagaattttatcaagttaaaagcaaggtatttattgtgtgcccatgctaggagctggtttttcaagccagatagtaggagattattttaaatgcaaatgtatctcagggaccacagaagggaaataagtactgtcttggagaatctggattggatgatggctacaactatggatcacataaaagaagtttaaaactattctttctttaaggttgttttgagatttttgtgaaactcactgagagatccagagacaacctgaatagtgggtcatgggttcaaattgtttgtatttttctcccattttctcccagttctcggggtcctagcaatctggaccatcttaagccattgaaccagtgctgatggaaaggcaggaaaagtagcagctctttctcttatcctcagactcaagggcctcagctaagaggcctcacggccaggtccctgccaaggacattgggtttcttgagtgacttgatcacacgctgatgtttcaaggctgggtgctccccagctggagccctgaaaatgcttgtgtgacatccttggagaaggaaacaaacttgaragaaactcccacaaagtaaatcaccaggactggatggttttcatccaagagttggggaggaaatgaagtgtgaaatagcacagatactgatgaagacattagttctccattaaaaccacaactgtgtcagagcagaggaagtttgctaacatgatgaccttatttctagaggggagagattagtggcctctcagatgcctctggaaaatctgggccacttggaaagaataacataaaatatgaacaatgacacaatagcttttatttcctgaaagcatgtaagagggatattgtgacaattcatgcacagcagcattccagtagaagccttagaaataatatgataataaatatgtaatgcatatgctgctattccykactcctgtgtccatgaaasacatcactaatcaatctggtactcttccctwtgagcttggattgggcctcatgcttctgaatttcaagctctcaaatgccacattcaaatggctagagctgacatgcatgttgaaactcatttgctctcccttcctaagaggatatattttatcctggtccacactgactcataattaaattgtaaataatggcaagaaagaggtctttcacaggcagtttaggagcatgataagaaacatgttgcgttttttcttctaaggaccaagttagcagaatatttatctctaatttagtaatatttatcttgtgcaaactgaattcagatgtgtaatcacaactcaaaccatggtagggtctttctggagggaagaaaagtcactttctctgaggcaacaagcagcatgtttcacaagatcattttgagaaatgagaatcaatagcaagatcttttactaggtgtttctttgtgaagttgaaaaacagttgcaaacattgagtcctgccacaacagtgactctgtggggtaaaggcaaagtgaggtatgctttgagagaagaattgcactgaggcccagaggggaaaagagccaggcaggttggaccctagagaagttgagcaactttatgtaaaacctgaggtttctttgggactagcttttgttttaggagggagcagaaggccagctctgctggtggtctcagaatcccacaggaccagtccctggaacattttgccattggattgagcaaagccttcttttgctgaaaataattagagcaatttggccatactaattatcctgcagcctagtggcctctgtgtaagaggatatgtgataragccaatctctcggtgtggactgtaaactgaccttttaaagatgttatctgtctgcccccattataaaatgggttattttgcttgatcagtgaaaagttgctacgtatgtctcttaacagagaatcagaatataggaaaaggcacttagcataatagagaccctgactgtactgtgactcttcactgagtcaccactggggagatggtcagatgctatgcttcagaaaccaaaagaacaaatggggtccattggtcagcacacttggctgctagttccctaccaccacaagataactcatgaccttgctcgcattttgcagaatcacagatcatggaacaagatgctgggtaggtcattttgtctagatctttgtctcataggagcaagcagttaacgtctccattttaaaaatgaggcaatagttgctcagcaagagtaaatgaagtactgctgctgggggaggcatggaccagtttgaggagagaacccaggctctcagcaagcaggtcttctcacttcaccactttgcttcaccgagtctcagtttcctcatctctaatgggcactgcaagtatggattaagcatggtatttagagcacattgagaaatctctgcagggtgaatgattaaatgtaatgctgataagttacatttttatatggcactttataatttacaaagtgctttcctctgcattgttttattttgctggtgcctcattgagttgcgtaagcagtaggattccttctccacttctcacagatgtgtcaactgaggcaccacagggttaaatggctcctcaagatcatatctctaggtagagtcagaatcaggactcacactcttgctttctgattccaaaccaggactaacactcctaccttctgattctgaatccagagttcctttcaccataaaatgacaaataatgcagttgactgtatttattattcactttaatgacagcagagtcttcagtgtcacagtgtggtaaaaatagatgtttagctgggaggaccaggaggttcttggtagcagacaaactgagctcaccaaaatgttcttctcatgggcaggctccattgccatggcctttaggaaagccttggcaggcctacctggggcagcctcacttactcactgtgtccagctttccctgtggagctgcctctcaaccccagtgccagatgcagacattgccttagaggacatgaggtggagggatttcttctgagatacagggaccactgcctaagagcacatccccagtgaggggattggactgcaagtcccgcaacagcagacttgctgtgcagacttttggcacacataaggagaaagaacctggtaagcttggggttcctgtgccactaatgttttcctgggagataggggaaaagagaaccagagtaaaagcagcaagaccaaaggaaaagccacgttttcattcactcaaaaataatttataattcatctactttccccaagtaagtaggtgaatatggattataatttatccaacttatatatatgtgtatgtgtggttaaaataaagatcaatggaaaatagggaatcatacagagaaagcaagatggtctcaggtggccattttaatactcattactacatagagaaacacaatcccttcctcttcataataaagataaaatatatttttattaagatscaccattagtaatctgtgtcatattcttttgaatctttttcattgtaaatatctggctgagggaaaaagcattttgttacagcagaatagagcttggaaagatggatgtttattacacttgaagaaaacctatcaaaccagtgtagtccttaaggccttttaaagtcatagattcctttgagaatctcataaatcccatgcatccttgccccagaaaagcacacaagcttttgcaaatttaacttatcattttaggtgacttgtaaacctccaaagcttgtccattgactttaggttaataacctcttcatttaaataattagaagtcaatattttatataataaattttttctttataaaaatattcatctcaaactatgactgtagttaaaatgtacaagtatagcaagtgtcatataaaatattctgatatctatgaaatttcctagcctatagcatttgtattttaaacttgtactcattgcacattcacttatagttttactgtagtcttatttttttaaagatgctatatattgtatactttattgtaatttgcatttgataatacttgtgtagtacttggtataaaaagggaaatctgccttcactcatacatcaatgttgattatatgtagaatatgtatataaagtaatactttaatatatacaacagctcatacaccatcaataagatcccatcctccagacttgtaaattcttggaaaaaattacttccacatgttcctaaaagtacttaaggatttttgactggttggtggaccattgactctgaatatctgacctgtcaaaatgccatctttaaactccagtgatgcatagaggcttggaattagccagggttgaatttattacagaacaaagagaggtgatgattaacacacccatctgaacagtagggggggaaaataatccttgaatggattagatgccatgatcctaaaaccacattctctgagtgttgggttcttgcccaggaatgggagaggccaaacgttgatgccttttaaatgacagggtgtctccatggagctctggttagggacagtggggtagagagtttggggtcaattgagaaaaagcctttctttctcctgtgacctatcagattgaggacctagacctgctctgtgtgcagtaaccctcaaaacttacagcccacctgattagtgttatacaattatcagtctgcctgtctaggtggagattaatgtgaatatgtaaataaatggacttaatttttaaccactaatcagagttaacttacaattttggggggactgtagtatgctgctttaaagactggaataaatgctgccaaaaagatgaaatgaattcttatacactgtcccacttagttgtgaaatagacagsctctctcaattcactggcaatgtctggtaggttctgaacactcccaggctatgttttcagggaaatttatctttgtaagaatagtccatgaacagagtactaaacccattttctgattgactttcctattctcctctctttcccctgctacgtattgcaagctttctaaaaagtatggatttttaaacagcattgtgtaatagcattgatggagattgactctgagaagaggcctccaacagaaggacaccatcctaagaaggaaacaggtcatcagaggaaagtcattttgacccccattccctgggaagaggagtgctcgaatcgcaagcccaggtgctcaggaaatctcctgtcactgtgagatgtgctggaacatggtgccatgtccaagcttctaaatacagttcaggctgggtcatcatgacagatgctgaactggcaccactgtgggaattgaagtgggaactctgacagtgcttaaatgccatggcccctgggctcaaagtcttcctaggcagggacagggagaggcagggcagagtcttgtggggaggagggtaggagcaactttggcaaggaaatcctgctgtctnggcnacactgccactctttcagaaggcaacagacactcaacaacacaccagctattttggaagctgtcagtttctgaattgctgacacacttgaaggacactgtctcttcaagggtcattctgacccttcaaggtaggtaggcctggggaaaaatagagccttgttgaagccaagatgttgaccatggaatgagtggaattaagtgacatggtgaggatgactcaaggagtcgggaatggagttaagaataacatgttcactttgcgattcccaaatcagccttctacacagaagacagtgtaaggcaattccttacctcaccccaccctccttttcttggccatcataaaaaatccatcctggggttagcatcctttgatgactcattcccttttggsaagagctttagaggaaaaagaaagacaggagagacttgggaggaagacttttcctggagggtctgggaagttgggatgtgagggtgggattctaagttttgcaagcatcttaatctgggtttgttgagttgtaaatataaaaacactcaatgatttcactctcaatgattgccttgtgccccaaaagtgaacttctttctgccatcaaagcatttgattttagggtttctgaaggtggtgtgggatggtggatgaggtgaagttttgaaatgggagagacttgggtgcatttgttctctctaatatttctgggtgggtggcactgggcatgttcccttgtataagtctcaaaatagggttaaaatgcctacctttcargcctcctgctcgtgctccctgggagcctcacctaggtactagatttttttctgcctcctcagtgtgttttccttatcctgagccaggtgagtgtttctgacaaggctatccatctggagtcagggcttcctgcagcttccaagctctgccctgtcatttccacctctcatggaacaatgcctttgggcagctttttcagcctcagttgctatctctgcttctctgttcaaggtgagagtttgctccctggcccattttccttactgaagacccaatatacctcttttcttagtgatctacccttttctctcttcttttagaccttatcactttctttctcagatattgtgccagccattatggaccaagagagcatcactcaagcagacccactcaaaagcaggcttccttacatggcattttcgttgtttcttctgcttttccctctttctgcctttcyaccatttctcctaacaccattcagttttgatagttttgccctaggccctgaaatattttcttcatcatgtgatcttttccnattctatattttacattttctttagtgaggtttgcatttattcatttgaaagtcttctttctgtctctctcatagggacagggaagtgactgagaaaagacttaacgcatatggtcattttctgttccaaatgatggaaacaatttatatkaagtatattcctattgtgcgccaggggcttcactgagacacatggtatccactatctccattttagatgaagaaattggctcagaaaggttaagcagctttcccagtcataatctgggtctgtggaattctaaaggaggtttgtaatcttttgycttacttctyagcgactctggaaaccccacttcactgcagacaacagagacaccagatgtgtaggggacctggtgagcacagcagtcattctgttcctgaaggaggaggatatctgtctcactacctctcccttagcattactagctctarcatttgtagaacttgatcctttccccattttatcctcatgactgtaagcaccttctcttcttaggttaatgtggaggagagttagtatctgagtattttctaggtgtttgactgactgcttctcacagaagtgactgaactctttgaactcagttgaaacccctgaaagatttcgggtcagacctcgccactcagtttgacacagctcacagtcatgcaaggaaaagctggtaggattccaatagttcaggttatgatgtcaggaggtgaccctaggacttaatagggatttcattgggaacatgtcatgcaattaagacacctcattactagggatatatttgtctcctggaagaagatgagaagaatagcattcaagattcttcatctggctccagcctaccctcccagatcttctctggctatatctcttctcttactttgctaaacctacagcatttcattcattaattcattcaacgaaaacattttattgagtgcataataggtgccagacactgttccaggtgctgaggatacaagaggaataacacagatgtggtcaggatgacatagattgctgccctctaaatacatttggtagattttattgccacgcctctgccagaaaattcccttttcctagaaacccctctctttcttccccatttctgcctttgcatctcacagacatatcttcattaggcccagaaaaaatccctggacttggagagatttctcttacctctaaactcccataggattttgttgccatttctcttagataatartatctgaaaattagcattcgtatgtctggaycttttttgttgatgaagtattaatgcaaatacacatacacaggcaccttgttaatagttcataaaagtttcacaaagtagataccaatgatatcctcattttacaaatgataaaacaaaggcttaagaagttaagtgacttgcttaaggttagatggttggaaagaggagagatgagctcaagaactcagtcttttggatcctaagccccagcatgctgtgtgctatggtggattttgactattctacttttattagacttatttatggacctatcctctctccctaaatgattgtataagctcctgaggacatggatcatctcttactcaattttgtgcccctaataacacctcgtacattgccaggcccagcctagaaaatgaatattatttgctgaacgaatgaatgattgattgaatggatgaattttgattactggagaggttgttacattgttgtcagccatgttatatttactaaacgggatggttttctatgtttgcatggtgagttgggtagattttaaacttggaatagttggtggtctcctgggatcatttgaagggcattcctggctgtgctcaaatgtttatcctacttacatctttgaaactgccacctccagaggcactctctccagaagtcatagttaaattacacttgatgtttagaaattggcttcttagttcttcccctttagtgcrtcatcatgaatttgtttatttattggtgctcagtgggaacattctaacaaggtataaagcaaatgcttgtaaggcctttggagaaaggcccacttttcacatcayagaaattaaaagaccayaatggcagatacacaatggtgctatgacagtggctgatgtcggaggtggtggtgggaggttggaagtggtggttgcaaagagcaaataaacattgacttggggatgagataatgtatcgcttcacccaggaaaaatgccaagagccttaggatggggcctgtgttgatagctgctcacctgaaattggtaaatcttgaagaccacccagtttatcagaatgaacttttgaaggacctttggtgcaagaggtacttaggttgaacatttccatgtggcttgtggccaatttttgattattccatttatgcactgtctgtgtgttcatcacgaatattttctaacccaaaagttggtctcataaatattaattttgtgggaagaataaaataaaatatttgaaatttgaaattaggactgttttagaaaagtcggggcccatatttgtcctttatttatttttttttgtttttctgatatgcttggtcattggcgtagaatcttatatgttaatttgacactttactgtttatgaagtgctttcatatacattattatcagctgaattctcttcaaacatagatatccacttaggaccatcaaaaacttttgggtcctgcactctgacttgagttaagcctaaataaaccaaattctgcacaagtagggcccacttcagttgccttctgtctttcaatgcttccattaaaaatttctcaaagcccaaacatcttccaagtaccttgtaatgttttgcttaatggtctaggctaaagcaaaagggtgatttgacattgacagtgatcttcagtgtctgtcacatttggatcttctacctaggttggattggggataggaagtgaaatatagcaaaagaggccttttatagttgtacttacttactaaataatgttaagttgatgaagagagctaaaatattcctgaatataactgcccttgtactaacaggggaaaattcccatcagaccttcgtttgaattttcctttctcaaaaaaccgacagttttaatttctgtagcgctaccttctgattgagcagcctgagcgttaactctgcatttctgagttcagagtaggatgtgcacagctctgcagttctagttctgaaaaatgggcaacagagtataatgaaaagagcatcaactctagtgtcagactaattcaattcacactctgacacctcccatttatataatgtgagacaagccttttattcatgtcatgcctcaggtttcttatatataaaatggcagcaataatgcctactttaaaggtttctgtgaaaattgtatgagataataacgtacataaagtgcctaatacagtacttgctacttctcttcctttttttcatttccagcttcaaagcatgctggatcactagaggttgaaacttttgcatattgttctaggctaaagcaaagtttttttataatttcaccttatacttgaaatttcaactttaaacaattttaacttttattttagatctaggggatacctgtgcaggtttgttacatgggaatattgcgtgatgctgaggtttagggtatgaatcccatcacgcaggtagtgagcacagtaccctataggtactttttcaacccatgcctccctcttccaccatctagcagtcttcagtgtctgttgttcctgtatttatgtccatgtgtgctaaatgtttagctctcacttataaaagaacatgagatatttggttttctgttcctgttttttttttttttttttttttgagactagatctcattctgttgccctggctggagtacagtgatgccatcacagctcactgcagcctcgaccttcccaggctcaggtgatcctcccatctcagtcttccaagtagctaggactacaggcacgtgccatcatgcctggctaatttttggatttttagtagggatagggctttgccatgttgcccaggctggtctcaaactcctgggctcaagcgatctgcctgcgtcagctttccaaagtgctaagattataggcatgagccattaggcctggcctgctcctgcgttaattcacttaggattatggcctccagctgcatccatgttgctgcgaaggacatgatttcattcttttttatggtcgcatagtatgccatggtatatatgtaccacattttctttatccaatctactattgataggcacctgggttgatgccatatctttgctattttgaatagtacagcaatgaacatacaaatgcatgtgtctttttggttaaatgcctaatatacagaatctatagggaatgtaaacaaatcaataagcaaaaagcaaccccattaaaaatggacaaaggacgtgaacagacacttctcaaaagaagacatacaagtggacaataaacataggaaaaaaccctgagcatcactaatcaacagagaaatgcaaatcaaagtcacaatgaggtactatctcacaccagtcagaatggctattattagaaagagaagaaaacaaatgctagcaaggctgtggagaaaagggaatacttatacactgttggtgggaatgcaaattaatccagccactgtggagagcaatctgaatctttttcaaataacttaaaacagaggttgaaactttaatggcattgagcctttgtctgctcagcaagaaacagatataaaaaattactactaccacttctttgcaaagactctctcaaaggctttgttctcaggatgactttgggtccttgctgtggttctatgtatcgctgagagaggtgctgcttgttaagtggagagtgctgtaggcagttggtgagatatgatgtgcccttagtctccttaattggcttattggcatgggaattgcaagcttcaggttactcccttttcccaaatagaacttggagggcatggagagctcagagacaccattccattactaaagccatttaacaggctcatttgagtgtttgctatcatcataattttagtttaatccatcccgggttatagttcattcccttgaagctctggactgagtatcaaatttgggctcagttcgtactcaggtcagtgccaaatgctctgcttctgccatatttagagttactctatgaaaaatttcgtcaccagcattctctaagatactcgataaaatctgatagcccacaaccaatttccactgcagaggtcctctggaaataggaacttacttgctcctggtacagacagggctgcctgggttttaagattctggtatttgcccttctgtgaatgggagccctgagatagtcatgagagttttggttttagagactttgtgatttatgaactagatcaagaagtggctgtcctaccactatcagataggaaacaccattcaatgtggttgtgtaccagtatttggcagaaaagaaagtaagatgaattgtctatcatccgggttgggtttttctcctttaattgtttcaaactattttcttccttgtggaaaatatgacagctgagctccagtcttacagaagtaacactgtgcatctaatctcagagcattctacatctcttatctgactctacagtcagcttacacatttcacatagaaaccaggctatcttgcatcattcacacatgagatggggcaaagcattaaactgagcttatggaattcatagtctggatagaagacagaactatcactacctgcacgttaaagaaaactttagcatgtagatgataaagtctaaactccatatcctgacacccaagatcttcagccataaatttttgtttgttccctgatgtcccaagagtttagaagagtgactggcacatagtaaatgttcaatatgtagtcatttagttgagttgaacctgaccttccaccttcatcatttatcttacttctcctctacctttacataatctaaactctgacataccagtttgtttgtaattctctgaaactccaaatccttaatcactgttattcccactacctgaaattctttctccatcattttgttgtttgttggtttcaaacttctatttcaagaccatattcaaatgttacctcataaagtcttctcaatcctctcatcattgacttgcttccacttcaaagctcctcaacaattttccccacctctgcaggcgtatctgtcacagtcagccttccttaacagtttctatgtcctttctaccaaattgtgagctccttcagaacaagaacctgttttatttgtcttggtccattaatatgtaacctagtcaaggcaaagcagaaatatttggtgacataaaaattgaattaaatgtagtcttctgtgctggacatccttaggcagtagaatggatgtaacctggactctggcatcaataatgtataaaatggagataataataataacaactcttaggcttgcctgtactaagtgatgttttgcatgtacagtcttggcagagtgcctgacaaatagtaagagctcaataatgttgaccattaactctttgtgttagttcttgtgagcttatattcatctccctgtcccaagtcaataatattattatcaatagaaccattacactatgctttatcataaatatataactttttttagcagaaagatatcttatacccccaccccccatggtaaagataaggaaacttaggccaagtgaaccaaagaaacttttaaagatcccactgctgatcagtagcagagccacaggagtaaatgtgctttgttcactgcagtaacgaataattcctcaaaattaactgttaagtggagatgccaagactgtaaaatatgcttttaaaatgtctaatttggatattaagtttttattagactaaaagtgtatgcaatttaggcattttctatgtatggtaaccaaatgaacctattgtagttggttcgcttttgttagacttggtggtctctaagctgtactactaatccacccattagacattcaagttaaaagggaccttatacacttccaattaaatgtgcatgtgctgtgccataaggattaaggaaattggggaccagaatagtcatgtgacttggccaagatcaaacatatttaagccaccttagttgtgaggatggttaaaatagttagggggtgttacagagttgccagctgttttggctgggttgaacctagtgtgnttttggggagatctgaccattggatcaggatggagaagatgtgcattctagtacatgttagttttcaatttctcttgtttcagtgtccttgtccacaaaatagacatanaaatacaagctatgtctatcttatcaatgggaagacaatattaggtaatgtgtaaaacataaattaaaagttcttttattattattgctagagtgagaagtgaacgtactttaagctaaactcaactttctgtgggaacttagtgttacagcattcattttatcaaagtgaaataggtcagagatagaaagtaaaatgatggttaaaatatctttttaaaggatttttttggggggatgagaatagatatgttgctttggccctgtgagtcacaaaatgttctctagtgacttgtaactggctcagcgcaggttacttaagttttctcctttagctgccttggttacatgtaacattttatgttcctgatttacttaaacttcttctgttgaaatactattctgacagtatctgatagccaagaaatcctgcatcattcatatgagttcctaatggctattttttgaggacaggaagtcacaaattgccaagaataaatgaccttgaaaacacagaggtgttttttgatctttaagggactgactgattatatttctaaatggatgatctgatttgattaaaataaccagctgtgtgtttcttccatgacttagataactttattatacatcctaattaatagctaaaaattttgatctggttagccaaaatattttctataactatgatttagaaatgtattttacaaaagattaaattttatttttacctaggctgttaatcttgactctgagattactattttaagggttttgtagggttgcttaccccacgggtggccctaacccttctagaagctttttaaaaagagcatctataaaagtaacagtaactttatttcaagattataatatttaagaaacaattgagaatagaagattgcatawgcattcatgttattgaacatgtgggctgttgcttacattctttatataaaagtcactggatcctgttttgtgagagagtgaaaatctagaagttcagggtatttccagttaaataaatgtctttgaaaatcctcttcatggacaaatactgcctatgcctccacagacttgcccatttcctttctagtaacaatgggttccccaggagtgttctagccctcttggatctctttctcttctggacttctaagagacatctgagacagtatgtaatggtgtggaaaactgtgtggcagttatttgtgttgctctctgattatttttgaatgctcatagtctccactgtactgtacttgaagagaggtcccattgtgtactttgttatttcccagaatctagcacagtgctgggcacatagtaagcactcaataaacacataattaatcaacactaactgggaaatttcttaaggtcttggattctgtttctaattatctgcatggtacttcatctaaggccatatgctgataggtgcttattgattgatttgattgaaactataaacccttatagaatacccactcaattatttaactcctatggtaatgtgaatctgagcccccggtcttttcccttatttaacttgtcttgttcaaagagttttaaatttgatgtttctaattgaggttacctgggttagcacttgcactggggaggattcttacattcaggtcattagaggtgtaatccttaagttcattctttttcattgcacattgaggacctaggccccccctgtggttaaatggcttgtctaaggttattcattaattcatttgatgttacattttgagtccctgttttgttccagatgacatactgagttaagggtagagtctcttatttcataattctctagccgtagtcccaattccaatctcagcctcaatttagctaccattaatacttatctcttagtgtagtgatacctttccttcccttttccagttcctaaacatacattggagaaatcatatgtccaaaatttctgttgggtcctacttaaggtgtctctttccaattttttgtaattgtggcactttatggtgaattttgtaactttttgcttccaaaagcaggacaataatatattttaaaaatctttttctgaggaggttttttgaaaaatttacagtattcatgataagtgaggagctcttaaaatatcccagacacaaaataggatttgggaatccatgtctcaggggacatgaattagtgtgtttggctgagtgtgtgatgatataatggctctgctactgaaaggcctatagaatcaggctaggatatagatttgtcactcagcaacagctgtcatcttagataagtagttctacttttcagtgcttggagaagaccaaaaatagctgctacttagtcctaggtataaaattatgtgcttagacatgtaaaacctagttataaaactttatagtttttttttttgtgggtggggggcagagggggagggagaatgaagatagtgactacatcttcatgtagtgattatgggtaaactgaagtttttggtcagaaacttcccctttatttagaagtttgatttggttctttaacaacctgaatatcttcacaagtgacaggtgaggaattagggagatggagagaaatgacactttttcccctgtgggcactttattccctgtggctttgacacagctgttagatattcttgccagagatgctgcctggggttgcaagagaaaaaagtcagtgacaaaaggaaagaaaagtaaaggaacaatggggtgtatctttcacaggtctgcaaacctgctgcaggtaagtgaggttggcagcaacgtgattgggcattctgtcccattcttttccatcttactagtgtcaaggattgatgctcaagaagctctgacccttgacaccattgaaaagtcactcatcagagtacaacacttgtttccagcctttactcatgaatatwtttaactccaaggaaagcaatcagaattctagatgttaagggtgggttagagaaatggattcttaggcttgacttgcagcatcatttgacctaagaaaattatnctagataatctgaatttgaaaaatgttaggacacacaattcttggcattaagctcctaaaggtaaatatttaaaattccagtaaatcttccygggtaaatctggctctagccttctccatcagtcagcttcccctgccccccagccccacttgtcttcatgagtacagaagacacaggaaaggaccatctggaccagcatgccaactttttatttggttgctctcaatcccaccttcctgtttggatcacccctcccctctgcccatacttcagaaaccaatcaaggtgtctcctgaactcatttattccctttgtttcaactgcctttttgggtaactttttccatatgcttacatccttgactcacaacagaggtttttttcccatccaaaatggcctgattagactcttaggaaaaaccatttactcaaatatatgacaaagtacttctaaagatcccaagcagcttttcattacttttgatggccatggcttatgtaagtagaggaaaaatttctgtgtttaaaaataactgacaggcagtgatgctgagtggtatggaattgaagaacataatgtttgcactgaatctttacttgcacaaatgtaatagtctaatctaggtttggacctrtaatttataattattttagtttaatatggcatttattttgttgccccagtttggcctcattctcttcaacatggtgacattagtactatttatattgcctgttgtggaccaattttcttcagctgttgctaaaacttactaaaatgccagatgtcatgttggaaacacgaaacctgaaagaaggtcataaatcacaaaaacaaaccataaaaaataataaaataccctgagtgctgtgctctggagcttcccagctttaagtctccttttgtttacccctctccccacttcattgcatttcccacccccatcttttagggccatgggtgaggggagctcagcagtttctcacctaaggcttgattgtttattttgcagattctgagcagagcactggttcagattctgaggtcctcactgagcggacttcctgctccttcagtactcacactgacctggcctctggtgctgcaggccctgtgcctgctgccatgtcttccatggaggagattcaggtggagctgcaatgtgctgacctctggaagcggttccatgatattggaactgaaatgatcatcaccaaagcaggcaggtaaggacaaattcctttgagtggccagattcaaagaatttgcagaagtaggagccattacattcttccattcttatttatttgtgatggcatcaacaaaaccaaagcagcttgcactcacttctctgcatttggacatcttggtaaagttgttctgttgtgtttgttgtgattgtattattttcctccaagggccaatcaaatgtaagtcatgtaaatcacaaacattttccacctacaaatgtatttcagctaatattggaagtccatgggatcttaacagccaaaatatatatttccaaagcaagtgtttacttcaccattaaatactttcaagaagtttgcttcccaaataacaacttgcatcttctaaagtatttaaagcaacaatgcttttgtagtaatttttaaaaaagaattgacttgatgcatattctgagcctgttgatgtccattgtgttttatcattgacttgaaattattacacaactttattggtgacctatggaatttcttgtaaaactgtttttctagggttacaaaattttaaaaacacagcttctcttgatatagacacttttagttaagctactcctttattggtatgtttcaactttccatagttaagtatttattttgtgctggacactcaacatacatctttgaaacttacaggaaccctatgaggttggacataatcatcccatatatggattaggatgcagaggatgaaagacattaattagcttggctaaggcacatgggtactaagaggcagctccagaattctgcataaatctgtgtggctctaaaacagtggtctcaactctgaactgtgaagaaatggctgtagttcttgccccttggattcaaaatgaaacgatttagataaaattaaatttgggccgggcacggtggctcacgcctgtgatcccagcattttgggaggccaaggtgggtggatcacctaaggtcaggagttcgagacaagcctggccaacatggcaaaaccctgtctcttttaaagttacaaaaattacctggatgtggtgatgggtgcctgtaatccctgccacttgggaggctgaggcaggagaatcgcttgaagctgggaggcggaggttgcagtgagccaagatcgtgccgttgcactccaccctgggtgagagagcaagactctgtctcaaaaataaataaataaacaaayaaataaataaataaatacatttggactaagcttttcagcatataggaatagttcattgaaattaagcaaaacagttatgctacttttgtgttttcaaagccagtgtacataatctcacatgtcatggggaacaaaaatcgcatcttactgattgtgagctgttttcatgaacatagccatttaaagtaaaataatattttggttgggtccagtttatctacgtgtatataaggaaacctcccaaaacaataagatatgacaaaaacatgaagttaaaataaatctgaaattttgtttattttctttcttttctggagctctcttccttctctcagtagtgaataaaaccattaaaggcttcctagggggagaagatgggctggataactgtgttcaatatcatctctttttcgttgcttgggtctcagtgtacttctgttccacattttgtggtgtaaaggcttggaagaaaacaaagtaactcaaggaaatttttttaaagtttttggtagaagagttggtttggagagagaagaaatattacatttttttttgtctataagattttccggtattctttttgggtttttactttattactcttgggtctctgtattccagtcatgtttgttcctgatatcacttcgttattccctgtgctttagtgaattgagttcatttgagcatctccttgacaamcttcttgtgactcattttgtaattcttctgcagtattttcatttccatatccctgatttcacaagttcaccttaatatctggatactctacacattccccaagacagacacatagtttgttctttagtaataattgaaatcctttgtttaagtttagaaactacattaattggttctgtattcagttgtctcaactgttgttactacatctaattcttctcaggtaattctgaaacaactctgaatcatacaaataaggctttctcttctgtgaattttcttcattccttctcattctcctggttaatttcttgcttctcactcatttttcttgctatgcagtattgtcagtattcttttccattttaattccaatctccatcttcttagttatgttagttatatatggctttctctcctttttctcacttagatgatcttagtcaccatctacctccttccacaccccaaactgtgatcctattgattcagagctgctgaagtctatagagccctcagtctttgagtgtaccaacccaacctgcataatcagcaccatggacagaggtgcttgcaaggattaatgggtttagaagacaaaagaactggcctaaatttagccataaaattaaaaccaaacacatctctttttgtaaaacatgaaaggttaacttttctttagactgttgtgacttcacttgatattctatgctaaaatgtgacaaaaagaaaaaaaaggcttgcgaagtttttaagaagagaattcaaaggtagtcacagaattttaaagcaagggggcactgtagagattatctagtcgatwtcctttgttttataggtgatggggttaaatgatttatccaaagtcacatagttcatttattttagaagtcaggtactggaaagggatgggtagcttctccattaaaggtcatataatggttccagacagaacagatattgaattaaaaacatctaacacctttttttgtaaaggtatgaataaaagaaatctctctctttcgtgtaatacagcctctctaggtgactgggggaaaccatattttcttatctcaggtagtaaatgagaggacttttgccccatctctggcaagatgccctccaaacatttacatatacagggaagctataaatcagtgttattaagaagggaattacttatctgtatttaaatgtgtagatcaagtttcccaaatttttggaattaattaatgcaaattaaagtgcctaacctatagtgaatgttagatttagtcaatgtgagtatcccatcatcaaatttcattagcccaccataagacaaaagtatgaggcctttaaataaaaattgtgaggtagggggagaaatttttaaatgataatatatcctagaagcttctgaagagtaataaggtgagaaagatgaaatagttatgcattaattttgtaaccatataagaattagccaccatctctattaaaggactgtgatccttcttgtgctttctctcagatatgattatgatgtcactgacctactgccaggggatattagccttttgggttgcttctcctggatgagtagtgagtgtgtaactagcacagagagcctctcctgtgaccaaccagtacatatttgcaagatggctgtttgaggtcagggtatggtctatggccatgaaatggagcaaagccaattaggccatatgtggatcaagcctgtgaccttgacctcattagcactgtgctctgcccagctcaactaactagccccagatggttaagcttaatgcagcattttgcatacaagtagcctagagcacattcagggcaatccaaatttttgaactgagaactttttatgtccggcttgatacaaaagagcttgagcttgatgtttttcttctttcttatggttaaagaagaatggtgaactttattctagacttattgaaactcaatacctcttttgggctgctctgtctcctcctctcttcaattatgagagaagtcgtaaagtgctatatcctgacctcacttgctttggcaagtttaacaagccattgtggtagaaacaaggtattgcccagaggccacgagaattcatttggtatttgcttccaattccamagggtccttcctctgacacacacgttgacagcctgagaacttgcagaaaattttctacagttttatgcactaaaaaatcttggtggctctttgtttggagactggtagcaccttcctttttttcttttacacttgagagactatttttagagtggttattttcaaataaactcagttgaaaatattttatgataacttgcaataaactgaaaagctcttcagattataagaagagtgtaagttgctatactaacctttaaaaagattatagctaataggaaatgtatgcatggctacacacatgcacacacatgcctgtgcatacatttatatcacaactaagattaactaaaaatacaaagcagggttgaacccttggagagtatgaatcatcaaataggtcaatttaagttaagaagagatagtagttcagtagtataagtctattgtatatttcatagtgataatttccaaagtgaaaaaaattagtcaactttgagaattagaggacattagaatttgatatgcttagagtacctaataagaatacgttgtttaggctgggtgcattggctcacacctgtaatctcagtactttgggaggccgaggtgggcagatcacgaggtcaggagttcgagatcagcctggctaatatggtgaaaccccatctctactaaacacacacacacacacacacacacamaaattagctgggcgtggtggctcatgcctgtagtcccagctactcgggaggctaaggcagaagaatcccttgaactcgggaggtggaggtggcagtgagccaagattgtgctactgcactccagcctgggtgacagagcgagactccatctcaaaaaacaaacaagaaaacaaacaaacaaaaaaacccacattgtttaagcttttacccctgctacttctcccaccctgatttctgagctttctgttttattcatcttcataggaggatgtttcctgccatgagagtgaaaatcactggcctagatccamatcagcagtactacatagcaatggacattgtgcctgtggacaataaaagatayaggtaacaataactctgggatgtggaaatgtgggtatcaccagcattccaagacaattcttcaaactccttagaggaaatagtttagcaatgcatgctgtacagagaacaaggaatggagactatgtcaatggcctgtggcagagcaccaggtggaaaaagtgttaactttgacctgggattcccccctgtgtctctggatagaatgggattgtatagtgtctcctaaggtagcaaaaatcaagtggatcttaagtctaaaattaatttaattaacattggaagtgattaacatattgaataatttggtttgtgaaatgctaaataaattggggtgatttattttggaaagaggaaggagaggtggaacaataangcatattaaaatgtatatttgatggatcgccccatagatgatggagaggaagaacaagagaactgggtaaaatttcaagaagaatatctacttatggagaattattattcattgatatgggttgtgagtgagattgttaagtaattttccctcaaactgattaaaagccaacatagtctccawgtctcttggatggcttatacatagttcttgccagaaaaaaaaaagttgtggcttatttcttctcttgaggtctcactcaaatcagtaaatcattactcatttttgaaatatctgaagtctaacaacttggccctaaacccatgaatagggaggcaagagctgatgaaaaaggccaggactagtatggcaagtggggagagagatggctgagagagacacggtctggatttcaggacttaggagaaaagatgcttccagcktgttttaggggatcttgggagttgtgatttggactgggtgcctctatttctcagggtccaggtcccatgtggtcctttagaactgagaagcaggaaagtaccagatccatggagatgtttcttctgagctatgagaaaattggcaaagtcgggaaaactgacttcctttgctaccaaacaatgtcttttttccagtgactttgtgggaaaatagtgtagaagatggtgttcaaaacgggttcatcaaaggcaatgtgaactgggagtatttggtggtgcttctgaaatggttgcagagaggcaaaggcccgtcatagaaatgcctcaaagtccagattcttagcaaggaaatggttaaccagtgagaggcttgggagggctctgcacatggctgcattttataggacaatatggaagatgtttttaataaggaacaaaatcctgaacaaatggccaagggattatatggtttgcatttgaaaggtgaaaggttgcagtaaaatgccttttctatagctagacatgtgagttcaggatgcatgtgtgcacacaggggtgcacggcatggagagagggaagaaaggaagacggctgtgagaatgttttccttgcgagggctgaagatttgatcattaaccacaacacttctctgccctccccactccatctttttgtccatttctatctctatttcatttccctggttatctgcccttctcttttcctcctttgagtctctgtttctttcccattacttctccattcatgtaatctctttgtttttctctcctttcccctgtctcaacttgtttcctgggcctctgtcccttctctgcctctgtctctgaattttcctctcttcctctttatctcagrtatgtgtatcatagctccaagtggatggtggctggcaatgctgattcccctgtgcccccaagagtttatatacaccctgattctctagcttctggagacacctggatgagacaggtggtcagttttgacaaactcaagcttaccaacaatgagttggatgatcaaggacatgtgagtcaaagaatcctatctcccctttctttctctcttcctctgtttgctttagagctggctagccccagtstttttcaaataggtaaaataaggaatctctatgccactttaagtaattttaagtaagtaagcataaaantgtttttttccagttaaattccatttattacaaatctaacatttagcaaacatctgttatacatcaagttgtgtttaccagacaaagtccttgtgctccagaggcttacagtctagtcgagraggcaagagagmaaaacaagacaaatcaaccagtggtagaaaaaatcacaacattcagtagaataacccacaaggctataaaacaagagaaacaagtgaatgacagtttcagctaatttgtcaagaatttttttatagggaagactaaatcttaaggctttccaggtataattggagcgtgtgatgttattaatttatctttggcagtgaaacacatactgaattttcactgaatggcaggacccatactgggtgctatgggaagattgaataagctaaaaccattgcttccatcttcaaggaaataacaattttctgaaagagtgaaaacccatatctaccatttactctcacataacaaaataatgttcacatattcaataatgaatgcaaataataggatgtagaatttaaagacagcatgaatacatgctgaaaatttgaagctggagggaacaacttgtcacatggcagaggttctgaaaccttttagtgacatgtccattggtactaaagaagtcattcagcattatccaattgaagcaaacatattacttttaccatcnatgataaggatgtcctgctatttggttccatgtaatgctatttaatcacttagttcttcctgggaaagtatactgatttctagttttctgtacatctcacctccaatctgtgcttttcctatagtgcttcaacttagtgatttatttttgcatgagaacaaaaygtaggttccttaaagccaagcctggtacaattcccctttttatttcagatcattctgcactctatgcacaaataccagcctcgagttcatgtgattcgcaaagacttcagcagtgacctttcacccactaagcctgttcctgttggggatggggtgaaaacgttcaactttcctgagactgtgttcaccacagttacggcctatcagaatcagcaggtaagaggtggccsttgagagtcttctgctacatctgttttttggtccttctgcataagattccttaggtattatttactttcaggggaatttgacatacaacaacccttagtccactaaatgttaagtactatacagtgttagagttctcagcagctgtaaagtgttttcaacttcagattttccttgtgaatgccacatttgatctaaaatagaagaagagctttagtttggtttgggtgctatttaagaagctattaaaccatctcaaattccttagatagtaaaactgcagaagccatggagggtccatacagaaaactgtaataattaagatttttcaagctctgatacgagatatagcatcaacatagacawggactttggagcaaccagaactttgggattagttctggctcagaagaaggggagtaagagtctgagttctttggataactgattatagactttyctaagaatactccagccaccatttaaaatagttagtttctgatgaaggcagtgatgtgacaataaatatttcaacatcagaatttactttgtagaacactgaagaacaaacattctactgcctcattgagatcagttacagagactaggagagccattattgtaacccaagttgaaactagaaagctacaactcactttgacaatgaaagaggactaagcatgggtttctgacagcctcttcacatcctttaccttcttttatagacagtgttctagcacatgagtacattctactcatagaaatattttgtttacatctgggctgaagtgggagcaggataccatggttaagatcataaaatttggcagcagataaacttggtttgatttctgatcttttcactgacattgtgtggtattaatttctttcaacttgtgtttccggtcttgaaaatgcgcctgcctcgtagagctatgaggactaaataaggaaacgtgtataaattcactgacacaaacctgacatctaattaatagtagtcagcctacattgctccgtggctgggtctgaacaggcatgaaaagyggggcatagaagcaattttaaagaatagattgcttattaaggaaaaagtgcattgttcgaaattggaggagctgcaatggctctcaaaggaattataatccataggtaactactttgatctctctgtcgtcatgtcatattggtgaattcatgatgtgctgacatgcaaaatagatgagtcatactcaattctgcccattttgggatcaagatgacagcttttgcctgtttaacaagcctctaatccctggataaatcaacaagcatgcttatttaacattccctttggctgcrcagatatgatttaatataatacagtaccttctagtaatacaaaataacctcgggtctttcccccaggaatcctgaagtttgcatcctgtaggtcagagctgttacctaactatacttttcggacttgttctgaagatgccaggtagcataaattgttctcttttgtgagctattttcacctcttactgtgtttttattcttcataacattctagaatgagaacaatcagtacgtcaaaattatttacttcatttatttctttttaaggaaacggttaggaggcctgtgaaatagtaaagagaaaaaaatttagtggtaggtccttggtgttcttaggaacttgtttggggaaacactgaagaaaagacaatagagggaatgtaatggaaatggaacattacccagactttctaaggaaaagcagtgtcctgctccacagacagcaatgggctagacatttggagacctgggttttagtcttaaattttctacgagttacacatgttgctctgagcaagttgtgtatttttacaataattgtgcttcagtgcttcagtttcttgtcttagaaaatgaggaattggcctgtgctttacaaggtccctgaaagctctggaattctaatttatccttctttttttctgcatgattttaaatgaggattgggagcaattgttctcaaaccaaggcaatcaacacgattttcaactactgaaaattattagaatgttcatgtctgaaaattgtttttattcaccagataatctttaccaataaatttttagtaagtctacacttgagaggtatgaacatggtgttttgtaaataaaatattccccaagatactgtttatttatgactcttttcaattctcctgttgtttttatttttttgtttgtttgttttttgggacagggtcttgctctgtcactcaggctggagttcagtggtgtgaacatggctcactgcagccctggcctcctgggatcaagccatcctcctgtgtcagctttctgtgtagctgggaccacaggcgggtatcaccatgcccacctaattgttttgatttttttttagagattgcctctcattttgttgcccaggctagtcttgaactcctgggctcaagcaattctcccacctcggcctcccaaagtgttggggttattagtagcattgttaaacctcctgtttctgctaacttccattttgtcacccaggttgaacacctggttgtcacaacatccagtctgtcactaatgtcttttgcttctactgacagaatattttcttctttctaatctgattgattttgcccttgttctgttcctgccttcccccaaccttgggttcttatgatagcttccaattaggtcacttggactgcaagcttaatgtctcacaagccatcctatacatcattgtaaagcccagtgataattgcaccatttctatgccaaaaattgtcaatgactcctcagtgcctagggagtcaagtgctggaccccgagtctttccaataatgtcctctgtggctaatgaccaactacatttctaggctcaatttctgttattcctcctcacacatctgcaagagtgtcgcaatctggtcagatttttactgttgcctgaactttgcagcatccttgcctttgtatgtccctttttcttttccaggaatgcccttcccttttgtttttatttgtcttgattccttctactcttcaaaaattcagtgaaaataccattccctaccacttcctttccttttttcagctgcaaatgagctctccccagttagaactgttaggggactgcactctctcgtgacctcatcacattgraactttggcttgcatgtccaatcttcctcttgatattttgagctttttgagaacaaaagttgtaccttttacaaataaacagtatgatgtagaaaacacgaagttgggagttaggagacttgagttctagacccaactctgcaattgacggactgtactacttttgacaaatcactctaccttagtattctcatttacaaattgatgattttgtctgaatcagtactagtctatggagaagttttttatggtccactgaaaaatgagaaaaataaagaaatatgggkacttttatgaatgtagacattcaatttaatagactattttattttgtctttcctacttttttgatataaaaatgtcacttattttatgaaattatgagacaagagagagtagatagatgttaactgtctccatttggtagaatgaaaaattcggatgtaatgttgattgctcaaataatgggagggggattagaattgacctaaaaaattctgaagcacatttctgtaattctaagatatttgcgtctgacctatattgcatagcactgaatatatatggttggcaaatgactgaaatgaaactgaatgaatgattagccaacatgactctaccactggtttctttatatatctgtggttctgtttctttgggtgtaagtagtagtaaagagagcttttctattttcatggaatatgttatgcttttctttccccattttccattccttccttccatccttgcttactgaccaatagactcttagggctgctagcatactgaagttattattactattattggctctctatgtgccaacttggcaggcctatggcagagagaaaggtgtagcatgcccagaatctcttcaaagagaataaaatggtagatgtgggaataaaggtgactcaacacttcatgctttttcttagaagaatctgatgccaacatatcctcacagaattagcaagaaatttccattgcaaagtctttgtcttctctgggggaaaaagaatgctgaacgttgatttttgttttcgaacaggaaactagatttcaaaaagacatggccttgttttcccaggtaacacagtcttatttcttgatgagaattggctacatgaaccagataggaagttggaaaccacagccaggtttgtgtgagcaaatccaataggatttctgagccactcattatggtctaaactagagagccattttgctggctcaaatcagtgtggaatctttttcatatgggctaaggttttttgttttgttttgttttcccccctatggaaaacctttcaagcaatatagtatgaaataaaaataacgaagagtgttaataagagaaggccccttcagccttcgtgctgtaaaaccatactcaggatattcaagtttcatttccttttcaggttgtgctatttatgtctgcctggtgcactgtgaagtatacctaatttattaactgcctccatgttactaggcaagaagtccgtgacaatgattaacattaatggtggcaagtcggcaaccacccccttatgtgcctcagtgttctataattcaaactacacaaattagtataaggttatggaaataaaatcagtaaagtaaaatgcttttacaacctctgtattttccctgtcttctcattatcactggacaaagtttggacatgtagactagcagacttgttttagtcgcacaggagattactaatagaccttgttctattagtataggatttttgtctctaatgcctccagtgaaagcaratagaatcaagagcattgtttggtctagattctctgaagcttatcatggttttgggactcttgatccctggctctcacatcatcatttattcattcacttgctcattgaataaatattcaatgagcatgtcacactaggttctgcttaattaaatggtatataaaatagacatggttcctacctgtggtccggggggagttacatttagtaaacatgtaaatacaaaaatacatgtgtaattaccaattgtgttaagagcaaagatggaatttaaaaggrtgcagttaagaagagtagcagaagtatcctattttggagagatgatcagagaagatctctctcaggagataatatttttgactgaggcttaggacgaggagtcagctatgtgcaaagtagagaaatgagcatttcaaatttggttgtagagcaaatgtgagtggcctgaacacagaaagagcttggcacattccagaactgggagcatctcagtctggctgagttgctcagtctgtcctgagcctgtggatcaaggcaagggagtgtgaatgggttggagaggcaggccagagtaagggcctgctggctctgcaargctagacaaggaatttggattaaattctgagcggtagtggccactaaagagaatgacatggtccagttacatgttaacgaagaccaaatggggtgctggatagagaagagattgtacagggacgagaatggaagaaaggagttcagttctaaggctacatagaatagttcagtcaagagatgatgatgacatgggctaaggtttctggaatatgtgttattctttcccactttgatattcatgcttacatagggcctttcttttaaaaattttaaattaaattttattttaagttccacgacacatatgcaggatgtgcaggtttgtttcataggtaaatgtgtgccatggtagtgtgctgcacctatcaacccatcacctaggtattaagccccacatgcattagctatttatcctgatgctcttcctctcctgctccctgacaggcctcagtgtgtattgttcccttccctgtgtctatgtgttctcatcattcagctcccacttataagagagaacatgtggtgtttggttttctgttcctgcgttcgwttgcttaggatattggcttccagctccaaccatgttccttccaaggacatgatctcattcctttttatggctgtgtagtattccatgatgtatatgtatcacattttctttatccagtctattattgatgggcattttggttgattccacgtctttgttattgtgaatagtgctacaatgaacatacacatgcatatatctttataatagaagatttctatttatttgggtatatatccagtaataagattgctaggttaaatgctatttctgattctaggtctttgaggaatccctgcactgtcttccacaataattgaactaatttgcattcccactgacagtgaaaagcattcctatttcttcacagccttgccagcatctgttttttcttgatttttatttatttatttttattttttatttctttattttttttggagacagagtcttgctctgtcatccaggctggagtgcagtggtgcaatcgtagctcaccatagctcccacttcctgggttcaagcaattctctcgcctcagcctcccaagtagctgggactacaggtgcacaccaccatgcctaggtaattttttgtatttttaagtagagatggtgtttcatcatgtttcccaggctggtcttgaactcctgagctcaggcaatccatctgcctcggcctcccaaagtatgaggattgcaggcatgagccaccacgcttggcctcttgactttttaataatcgccatttctgactggcgtgagatggtatctcattgtggttttgatttgnatttctctaatgatcagtgatgttgagctttttttcatgtgtttcttggccacataaatgtcttcttttgtgaagtgtctgttcatatcctgtgttacatagtgcctttcttaagaaatgcttcctttgtcctttttccttctcttgtgttttcattaaaatcctacacatctttcaaggcctagctcacatgctgtctctaacatgaaaccccagagcccttcaacatggagtaattcctacttcgtctaagctttcagggtactttgcctttattgtgaactttatgaccttcttttttatattgtaattgttagtgcacatctgcttctttcttctggattataagctccttgaggaaaaatggatgacacacagctatacactggctgtacaccattctgtcacctgtgttgcttgtcacactgctttgcacacagaaggcacttgatgataaatgataagtggcacaaccactctcttcataaagctccctaattctcacattaaaagctttaaaacaagtgtacagatattgtttttttctaacacttgagacatttgctattaaatttccatgcatacccattggcctgggatccaatgagctgtgggaaatatatttttaaccatttcccccgggcccatgaagtagagtgctgttatatttacaggggtctgtggagacccccaaaacatggtatcacagtcatgtgtcagaaatccctatcataaatgagttggacaggataaaccaacttgaaagagaaaataaaatattataactccaacttgaaaagaaaatatggtgcatggtttattgctgtggattatggaggaagaaagaactgattttcggtcaaacacagaaaagcagtgacactctttaaactcaatacagtrttcatatggcagacactcractttagaaagccaaacctttagactcctgctatggtctataaaatacatgtaaaattgcttttgctacattgttrgygctgcataattagtgtgcarttttaaaggcaaggaatatttaggaagaaaataaccttgaagcctggaagactctttcaagtcagagtctgtttgtcagaatctcacattgctttgaaagacctttaaagactgcggtcttgggaaattccactctgataaaatgaggtgaaagagaactaggaaagatttgcaatgtaggaaacaactttagctgtcctagtgatacgttctacaattatcaaaaatatgaagatggtcttaaataatgagattcccttatttctagaatcaccttgcattgggagtgccttccttccttcctgagctccctagcacctatgcctaagtctccattgcttgcatgtagtgagtcattaacaattcagacacaaaggtaccaaggctgaaagtggaaacactagagtgcatgtgacatatgttgttcaggcttgttctagtctacaggcatgagggcaatatatacaaccatggcagggtttgccagaactaagataggatgcaatggatggggacttatgcattgagtgggggttgaaccacatggcccctgaggaccaagctggtgacacaattggatgtgctagcttggtcagccttatgaaactggctctttgtttctgatttgcttgtgagtcttggagactggataacatgtactgcatcctgccccattcagtctcacattgtagattttcctttgggtaagaccctggcaaaagtctgctttttctgtcttctacatgaacatttcaagtcattaaatgaataatttctagtggtaggaaaggcatgccttcagtgaaatggcaaatgcagtcaattttttgggtctttcaggctaaggcagattgtcttgtggtctgattccacctaactgaattgactgagtccattattaattattaactcacttacacatcatttgtttactcactcattcaacaagcattttttaagtgcctcccgtgtgtcatgtaccatggacgtgaccattgaccaattttccatttcaatatctgtctaggcaagtgatttaccaccactctggggcaaggaaggtgagtaggagagagtttttagagtcacatactgggcaaattttagtttttatagagaagtgagtcgggtgggtcagacatctgtgtgccaggccaagttctatatccagyttcawattaaatcttgagctgaaaggaaattaaataaaagcaacaactgttattaaaaaagtgatttttgtaattttctaggagtactaagaaagaaatcagttaatataaaagcaattcatacttatttgtttgtttccagattaccagattaaaaattgaccgaaacccttttgctaaaggattcagagattctgggagaaacaggtaagaatcactggggaagaggcacttcttttctatgtgacattacttccctcacatcctgctgatggttgatggctcctgccttttagaaaacacctgtatgctccgccactgtgtacacttcggcaaagagaaatggatagctaacrtaagaatcaaattctttgttgcatagtctaaatcaccagatcaaatccctcatgctgttttcttccccacatcatatttagtaattgagtcacttaaaacaaattttatggtaatttattatcattaaaagattgccatttttctctgataagtatctataggtggcttcagcacctgcagtgatatctcatatatttctcattcccaggaaacaaggagttgtagacaaataacattttttcagaaaattactaccttaagagctaaaacagtgtgaaaaaaaatgtaactgtttttctcctgggaaatagttccaaaatatatcagatgcttcctgctttagaaaagagagtttayagaacacccctttcttgatgacttagcctcagtcaytatgactaggttattatatagtgaatctcttattgctgaagtttataggaccatttgctcctgctataaatgtccttagagactgtgtcatttctcttgttgatacttctttcttttctcgaaattctttctcactcctcctatataaaattaaaagctgttacctatggaaagttaggagagaatcaaaatgggtagggaaacyagctatatctaagattattcaatcagaaaatttcatcttgtatagacagtattgaatccacaaatgtgacacatctgtctcataagtgcgtaggctttgcaatgactgtttattttaatagattttttttttttatartttgagggcatttatttacattcaaatgacagattaccaggggttatctttggtattctgtctgtaagaattttcaaataaaccaaaaacttttatttcaaaccattttgtgaaatgtgcagtacattatattaaaatccagatttatgctaaaaatcagttatggcaatcattttctttacaaaatgacttatgaatcacttctctactaaacttatgtatatttaaaatatatttagatttgaataaaatggtattcacctcagaatttttaaaaattgtatgtactgagaaaagtaaaaatcactcaaaattccagcttgtagacaacaaaattgagcaatatatttttggtcaagcaactacttgttagtggtagagcgtagtagaactcaggcwtatggactacatgtcaaatgctctccttttgatcattctttgtttataacaagacaaaggccgtcattttcaaaatttagccagtgaggaatgaatacctactactttcatttcagatggcccatcctcttccttcccattagcttattttacatgtccaggtcagcagaatgtgcttgcaagccatttcctattgcctttttttccaaggttctgcactatgggctaacagaagaccttgttagtgataaggagatcaaaaatgaagctagccttttgtaaagaagcctctagacctgtcttggtggtgattctttggggcaggactttcatgacaggctatttctggaggtaggccatggcatgcaagggcttttaagaccttcagcttgaagtacatggatagatttttcaggggttccagatattgtaggtaaaattgtgtttgaatgaatagatgcacatttttcctggagagaggtctatatctttcttcagattttcaaaaaagtcttaaagttaagaatttctgctctagatacaactctctctctctctcaagggttccaacctactggtgttagttattaaactatttctttctttttccttccttctgtatctccaatagcatttagtatttgcttattttattcttggcacttgaaatattttattttctttgcttttttctcccatttgagtcattgtttttctgagtttttattcgtttttctaaagttgaatttgatttctaaataagtgctttcctatgagcagccaccctatccttggaaattgccatctgaacatactttaaccatttattgtctgcactgcaaaggcatcaagaaatatgtatgtcaattattgataaatgcaaagaagaaacataaatcagattaagaggtagagtgagagtggaagacacttttacagtgtgaatagggatggtgtcctgataagatgccatgaatgttgcaaaagaagctaccaactatgcactctgggcagtagaaacagcaagtgcaaagacagacgtgtgccaggcatgtctgtgcaacatcaaggaggccctgtggctacaaggcgtgacccctgcccaggaacatgactgagtatcatgagaatgaaggtgctgaggcatgatttagaacagaaaagtaggctagataagctagtgttgaccagcattagatctatgttgtaggaattagagccactctttaactttgagaattrgactgttgcatcttgaaggatttgcttttggttaggaattgtgatgacatctcagttcaagtgctgaggccctcgttcctctactggcctgaaggctggtgactgtcttactgctcagggcagacagttatgtgtgtgtccttcctaatgggctctattctctctaagggattcaggaaagcagaactatggatcttcgttaatccatttcacagcattatttatttattcttttctgataccatgggaattcttcattatgttccatcaaaatctgagggctactttaagtactatcagaaattttatcagttaacttactgtgttccagacctttaattaygctttctctaatcttcaaaacaactcgtattttacaaatgaagcaattgaggctcagagaggttaggcagttttcctactgtcacaaagtaaagctggagcaggtattaaaaccgactctgcctgacttcaaagcctgaatggtttgtgctttatcatgctaacagtttacacttgacttattttatcttcaacagatattgagaacagaattctaactctaaaaggcagaatcctacctcttaatctgtgtaaaaacactattcaagtcacctagcacctttgcttttccaagtaaatcaaactgtatattctcagtttgtcttcgtagtctactccccatgacttctttatcaactttctatccccatgtaagtaagtgttttcctagtagagaacaggaagccagcctgaccttccctagcaggtgaaactatgatataatgacattgaagtcatgtgtctcatgatggggcaaggatgaattactaaagatagaagccatttttgtccttcagcattctggaaaactagattaaaataaattgctacggcaagtaaggggrcccttgtatttttctctttaaatatctcaaaattacctgataatcacactttaattctcactggctacccacaggatctgataagggcaacaattattaatgccaccttgcaggtgggaaatattgatagatgaggatacagagaattatttgcaaatcttctgggaactggtggttctgtgccagaatcaggacccagttcaccaccttccatcaagcacctcatctattgcccttctgtggtaaaacaacaacaacaacaacaacaacaaaaatcttgtaaatctaagatcttccccatgcattttagacatcaagtgactactcatgcagaggagcatggtttgatgagttgcatgtaaatgtacccaaaacatacggattacatttcctttaaacacacatgggcttaaaaattaggagggaaagtgcttgtccaatgttttttggttttgcagaacacaaaacatttgtggaagactttggagttacagagtttgccaaacctcaaaccaaaacatgttcaggtttgtcaatctcaatccntcctagtacaatccagaggctcaagaagaggggaatgagaggaaagatggggaggacacagccacccacnacactctcctcaaatgcctatgagagtctctctcagcccataagcctctcacactcagaaccatccgagtgtagccccctggctgacaactatgtcctccgaagcatagaaaagagtgcttgagggacctgtggctgagcatactagcttcccatttttcatatgttgatgtaaagagacatctggccgggtgcggtggctcatgcctgtaatcccagcactttgggaggccgaggtgggtggatcacgaggtcaggagtttcagaccagcctggccaacgtgrtgaaaccttgtctctagtaaaaatacaaaaattagccgggcatggtggcgcgtgcctgtaatcccagctactgggggcgctgaggcaggaggattgcttgaatctgggaggtggaggttgcagtgagccgaaatcatgccactgcacttcagcctgggcaacggagcgagactccgtctcaaagaagaaaaagaaaacaaacaaacaaacaacaacaacaacaacaacaaaacagagatatccatggagaagtcctcctggcttccagccccatccctttctcattcctctcaatgggaaccagaatgactgatctgattcatgagtctggaggaaggaaccccccagattcttgcctgcttgcctgcagaacatacattcccagctgtcttttcattatgtggaaagtctagcagaggaggcctacatttctggggcatcagcttatttcagaggagttcaagccagctcattcagccttctcgcttatgccacaacccccaaacacctttatctatagtaaaaatggtattctggtctccatggcattaggctcctgtgccttccacagaatagattctgagcttgggtgaaacaagaggtgatattcattggactgtgtaagaccccaaggggagccccagtgagtccacatttcagtcctgtggtgccaccatcattagagcctattgtagttctccctgcttctttaggaagtgtcaggtgagaagcataggaaggtctccacccttcagacttgacttatggaactgctactttccattaccaagtaattaagcccctgatgagaagtcttcactgggagcatgcatgcatgtgtgtgtgtgtgtgtgtgtgtgaatgttgagtgtgcgtatgtgtaagtaaacctgtatatgtgtgagtgtgtgtctatgtgtgtatgtataaatattgtaagtattcatatatgtgtgaatgtgtgtgtgtgtgcaagtataagtatacctatatatgtgtgagtgtgtgtgtgtgtgtgagagagagagagagagacaggagtaggtgtacgtgtgtgttcacgtcgtggggaagcatagcagatggccatttattctggagtgaaatcactgacagattttgcttccaggcattgtctctgcaataggagggaaattgttttattttcttttttctaagttgtttctacttctagatttcttagaaattgtgtggcccaaatctggttttgggtgtgtgtgtgggatgggggcagtgttcacctattatcaggcctgtagctgtcaggcacaatatccagggttgcctctgggagatttctcttacttggggagacagtaacacttgcctgttttcagggagaaatagcttttctcagcttgagatttttttttttttttttggtcttgtgctctgtgttcctgggctctgccccctactagaatataagctcctggaagactgggactgtacctattgcaggtttctgttcttgtattttttttccatggtgccaggaatagagaataaaacaataatttttcatttagctacaaaacagtaaaaaggtgttgatgaatggcacagaaattaaaaatcaggagctctagagaaagaaagccctatcccagccagggggaaatcaggtaggtcagcagtgaggagctagttttgaacaccacataaggagggaagaaggagcaaatctctaaataggcttagtttaaagattaatggcaattgtgattaaaatcggagactgatcactgctgtaagacattgatttagcctaactgtagattagacacacacacccttgagaccctctgatctggctctgggtagctggggcatgtctgtgtgttctggctccctggagaaagatacctagcaattttcagtgcctgcgagcttcaggaaagaagtggttcccagagactgagctaaagcagaatgaggtttggttgagaaaggacacccagtagtgaaccaagaggtaaaattatgtctttgaggttggccaccccaatggggaacctgcaccaaggagaagacaaagatcctgaagctaaagaggagcaagagtctttgcactgggtctaattgttgagaagcacctatgggaggtgcatgtgcacacatacctggagagtccactgtgctcagctagagggagcatgacaactgccaagaccctgcacatgaaagagataaccaaagaagtggaaagaaagagactgcatctttcatcccacatctgatgtgaaaacttcttcctatcaagccatccttgatagggtggctgccaagattttacagaaagcacaagtcagcttggaaaattttatataataattctcagggacttcctccaaagcaaacacatacataaaaatgagattattaaggttgtggtctgtctgagtagtgaagggttctatgaacttgtcttaaaagtgctatggagtgaaagactctgggatttcctctgacggagccttcatcctgtctgtgaccttgggctttacccttactcctagcctccattgcatctagtacagctgcaggtgggactgtcccatctgacacagtttcctccagatatttccagctggtatggcaccccaaagccactgctgttggtcccatgatagggcccaagtggaatggcccttctgtagyccagggaattggtacaactttttaggagggtatgtttttctctttcgaatccaccattggaagcctgagccagaaactcaaattctataacttagaaactgtcagaaaggagccagtggcaggctctgtatcacaaggaagttgttttatatgggtaagtagttttaatgaattgcccctcactgaagaaacaatagggcttgcaggatgaggtgcaagaagaaatctgagtctcagttcattcttggagtgtttgcagccagcagtgctgtttgctgggaatgtggctggtggcagtccttcttggtgcctagtgtccttttacataacatgtcagaggatgctgatctaagactggtgccactcactgcattacgggaatggatatatttgctcactgaaagagaatgtttaatgaggttgatacttaacctgagagaaataatttctgtctaggggaggtggagaaaatatctgggagtaaagaactttcccatgaccccctcttcagcagctgctgtcccatggccatgtttataaagaaccacctctcttgggcacaaataggcgtcccctgttggagggccagccccttctcacaacacccartggaaggtggaatgtaagatgaggaatcaaagtgcctaatattagcagaaggaaaagaagggacgaggaaaagtaggctagaaattaatcccagggccagtttgtttttgctgaaatctgaaacaacttgtcattgggggtgggaggagaaagggtatacagaggatctcngttaaaatttgctaatagagctctctattatarccaagtaactcaaatcttatctatacctttatctattaagttaaacatagaaaattactgtatttataggtcaaaaatggcaaaatgctagcaatttcatacagtttaacctcatatatttattgttagccattcaaatcataagtatacaagcaatagtaacaattatttcacagagtatctgtggtccaagttgtccatttttatctccaagttgatgacgtcaatgcactatttcccattttactgatggtaagactgaacaccatgaggtattagctttcagaatttgtaaatccagctaatgacagtgtacagagaatggtttcactctcttctgctaggcatagcttgctagttaacagaaattgtatctttgtccacctctggctccctgtcactcctgaagactcatgtagtgagcttagagccagtgaactgaccacttgtctttaattcaaccagcatgacatctcaagtgtctatctcactttcaatttctatattttcatttggtttccctaaagccattgggtatatttgtccagccaatctctttctactcttycctggcactcttaccagcccccnaaaattttgcaaacccttttgttatccctggcatgggtggcttatgccatttagcagatctatggaagtaatcagtgctggacactccagcaggcactactgcatctacaattcaaggtagctggccctgtgctggattctggcagatgatccagctggactcctgcttttcatgcaggccatagctgtttatcatattctttggcttgtagtcttttatccagtacttaacattttttctgccttatttgttcrccctcccttgtcatgagccttttccaccattgtcctcttggctgtgtggccttgccagagaaaattggcgatcattttgttatctgtggcttttgcccagggatggtgtcatcgaacagagagacgtctttttaatggctaacatattggagtctgaaatatctgcaagataatgaggcctagagggacttgagggacacgtttttgtttctttgagaagacaacgaaaaatggaattaggtaccatacagctccctccacatttaatccagagccagagggctgacagaactttggatttcagtgaagtaagagtatattcttctattataggttacagtctgaggagaatgattgtaattcttttgcttgagttagaccaatggtcctcaaactttcattatgttttctctctttttttgatacattttgtctttaatcagtctgcatttattaaatcacagttaggaggaagtattatgattatctccattttacagataggcagacttagaaatgaagaggttatataacttggcaaaggttgtactaatagtcagcagggtagcagtttgaagccaggtaatctagccccagagcctgtgctcttaaccattwtgctattttgtccctcatgtgattttagcattactgaattaaagttagacaatttcagtcaaatgcaaagaaacttaatattctagttagccaactttgtatgatcatgggttattactacacttattgagtcaatgaaaactctttatggactgccattactgctgattcatactccaagggaggacagggttcttaagttgggaatcacttggtaaggagcaattttaactcaactccaggcatctgtccattggacacttgttctcccaaaccattgcaaggcacattaatgacagctacttcatcatgtagatatacttatggtactatttaacaccaagttttgaatgatggttaggtttttagtcaatttgcacacctctgctgggaggtcttttagaatatccctggacaataacattcctgagtaatctggatattttgatctgagtaattctatttcagatccagtgaaggagaaagaagtatggaaggtttggccttacctaaaccaagcaagaaaatctatgaatgttgagatgtgataattatatctgaaggaacagtatattctagttatatgtcctttcaaatactagaagggaaaagaaaggggatcagaggcatagcaccacccatgggacaaaatctaagcacctgtcatggaataaatgctcatggtgtctactgcccttctcccattctgtaccctaggctccagtcaccctgaactatgtccccaaaacatgccttctcttgcatacctccaagtctttgcacatactgttaagtctactagaaaaacttttactgactcttttctggatggaaaactgctgattactctttaatagtaagcttaaataactggccttttgtggaatcttccttgactttttcaggtatattaagtgattcttgcccaatattccatggcatcttggcatacatgccttcagtgtaacatttactgcatagttcagaaactagtcatttatatcttgttccttttttaaaaaacaagacagtcataaagggtagagaccctgtgtcttttctgtctttatatttcctgaacttagtattataagtatttttttctggttggataattctcttattacttcaagacctctgtctcagtaggcttcccttagtccttttccatcttctactgagaagaccaatggccttatcaacctatagcatacgttgtctttgttaccagtgtcaccagcaaatagtatggggaagagtaaaaattaaggaagtcagaactaaagagaaaataaacaaaggaaacattaaaaagcaactccctatctcaagacaaaagaaaagcagaaatatgcattggagtgctaccaagtagggtcatgaaatttattataattattgttgtacttatcaaatatttgctgaactttgaaggaatgataytgccatcttttttggattgaaaatgttgcaaggatgtttttttctgtagtctgactatttttccaaataaattgatttcaagccatcatcaatttgcaaaagaggtccttggcttgctttctcttcttcctctttctccttctcttcagcacattctgttggtttggctagtgagcagcctgaaaagcctaaagagaagaggcctggaaaccggagaggtgattacagccaaagcactgaacaaaggtggtttggatacggcctatgttgtcaatggagctaacagggaaaaaatgagcaagagggggacacttgccaacttgaccgtctctgattggaaatctcagagatgacatcaggtctctgctgttcagcagacctgagaggctcaccatgtggaacacgttaatggcataccattacctaggactgcttttttcacccgttagacaatgaattcacttttaaaaacttggagataaaattttacaaaactagagtaaaatgatgacaaatgagtaaacaatgtgtagcacagggtaaattttgactagacatccaactggctgaagacgttaataggtggttggcaagaactctcaaaagaaaagatgggaggtgaaatgactcacccctgcaagggaactcagactctgctgaagctcagaagttctatggctggaatggaaaaagacaaggaaaatgcaaacctctctgaacctgaagttaataaaggcacaatcgcaatcagctatagaaacaattcccaaatctctaatactggaggatstcttctgtcttcagatactttattttacaccaagttgtgttcctaagttttaggcttagaaaaatgaatgcttgttaaagtgtaagaatgactcagcaataaagcattcattcttctacttattaattcaatgcatatcatttgagatcttatcctgtaaccagcactgtgctagaaaactgggcatagaagaacatgggacctaagcccttgagatgcgaccatactagtggtggagagaggtgaattgtttaatcttgccatggcactacaccaaatattgatatatagaactagtaccttctaataattagatctatccaatgaagcataatagggttgaggacaaataaaacaggtagaatatggtaaataaataggattaatttttctaaaaagcaatacacactgaatacataaataaaatcaataatataaatctatgagaccaatattattctctgtaggataatatatattataggatcatttctattatakaataatttatatatatgctatgtaggatatatttataagacatagatccactgtggattaataagacatggttaggcatgtatggtcttagccattatttttttgggagccataaccctccccacacaattccactaccaaactgatccttgctgtaacagacccctggatggattacatatgtgtccataggtggcatgttgttctttatgttcgttagctaaggaaggtctccctgctgaggatgtggcaggtggactccttgtgggaaatgcctgtcactctcactatttacttattggtaatggaaccagagggtgaaagttatatcagatcaatcaaaaaactgaaaattttcctggggatatatatataccaacagaggtggataaccattcaagatggtgtcataagagttatagtagatgacatccaagattcttcctagatttaaaatatgtgattttacaactcagttcttttatttggattttagatttgaattcatgagtaaatagtcactattctatatagagttaactgcttaaataaaataaaactattaacacttttgtcacagtcttcttgcctattatgaaaatgaaactgctatggtttgaatatgtcccccaaagtttatgtgttccaaacttaatctgcaataaaacagtgttaagagatgggacctttaagaggtgattaggctctgagagctgtgccccatgaatggctaattaacacaggagtgtgttcctgatgaaagaataagtttggtgcctttctctcttgctcttgccctctcttgaccttccatctttcaccatgtatgactcagcacaaaggcccctaccaggtgccagcaccttgctcttggacttctcagcctccagaactgtgagccaaataaactttattgtttataaattacctagcatatggtaggttatagcagcacaaaatgaactaggatagaaaatgaagttcattttctatttattcaacaaataaaatattggcagtgtatcagtatattattgcaatttcatagtcttccagcacttcattatgaactgagaagggactgttctttgtccttgagctaatattttgtcctcatcatcagtacatgttcctgggaagaatgaactaggaggtggaacaataaagactctgccattttcagtgagcctcctgtgccattaaagggaatcctaagatattctggtgggtggccaacattccaaaacaaagcagtaagacctaagcctggcctatctatttcttctatccatccaggctcagtgtggctttatctgcctatccccttattattctgaactccctaattgcctgggctctttctctccacaaatagtttcatgtactgtattcaacattaatgtagagtgactatgtggagatgtctcctattcctacttctaacagattaacagctaataaacaccatgtaacactctcttctctgaacctcttcttaaaatacagagtttggtttgccaacattggtgtatttaaagcctccaagattccagggaagactttagaaagttaactgtgcaagtgaggcctgttcagagaggaaattttccaacacaaagagtcaatcagcgtatcagcagctcatctgagaagaacctcagggtatcctatagttgttgataagtaaaggatatttgttctcacctaaaataaaatttctttattcttgttgtgtaaggctgaagagaactctggaaatacattaccaagaaagaaacacaggcagcagaagtttcatctcaaaaggggaagctaatccatttcaggaagggatgccataccacccaccttccagtgaccttgcaatgaaaagatttatgccatctgctctttcctattctcctcccacctttctcacaggtcccacacttctcctctctctgtttagttaagtgaagcagttttttttttaaagaaagatcaataattagaagctgtgttcaaagcttcaaacaaagccccagctgatattttgttttgagggtatggatatcatcaagaatatgtctgagataatctcaataatcatgtgaaaatgatgtatatcagcacttgcatatgtgttagagacatagttaattgaagggtaaaaagacagtatgcacatagtccaatttatggaatttccaatacaaatgaaccaggagccttaaaggaatgtactcgtaaaatgttggatacttcctgaactctgacagtttgtgatggccaaagaccagactgattattaggttactaaaatgcagatgaatatttggagaaatgtattagtctttttgcctgagccataatttttgagaccaagccctttctttatcttcaggtaggtgtttcttattgcagcagaaacccaagtctatttcactgcttacctctccttttatttctgttgccctattcatctctgttgatttaagaagcctttaaaaccacagcagtttgacagttccattcgttctgtacatacccaaggtgaggagttgactctcggtcaggctgtgtcagtgcagtgtggtaatgatgacgacattgttctgtgctagagaagcagtcaatgttactttctgcacaactgtactcatgatattagtggccttgacctttaatacttaccatgcttttttgcctgcagacctagcctcatttaaaggagggtcagaataaaattccatcatagttgtagatttgcttgcaaatgatctgaattgggttaatttgttattccccctgcagtccagcatcattgtaccttgagttttttcacccgaatttaccttgatggtggtagcttagtatctatgtttttattacctgtttgacagtccacctctggatctctgaaaagtcaatgcatttcttgaaattatttatgacttcctttgctggcttttctcttgtcagaactggacttgaagccatcatggagacatatgcattctggagacctcctgtgcgcacactcaccttcgaagacttcaccaccatgcagaagcagcaaggtaaagccctggagcaaggcctctgcttagtgatagggccagggacagagtgggagctcaaccgaatatagcacatctggcctcaggccaagatatgggttataccaattctcctggaatgaagagaactcaggagctctgtaaataaccaaagcatcaccacttgggtaaacaagctggtccaaaggcagcatttcatctggcactcaaaatgctctctcccttcctaagagtgcagttatatatttataatgatgatgatattattattaatattgctaagcattcacatatgccttggtatttgaagagatttttttaataacttcatttattcctcatggtagccttctcagttttcttagaataagaaaagtttcgtgatgagcaaaatcttagctctggacaatgggaataaattgtatcaggtctccaggtgaggaatgggctgctgcaagcctatctggaccttgcaacttgtgttctttccttttttgcttatataaaacaacacccctctcagttggtggaataagtagactttcccccctactgctttgaactttgtgctttttatccaatttataatttttctttcctcgcagctcaggttgggaaacctgtggccagatgggttgtgacttatttcaaattttctcagtcttgtctgtagctttcccaggcatagcacccatatattatatttaacttacccttttcaggggagcttctaacattttgcacactgaattaggtttgtaacctaaattgctgaaatctgtcaggttttaagatgagtgtagtgattaaaagcatagactctggagttagactaggtctaggctaggctcttatcactgatcctttctagctttgtgaccttggtcaagtccctcaacttttctgacacccagttttatcgtctgcattatttggaaaagtagaatcaaatagaattcttgaattaaatgagatagtgcatttaaaatcatagtaagcatttaatacaactagttatcattgtcttcatcatcctcattatcttcaccttcaaggcccttatgtccctgtatgtagacacttaagcaaagttgtgtcaggaccaaggaatattgcctttctgacgattaattatttaaaacatgattagactattcattttcacagcgatctggtgaagtaagtgatccagaatttccatctcttttatatattcctccctacaaagctgtgattagaagcagagtcaatagttattcaaggtgtcaccatggctttgaggccctcacggatggccattaagagacaggggcttaaagagactcaggaaaatctaggcccccgtctttgatggtcatgaattctctacattgaggcaatttacttctattcctgcatgccagtattctcacctacaaaagagggataattttttggtgtgaggaaatttatataaacatgctgtgtatacaaaaatgtgtcattgatttgatttagttctctggtggcttctttgcttctctgcccttgctttactcattgcctttccaagctctagctaagcaggagtttgtatcatggaggctggtcggagaaggttggcagggatattgccagttccagagggcaggcattaatggcaacaattgtgttcaatgctgtatccccaagatctactacagggcctggcacccagtangtacccaatgaatagtgaatgggatcacttgctggcactgtggctcaggtgggcagagccactctcaaacttcttcttggagcacaaccacctaatatgtatgtagacattgataaggagtgatcattgagggacgccattgggcaggcacagacacaggaagcttgcatgggttacttagatgtgcagcatagcaggcttcatggtacttatactaaaaatttaccagtatgaagggttattattgacattttgaaaacaatggtttcaaataaactgaactttcaaaacrcttcagtgaccctcacttttatcggaagagaagaaagaacttgaattattggatacatatggtgatgggatggggttagagaaaaagccaggactctattaaatagtttaattggaatatatttttgaaatatccattgaagttgatccagattctcattattaaaaaatatgtggcttggtttcttgacgttaacaaaggatgtaaaaccaacaacacccatcccctcttcccttaagaactaagagtttcagtgactctggacagtatcatgaatgaagagaagagacacagccatgcatgctgaactgctttgcatcttagaaggaatagagaggaatgagcttctagtggaaactgcagtggtaggctattttttacagcaattcccttttaatgaggtgagtattggcagtgtttgcaccaaacctaagattggtgccaaatagtgactgacttatccaattgtccatattacctcattgtttcagcatatgagtatctgtcatgtcacatagcagtcctagacagttttgtgctgctactggtgagggtggatctgtctttctgcatagatgaggttaagaatgcttttttcatcctgccttggctgccatcttttatttctcttgtcattaagactcatctgctgataaaactttgaagaaagcacttaggtaaattctccacagttttgcaaaaatttaagtctttttatttttaaaatcacattgaatggagtattgtaaatagttgtttaaggagaagaatgcatgagattcattatcttctgcctttgacacaaaaaagaaactgaggcatgacacagtctagtacaggggtgtccagtgttttggcttccttgcaccacattggaagaagaaaaatcgtcttgggccacacatgaaatatactaaaactaatgatagccgaggagctaaaaaaactacaaaaaatctcataatgttttaagaaagtttacaaatttgtgttgagctgcattcaaagctattcttggctgcatgcagcccttgggccatgggttggacaagtctggtctagtatcatatctgtagttaagtggtggcagagctaagttcagagtaccaacgcagatctcttatttgacaggacagtttcctttccaccaggttacattatttttcttattctttcttactacagctttaattttccacaaagattttagtttgctcttcctattgatggtttttattgttcaacaacttgagcattaactctcaataggtcaattttttttttataagtcaagtatatggtcttcagatgtcttcagttagactcaagggtgtttatgtgtttggagagtccagagaggctggaggttctggagatgaagattctacctcaggaatggcttttgcctgaacactgctagtgacaaggagcaaatgaactaaccaggcaagttatgcttggagaaagtgactgaggaaatataaacatagaaggaaaaggaaataagagtccaggtcagttataactaaatacaatgcaatcctgttgttgttctgatggatatacttgaataaaatctgtgcctcaacttcctcatgtatataatggagctatttgagtggccaaaaccgagagctttatcagcagtgacttcaagctatttgataactgttgttctaaaaggaatcattctggaccaatgacaccagaactgccaactttccatctgtggacatgaggggatccaccatttacaaaagctctccattccccaagagagttggtggacatcactaccgagttcagtaccattgggtgtttcagtgtttgtcaggcagttaaagagttaggattatgagggtctctgttgatgattgaattttcatcagtttgacttgtattagttgaggttggttagtgagagggatcagctaccgatcaagtcatacaagtaagatactgggaaagaaggacaatttagtggacatgagccattgaactatgacgtcactgtaatgatnaaaacatagctgatttatacagatctcatttatcactgaggtgaggaataatgcccatacgtatggcttatcacatagaattttttttaaagcactccctttttagctataggagagcaatatcctaattctgcactataatcatgaagagctcctgatagggggtagggagcatctcaattcaatccattaaaacaaacagtaattgattacatattttgttttgtccccgaagttccttatgctcagcatgtccaaaactgagttatcatctacctcacagcctggtgccctctccatggggaaggagaacacttgatatcccggaagtttccctccctgccctacccccatgcncaaccattactaagttcttaaatctgtccacatctctaaccttccttgttaccatgccactctgcactgacgtcacctctcactgcatgaccttaatgtcttccatagtttctacattttcttccaagccattcctcatgtagaaatgagaatcatttttttcaaaacacacatctttgcacctcaaccttctatctccagtctgcttaaagctgctcaatggccacagtttactttcacctatgaaagacatattccttaacattgtcgctagaccttgcatgttctggcttttgctgcctcacctctaaaatagggataacaacaatgaggattaatgaatgtaaagtgcttaggaaagagcctaggatttactgagtgttcaaaaatgttctctatgatcatcctcattattgctattattactactctagcttcagcctatatcacctcccctcgttctctctgttgtttcagcatcactcatcttacttccctttctcaaacatggtgtgctctttcctgccacgttgttctctttctctggaaggctccttgctacccacttgccttcttagtgcttagtgctatctgtctttgagatcacagcttaaatatgacttccttggggaaattccctgccatccagagtaggccaagtatccttaaggtgagctcttgtttatttgtgtcattctttcattaatgtctcttatccacatttttctcactatttttttcccgcatgattaaatccctggatccaaacactccctgttggttgagtgtatatttagtactcaaatagtgattgaataagtgaataaactctgctaggttctgtatcatagggactaatgtcaatgtgtttggcaaacattaaccagagacaactttaggataaaatttgaagggcatgatgattagaaaagaaaaaagaagaaaataagttttgtaaaggatagtgaagaaagtactcaaaattcttttattttccttccttccctccctccctttctttctttctttttctttctctctctctttctttctttctttccttccttccttcctttctttctttccttccttccttctttccttccttccttccttccatctttctttccttctttctttctttctttctttctttctttctttctttctttccttccttccttccttcctttctttccttccttccttctttccttccttccttccttccatctttctttccttcttcctttctttctttctttctttctttctttctttctttctttctttctttctttccttccttccttccttccttccttctttcttctttctttctttccttccttccttccttccttccttccttccttccttccttccttcttcctttctttcttcctttctttctttcttttcaacagagttttgccctgtcacccaggctggagtgcagtggtaccatctcggctcactgtaacctctgcctcctgggttcaaacaattctcctgcctcagcctcctgagtagctgggactacaggtgcacaccaccatgcctggctaatttttgtattttttgtagagacgtggtttcaccatgctggccatgctgaaactggtctcaaactcctgacctgaagtgatttgcccactttggcctcccaaagtgctgggattacaggcatgagtcaccacacctggcccccaaaattcttaagtgaagataacaacatagtaagttgggaacaattatttatggtctcaggaatccatatgtcagtgcgtataatatgaggagtgagtaaaatgaccttgaagctttaacattaagaagtaagagtcacttgttcactcatgcagtcaattaacattagcatttctcatgctgtcgtgggtaatgttaagtcttcttgggacagaaataatgacaagaatagtaaattaaagtgatacactttgaaagaaataaacccagtaggagaaaaaacatgagtattactgttagagaagactacaaacttcacttaattctgggcatcctaatgttattcccacaagatcacaccattgtttttcctgcttttatttatatattcttccttttatgtcttatctaactgcatttcacaaacctatcagagaatggccactttgactttgatgtctttagacactcctcttttatcttcttaccatttgtggggttgtaattggtttttgaaattacctttttgtttagatttgtgcatttctttctactgaacttttagaaaacttaaaaaaagaaaacagcagctgttgtttttctattctgtacattatcttccttatttgccaatttgccagggacactaatatgaaaaaatcatcttgaaaagttnccagcatttttacttcattgtttagcctgttcttattgatcagaatgaggccagcaaccatttaagagattatgtatttttctaaagtaaagtcactatcttattagatattttttttacagagctagatgtctatttacgtagctgaaatcccttgttcctactcataggtaatttatcatgtcttaggaaggaatcatccatagcttccatttgacaaagtggttcatagtctagtcctaccattctcatttttatttctctctcttccagctttatcttaatattcctaccccttcagattcatagtggaattacctatagaattagggatgtatatcaattaggattcttactgttgtaaataaaataaaacccaaatggcaaagcaaaaaagaaactcattgggtcatgaaactgaaatgactcaaataggcagttttaggcaaagcttaatgtaggcacccataaaagatcatcaactccatttctcaactttgctctctatcatcctgactttattctcagtttccccatggtataaacatgcttaccagaacccctggccctacatattttgaggtttaaatctgatgggaaaaggcatgtacctttctcctaagatttctaccaaaatctcattgagtataattgtctttaattgagtcatctccattttaattactgtggtaggggggaatatgatgctttgattgtccaggcctgagtcacatgccttccctgaaggtagggctaaggcagtgagagtgggagaaagtgtgtaatagtgggaaaactagatactgttgccagaaagaagcagatgaattctaaatgaagataacagatgcatgctgcagcaaggaaggcagtaaaacaagtaggggagaaaacaattaagttaatggaaagtgaagaaatgctgcagtccacctaaggaatgtggtagatacaaaataggaccatctaagaagcggagacactcagagcacagagtaccaatgtgcaaaatgagaattggatgaatatattcaaagcaattttaaagagaaggagtttaggtctgtgcatacctttaacttttatggagaatgattcactaggagtctttctaagattgaaaccacgcaattcctattagcactctaatgttcatgtttgcattatgaggatggtactcatctcaactaagtaattcttttgttgagatgaacagtgctgtgctcattaaactttacgatctctgggtttattctctgggatcagtctatagggtgctgatattttaccttttacctgtttgaaagcctcaaagaagacttctcaaggatacacagtgaatcagcactcctcagagacagatgccattgaattatacgagagaagagtctggctcatggaacgaagtaattacatggaaatttattctttactagcctagatggggttttgccttactgtttttcaattttgggggaggagggagaaaagcacagcaaaataaattgaaaaagaaactgtatgtgaaagcccttatattacaatctggaaatgatcaatttagagatgcaaaagtcagcaggtttagtattcaggattttcatggtcacgtttaacttgtctttatggtaaaaacaagtatattctaggttattgtcctcatacggaattactgctaaacgtatcctttttggttattttggccattagccttggatattggagcaatttaatgtcatatatgaattttcatgtgtgtcacctcatattggcccatgggtaaaataggatgaagggagctggtgctgtaggagattgatcctacagatcctacagatgctacagaactcctgaaagttttaagctacttagggcattatattttaatcacttctcagaagtgaattaagacctctaaggatagtgggaaaaacaccagtctagctatttgtgttctgtcaatcccactttgcttcatttgaggaaagatggagacacgggcagccattcttgtcctgaactggaagtgagggaggagggacagataattcagagaggaaccagagttaggttagcctttgggaatatggcacaggtagggccttagctgctacctggcctagtgctccatcattcacagtgatggaggttcctctagcatgtacaacaaacatgtagctgttgtgacataatgctcatcagggtggggagaggccaagatgcttagctccacagacagaggccaacaccgcagagccattctcattagaacccaagttcctttctccttccttcactcttctctcatagaagagaatagttaatgcttttgtgctgggctaggtgcagtggctcacgcctgtaatcccaatgctttgaggctgagacaggaggatttcttgagcccaggagtttaagaccagcctgagcaacatagtgagaccctatctctactaaattttttttttttaaattaatgcctatgtgccagatacagttatgagcactttgtaatgtatactattatatcttacctatttctcaaaacatctctacaaaatagatattggcaattccttaaaatgtaaaaggcttggagttgctaacttgctaaggttctgtccttaatcagtaagacatctgggattggaactgggwtttttggaccctatagaacacactcatccattaaataaaatttctgtcaagatgctcagagcactcgggacctggcaggtacagaggggaggagggcacagggaagagagtcatgctttgctttgagaggcagctctgaccctcctgtatcagtatggcctggcctggactggtgtcccaccctgccctagcttttctgtgatgagaatctctagtcagccaagtgttgtaaatgatcaaagaggatgggctccctctttgtgctcattttgcacttggctggaaattccaatcttgtttaacattcgacaagctgttagatcataggaggagaaagacttgtcagtatctcggtttgttctctgcaaaatgaataccatagtcttctctttctatgggaactttgaaaaattgctgttatctgtattgagtactttatgttcacaagagcatttcttcaaagtgcatggaagcaaggtgaccttttcttggacagccttgcccctgcctccttcaaacactagttcatatggaggcttcacccactcaagctcagcaggccaccaagtctcatttccagtgaatgtcatttaaaagcccaagcaagctgactacaaactttttaacatttgcctctcatctggtcagcagaaatccctgtaacttgttaatagttccaccccccaccttttyttttttttctttttgtagtgaaaccagttgaggccttaaatcagtaccattccttccatcttgggccatcagagaaaaccatttagagttgtaggaagtcatctgctccatcttgcacttcctgctgcagggctaggaccagtgcctgatagaacatacctgtgacaggacagtatgacatgctgaacaggtggtctcctcagggaccacataaacaccagatcagggagagcaagaatgaactttcaaagagaagtgaccagataactatcccataaaacaaatctctttacagctggagtcaggtttctccatttgtgccatagccttaatttcagagaagctcatagcatttggagtggaaaataaggaaaatgtgtaggatgcctcaaagaggaaccacacgcttgaaatgaatccttgagatttctgcaaggcacagaaggcctggccattcagctgtatagaaacaagacagatgagatgttctgcctcctccttctagaatcttctcctgccagagatccttcattatatcaaaataattccatggaaagtacttgttgttggcgattcacactttatattatttgaaacctcagttacagatatgctgagaaggacagaaactgaggcccactggttcaagcccctgatttcacagctaatgagaatgaagaggtggcctgcattgctagtggtcatgagctggacagaggttaataggcctagaatcaggctcagggctctttccgacatggccagctgctgtcttccttctctcagtggtatttacaatgttagccttgtctcaaattgtggaataaaaatcattttacttttcttaaaggattttaagttgagtattagaaaggaggaaggagaagttttgaaatgtctctaaaatcagcagctatttatatctaaatacaattcttccttgaaggttcattggggggaattcttttgaaattctttcgttattagttaggctttgtcaaaatttacctctgaagaaactattataataacaacagccaaatttgtacttctatagccagcactactacctatgcccatggatgtaagatgaacgcttttttttttcctgctaaaaattaactttcggttcctctttgagggcatctgtctcttaattgacacatctgggacccctgtgtccttagcacactgtggatggtttctttgtattccagtgtctctggaatcctgcttttttttttttttttgagagttttgctcttgttgcccaggccagcgtgcaatggcactatcttggctcactgcagcctccgcctcctgggctcaagagattctcctgcctcagcctcccaagtagctggtattacaggcgcccaccaccacactcagctaatttttgtatttttagtagagacggggtttcaccatgtaggccaggctggttttgaactcctgacctcaagtgatccacctgccttggcctcccaaagtgctaggattacaggcatgagccagtgtgcccaacccctgctagtttttataacattttcttcactgagaaaaaccttattcctgctcttttatacctaaagtgccctttacccttttataatgctcagcttctaagagtcccaaaatgagtgggtaggtgatctaaaggatattacattccttgggggaatcacagctcttgacaatgctgggaaactcctaaccttgctgtgaaggaggaagttacatcacggaagattccctatggaagacaaagcagctgctctttccagaattcaaataaagggccccgcagccctagcactcacccatgtctttaacttccattggatgagacaggaggcagatgctgcactgctgcttcctgactttgggaaagaggaggctcgtaaaggtcatttttggccttcttaaattatctgagaacacactgaaggaggttggattgaactggtcctcagtctgtcggtgcatcatccacctgtctagctctaacattcacacatcataagatcaactcgttcaaatacagatttagggacttttggaaatgaaaggaatctggagttcctctaacccaaagtgtggtctctggaccatcacctgagaacttgttggaaatgcaaattcttaggccccaccccagacttacagaatcagagactctagggatggagtcagcaatctatgctttaacaagccatctagctgattctcatacacactcaagtttaggaaagactattctgagtacttagaaatgaggaatttgggttgtatgattggttcttaagccacactacacatctgggggagcttttaaaacaatactgatgtggaggttccatgcccagaaactttcctttagttcatccgaggtaggatcctggaacgtcagcatttcttttaaaagctgccaggtcctctatgcctgagaaccgctgatctaagttaattcctcatctctagatgaagwaactgtaacctgcagagggtaagtgatgtgcctaaggttacctgggcagttagtgtggcagagttgtgagcagacccagatctcctgactctcaggtcactttaaggcctttttagcttcttgttctgataaatattaaaactccaaaggctccatttacagtctttattccagtctctgagaatggacatgatcctataaaaggagatcagcagagcctctggttcataatgattttgttttgggttagccctgctttattctaatctagctcttataattgtgttcccaatgtcttttatgtgatgcaacttcaatctcataccccaggctccactgctctgcacccccaggcctcaattttgacttggcactgtcttccattaccccatttcctctgtgattagggtcccgcgttggtgtcctgcatgtttggctggaagactaaaaatggcaaagtaggcaacagcctttgaataaaatacatatttaatgcatttccattaagaatgggaaaagctgagctagtggattttaatgctgacatcagaggtcttattagaaagtgaatttgatggtgagaaatggcaacgtgaatcttggaaggtttattgttatttttatacaaaggacttactaaggctcttacagagaaaacaaacaaaagagtttagtgttgtttttgatccttctggagtgtgtgtgtgtgtgtgtgtgagagactgtatgactgtgtatatgtccacaggtggaatcgcttagcataggtctgctgagttaagaggaaaaatggttctgtaaaaatcagccctatcttggacatttgaaggcacctcctgtatggcttgcatgtgacttaggcagactcatcttaaaasactctgtctcaatagtattcacgttttatttttcaggaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcascacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcakgcacatgattagyccttcacccaataaccaacaggcaaccaacacttgtgatggccggcagtatggggcagttccaggctcctcctcccagatgtccgtgcacatggtttaaaggccagtccaaacaccacggagcatttggcaatcaaggccccagagtctccgtggtcagatcctcctctttgggagtccagtgtctttgaaaaacaggaaccgtgttttttttttttttttttttctggccgaagacatatacccaagaacaagagatacctttaagccagtgaaggatacttgcgatagaatcatccgcaactcagtggccattcttctgccttcccagaccttagttttataaagcattgtctgttccagagtggcctttgaagagactgaataatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgttttctgcatgtttgttcatacagaaaaatcaaataacagccttgtgcattttcatcgtgcattacagtgagtatagaagttatatatatattactctatgtgatttttatataggccccatgaagtgaatattagcatccttttataagtagtaactgcattccagagagattgaatgaaatttgtagcattatccagcctgtcacagagggaacgaggacttgaaaccagatcttctgactctaatgggatttttgccttcatattagctgcagaaacctgtgtgaggctaatagtaattgtcattgttactgtgtgccacctgatactacatcatgtgttttacgtgattatcttatcctcccacaattctgtgagataggtaacatttgaatcctcattttatagatccagtaacgagctcataaaatgttaaatatttgaccaagtggggagctggcaatctgaccttagggtctgtgcaattagcactgtcattcagcagtaccacgaggcacttggacaatcaggaaagaagacatatcttaagggattgaggtgagagtgcctctggattttgcttggtatattgaacaataagtatgtactatcctccttgaatgcatcactgcagcatggggagagtggttttgagttgtcatgcaccaactgacaacttagactaataaagaggctaggactatgccatttacaagaactttcatatattatctcactggagcctcacaataaccatgaaaggtggacaggccaggaagtattgttttgcaaatgaagaagtaaaagataaactttgtgacctgcccattcttaagtggctgggaagcagcagagccaggacttgaaacctcttgctcttgcccctactccagactgtttcctggtggacagttacactggttgctcactgacccatttcatcagggtttgatttggtgggctcaggttgccaaccaccacagccattcactggaaatggaggttggtttgggagagcaaaaaccttattcattgctctggttttataaataactgcagagggtggcatgctagttaattccattagccatcagatcattgccaaaatagctggacaatgactgactgagtacctccacggattgtaggctctctgggaatgacatgcctcaaaacttagaaaaccactcctatttggaaaccttgcatcaccccttggtttcataatggtataacaaaaacaactacatgtgaagcttacggttattattattactttttaatttagcagcataccaaacattgttcactgatctaacaccctttgaggtttggggtaatagataatcatagtatgccaatcagaaaacttgacataaaaatctccatattttcacccaatagtaagaataataatttcaataatcatttagaatattaagtacagaacatttttgtaatttgggttaattagaacaatccaagttagttacatctgaattatggcatatgtttccatgtgtacctgaagaagtaataaaaatgttttttaaaagacaaactggataaagaattgtgaagaatatgctctacgcaattctctttcatgaaatagtgagcattcattgtaattggcataatgattacacaaaggggtgtttactagaaggattattcttctatagtctaaggtgctccacaattgctcatttttctggggaaaggctatcttattcatctttgcatcctcaatagctaggacagttcctgatctattatagaatctcaatacatacttattgtttaatttgttgaccaaagcctttttttaaggataagaaatggttgcatggctaaataatattatttactccaagttaaagctacctaaattaacaaaggtttattgttcttcatatagtattctgtaatagattagtgtaaatgtaaatagtagctagcaagcatccgttatacataaggaagagtaaaaatcacaccatggtttctttcttgaaagggctagctttttaggcagccattcacaatgaggtgcatgatataaaaggctctggaaattcaaagaagatgtttagggtaagaagaggttaattgttttcattggtgaggcagaacttctactgagcttttaaggatgctcagaatttttatagaaataagaaatggtgggttaagaacaaaataagattttaaaagacactacaatgaataaacattggaggaaaaataatagcatttcatttcagggagcaatttagtaaagatagagatattcagaactttcttacagcctatagattaatatctttttctatggagtattttttcattagtgggagttttgagagctgagatccaagagcagagctgtctggttgacgtgattcactgcttagtactttgagcatttcagagaagctctgttgtaccagtttgcattcagtaagctaaaggagagttgttttcccaaggaaacccagccaaaaagatgcatttcacaaaagcttttttgcttatgatcatcaattggagatttgttccccacacttatgtcaaggttcatcagattcaattcaatacatattatataatgctctttgttaagcactgctctgggcactgagaacgtagcaatgaacaaccagacatgttcttgcctttaggagctcatggtctagtgagagactgacattgaatacactagcaagtaaatgaataatttcagattgcattgatgactttgaggaaattaaaaataatagaatgatagagaatgactgggcaatgagaacgaaggcttatttagatatgattttctaagagggctgctctcagagggtgatgtttgagctagtacaaatatagccattttcttagaattggcttactctaactcgtgctgagggcagccatgtgtcactggaagatgtgttcagctgttattatgtcagcgtaggccaggcatttttgtctttacaatagctttgtatagcattgatactaattttttgaagtcttcttgggactggagtaatttagagactcttcaaaatatgaatctatcttctacacagcccgagtaaaatcatattttcatgacattcttagaggatgagaggcacctttctaactaactttgtaaaaggttaaaactaatgatcaaccaaccaattgatatcaatcagactaatgatgaacagtaattaataagcaaaaatattaaatatggcttggtagtctataatgatctgagacattattctgttctagaaggggattttaccctggttgaagagtcaagctacgtgcataagaaacaataaaagtattaaattggtggtaaagaccatatatgctgcaaaatttcagaagaaaactaatttttattgagtgtttattacatcttacacattatgcaaggtaatatcctgtaatccttgcagccatcctgtaggatttatatttcaatccctattttagagatagggaaaccgaaacttacagaagttagtaatgtgcacaaaatcacagagcttgcaagtaacaaaggcagggctccaacccaggcctttccactgctatatttttccaaaaatgagatttacagggactataataaaaagtcgtgggctcgtggagaaagttgaacttgaatcgtacttcgaagaattcatggaagctgcctaaacctaggaggaggaaggtgtcccggtgcgaggtgggggccagcacagtaaagacacatgttctctgtgtggtatgagctatggtagtgggattgaagcagaggatattcattttcttgagtcaaatctcataaagttctccctgctgttcctggcaccatgacctctgggttccctttccctatgtgaggtgtccttgctctgtaacttgggcaattcaggatttcctccagtgtctcaatgggaaccttcaacatggaaagcgtcagtaaggcctgggaggtgatgaagaaatcaagttgcatccctccacccacccccagcacctccaccccactctactcccccagccggggccccagggttaggctcaactgccacactccctgagtcaggctttgcacagaggcccttgctttttccagccaggcacacagtgccacgtgggatgctgaaatgggatcttgctgcttaaggccgagaaaacattcatcatgttttccttcttagctcattttactgctcatagcactcatcttttatgggccagcctaacggcatttcccacttcagatgcttcctactcacagtttctacttttattacactttactgcaggctctgcagaggcacagaaaaccaaaggggttttgagtcatttttagtattttcacctagtgaagccaaagtggacaaagggggctatcaaaggattgccaagtcaacctctgtcagctcttattctcagggaagcttttgaactccacgaagaagattcttggagttctcctcatcttgcccacaccatgcatccttcctctacacatgagcaggtagagcctctcttaggctgtctctagatgaggtaacagataaatctccaaatcttaacataataatgttcatttctcactcatctcacaactcaacatggaatttctcattgagtggctcttctccaagcaatgatttaggaaaacaatcttcttccatttgatggctccaatatcttcagcacttagctcagtacctctccattcagctaaactatgaggagaaagaataaaaacttgtacatgggagatattcataagcccagtcttgtattgatgcatgacttcctctctattctaatggttagaactccagtgaccacacctaactgcaaaggaaactgggcaatatagtctagctgagtgcataggaagaagaggaaacaaatttgttaggcattagggagcttctgccagcccctgagccaacctagcctgagccaatctcaatctgcttttcctataaacccagcagtcaaagataaggctaatttctagtcccagcttctcagatgctttgcaaagcaatctggaacagttaactttgccccactggggttcggttcatctgtgagatatatcttttagtaggattccttcccgttctcctaaaagatcttgaggatttataaaatgctgagtaagcttttctcaagtgataagtataaaacaagaaacatttatcaagtgcttattcatgccagcttaagtgccttagttagtaccatgtcttatttaattcccaacgactttatgaagctgacagtattattattatacccacattataggtgagagaaaaatgcagaaagactaagaatcttgccaaaggtcacactcaggcaatctgaggttagaaccattaatatttgataaggcagacttttagaaaatatttcttttcctgggcaaaattctgagaatgctacacaagccatgttccctggcttaaataagcttgtagtataacaggaatcacctcttgtttggtttcattcagaaagagctcaagtatgacttgcatatggaagtcatctctagagtgtcaggatcacactccactcagcctgtagtttttgcaggtctttgcataatacttcctacctcaaggcaggagtgtggaaggcctgaacatgtaatgttatttgcagtccccaaagattcagtctgtttggaaactatattcatacatggcttctagactaagcttctggaattaggctttgtctaactctgtgacaatgctcaggcctttgacctaagggtgttgctggtggtgctcctcagaaaggaagctcacagggtgaggcaccctctacaacaacaactatcttgggtcccatcactaattaatcttcacagagaaaaattagctatcccttcatccagaatggtgcccagaacaaataggcaaaatgccactggttccattttccatttccagagtgtgctggtctca

SEQ ID NO: 10742 - DNA, 46182 bp, Homo sapiens
  misc_feature (1)...(46182): n = A,T,C or G, or insertion/deletion polymorphism (see Tables 1-2)
aatgtgggttgagggcattgggagaaatacctagaaagcactttggtgctccctctgtattccctgatgacacatgctatttaatatggtcatttacaccaatgatgattgttaccttatctgaaaaatgggtgtaacagtatctgtcctttctacttcagaatttttgtgaagctaaaaaaaactaagatagtgacagggaaggtatttcatggtcatcatcatcacctaatttttcgcctggaggatggttaaaggggktttcctccttgaggctctagggggcttcagggagcaagaagtattctcctcagcatttgcatcagtaaagataccaagaggttgcaggggccaygccaaatgggtcatgtgaggagatgtatttcaaagaattgtctgcaaaggtggccagggtgtagggctcaaaagaagcgttcagtggcctgggctcgcaaggggagctattgccatccctgggccagcaggaggaggggagggggtgtgacagggttctggaagggctgaggctgccttggaggagaggtggcgttttttgaggaacagggtcagcctgaggcagccaggggacaaatgcctgttggccagagggcaagggagtccactgcagcggccacagtccatccagcccagctcctgtcctagagacaggatctgccgggccaagggcagaggcccgcacagcaccattggtggatcagaacagcgagggtgcctgggggttgggagctttgctgtggaggcaggagtctggcctggtctgtgagcccccctgccgtggctcactgggggtaactgaacaggcagaagtccagggacaggctccacctctcctctgagtggccggcaacaatgcaccttactccctgctggcccaggtataaaatgaaggcatgaactagaggattattcaaccttggaaaaacccttgaccctaacataattgttcattcggtccacatttcgccccctcccctctgcaagactgtagagctctatcttctgaatttgaccctctcccaaaaaaaggcatattggatgcactctttagaagttcacatgtgcggctgggcgtggtggctcacgcctgtaatcccagcactttgggaggctgaggcaggcagatcacttgaggtcaggagtttgagaccagcctggtcaacatggcaaaatcctgtttctaccaaaaatacaaaaaaattagccaggcgtggtggcaggcacctgtaatcctagctactcaggaagctgaggcaggagaatcatttgaacctgggaggtggaggttgcagtgagccaagattgtgcccctgcactctagcctgggtgagagagcaagactgtttcaaaaaaaagaaaaagaaaaagaagtcctcatgtgcctccctcccctgcctctgctgggtttgggggctgggctgcttctccgctctcccctccaccctctccatgacgcaaatcctagacagggagaacatttcttgacctaaatatttttctactctaatgtccttaattttagagttggacaggttggattatttgaaaacagcctgggttgtgagaggaaaatgagcaggccagaggaatttggagctgccagcatcttggaggtgagcatccaaccaaagaacactcagcttccgctgcctttatgcccatcgatcaccccacattgcaaggttctcatcacaaatccagaaataggactccaatggggagtatttgtaaatcatcttttcttagataacaaatcctggagctgaaagaaaacatgtgtgaccattcttgtcaatttacagatgaggaaacgcaggccacagagggcttttcaccaaagcctttggctgtctttttcttgctcccactcccccaaggtcaagtgcctcacagccaaagcaaaatggatcttagaaataatttgggaaaatcaggaattgctgagtggttcattaagactataagacaaaacagcaacaacaagcaaacaaaatccccaaacccccaaactaaacacgcagacacaattctgtttaaatacatcatcggtcatcaaatgattctgagccccataatcgtatttacccagtgaaagcaaagaagtagagtgagtccattcatttcttagccatttactgagcgtctcatgtggccaagcgctgggaaacacaaaggtaaataaaacgctggagagcactagaaactatatttatgatttcatttatatattatgtattttaaataataacatttggggttttccagaaatgggtattttgcagtaaggtgaactctaagaagagagcatcacaacgatgtcatgggcaaacctgccttcggttttaattagaccatgaattttcttttctttctttcttttttttttttttttttggtcttgttctgttgctgaggctggagagcagggtgcaatcacagctcactgcagccttaaactcttgggctcaagcgatcctcccacctcagcctcctgagtagctggggtcacaggtttgtgctaccacacctggctaattctctcttccctccctccctcccttccttcctttctttctttttcttttttttttttttttatgggggtccactttgttgtccaggtggttctcagactcctgggctcaagggttctttccacttcagcctcccaaagtgctgtgattaaagggatgagccaccaggcctgacctgactttcttactatgcacttgaattcgaatttacacctctgatgttcatgtcttactttactgtgaatgtaagctaagtggatgcctattcaattaagcaaacatttcctgattaccaggccatgctctagacaggggggatatggaaatgaaagattaagtggttctgcctgatttgctcatgatctatatagaaatgtaaatacccagactccgggatagaggagcataaagaaaggccaagcttcaaagaggaggcaacattggatctgggctttggaggatgaggagcagtttgcaaaatcgatgaggagtggggaaggcaatctaggcaagagaagcagcatttgcaaaggcctggaggcaggcacttgggggaatggagaatttggctacaggacagggtttaaggagaaacagggatgacttcacccaggtgggctgattcttcacattgcaaatggattgtcccatttgcagaaagatccagagcctaatgtctctcccgattctgtgtcagtgtgccggctgatcccagtgtgccggctggtcccagcgtgccggctggtcccgtggattgagaagtggacccaagaaacttaaaaccatcagagatgaggatgtgtgcagggagtgactgttgtgggatgcaggtttctttacggggtgatgaaaatgttctgaaattagtggtgatgattgtacaaccttgtaaatatactaaaaccagttaagcgtatactttaaactggtgatatctgtggcatgtgaattacatctcaatctaaaaacaagacatttggatgaagcatcgctggatcgacgtggccaggctgcagaaaaacagagcagaacctctgctgatcacctgccactgaacctccataggctgacagcactgggtggccaccctcccagcaggacctcatccatcctggagatctggctggctgtgggaggcctgactagatcctgcaacccatcccagctctgcagggaagcctgtggccggggactcatcatttgacttctgtgacctgcaaagaggctcatgaggcctctaggggaagagtcaccttagtcactctgaacacttgtcacataaccaggaaaagtgtctatcacctcgccctggctccagcaccggctgctaagaatagagaccacaggagtacagaattagaggtcaaagcaatagtaatacctaaaacaggcacttaaaaaaataagaatagctcatttgattctcacaacactgctctgatggaggtttcattatctccatttatagatggggaaactgaagcatatattggttaagcagcttgcctgaagtcacactgctaggaagagagggacaggattcaaaatcgggccacggcttagccactgtgtcacattgtctcttgctgtgacagtctggacttcaaccagtgggacaagggaagttgctaaaacgcttggacctggaagtaccagggtcattagagagcagcgcctggctgccctgaggagagggagcagggtaggagttacaatcgtacaggcagtgatgggtctgtgcctgagatcagcaaccctggaagtattcctaaaagagtcatttagggccaggtgcagtggctcactcctgtaattccaacactttgggaggctgaagcaggtggatcacgaggtcaggagatcaggaccatccttaccaatatggtgaaactccgtctctactaaaaatacaaaaattagctgggagtggtggcacgtgcctgtaatcccagctactcaggaagctgaggcaggagaatcacttgcaccagggaggcggaggttgcagtaagctgagatcacggcactgcactccagcctggcgacggagcaagactccgtcccaaaaaaaaaaaaaaaaaaagagtcatttagaaaaactgagtatgtgtcaacaatcttctgtggcacttggattttaaattgttggtgctgggatgaaactggtccagggggagatcgcatcccattgattttccctttttgtatgttgtgaaaatacctgacatctgtttgacctgcaaccaccattgcagcctcagccatccccattttggtggctgtggcttcttcaacctaatttctgccaccctctgtgaatgacttgggttctccaaatcaccacacccttgcaagcttaatgcctgtagtgagctgaatggcgacccttaaaagatatgtccacatgctaaccccaggaacctgatttaccttacatagtaaaagagtgaacattatcttatatggcaaagataggattaagttaaggattttgagagggagaccttatcctggattatcccagcaggccctaaatcctatgatgagtgtccttataagagacacagagaagaggaggaggcaatatgactggagtgacatgaaggcagagattggagtgatgcagccacagtcaaagaatgtctggagccactggaagctggagggggaaagaacaggttcttctctgtggcttgtagagggagtgaggccctgctgggacctagactttagacttctggcctccaaagccaggagagaacatgtttctattgttttaagccaaatttgttccaacagtggcaggaagctcatatactgtcttaacacattctgttctcctacctggaatgccttcccctctgcacgcacctctctcaggcccacctgtaggaagctttatccacagtctttacccacagtctctggatgtcctccctcctggcaagaggcagaggccactctcccacagggccactgctcccagcaaagacttgcccttgtccgtagctccctgcgggtggcgctgtgtctcatgcattttgcattgtccatgcccttcacagggcccagatacaatcagcagaggaagaaaaccacaggatgaaacagtcccaatgaccagcaccagtgaagacccaagacagcacaaaaggccagctagcagagaaacatgattgttcaccgtccatctctgggacaacctaggtccttcttgcctttctgtcctcctcagttgacagagtctctaagggaggggcagggcctccactttgttcctcctggtgtggaattctgaccaagtgtgtgtgtgtgtgtgtgtgtgtgtgtgtgtgtgttgcgcgcgcgcgtgtgtgttgggttctgttaaatgcttgagcctgagacggggggcggggcgggggggggtgcgggaaagccatttccttgcttaagcccaaagggtttctcctgaccagtgggtcactctcatggcagatgcctgggcagatttctgaagtggagcaagagaaatcttctcttcttcacctgcttcagggaggcatcaaagtgccaaaaaggtgggttctgtgggtccccgaggcccgtggcaggggccagagtctgacacccgctttccctgggttgggggcggggtgcctctgccaggagcctgggttcagaccaggctggcctgtggtcaaaggcacacttagaccctggctggagagttggggcgagttacgagakacccactaggtcacctgtcaaagacggctagccctcctggggattttgaaatcagggcacccgcggcaagttcccaggctgtgcctggggctcaaggcggtggctgctyctgtgctctgggcttattcccaggattctcagacggctgatggaaaacgccccggaccctccgtagtgccgcggggaagtccccggaaagggtgtgaaaaagtatcgaatttgggtgatgcctcctcctcgtccagcgcctgacagggcccagctcctggcccaggtgcccaggaggcaccgatccccgcagccggcctcctcccgcgcgggctccactcccatttcggcctcgcccccacaccccatagtctttcatccgtgagtcctgcaggcaggacgggttggaggtctgcaaacaggaccctctctgggaagccgcgacagcggctgagctcggggtttgggggcgcaggtcgggctagaaccaccccccttctctccgcgtccgggcatcgtcccagcggcccctcctctgtgcccaggatgctcgggcggcggctgcagtgggacctccrccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcccgcccaggagcagtgcccgggggatgcccatctcccggagtacgcgggacggggctgtgaacagcgggtcgcccgggtgcggcggccccaggaccggggaccgggtctggaggtgctgggcaggggcggcgcccccttccctggccgcggtgcgcccttgcgcccggcgcttgggtcctgcgagatgagggtctagaaatacacagcaccacccgacccccgcatcgggccgtgaccaccgcgtccccacgagccctccccgagacgaagcggggccggggagctcgcggacgccgggacgccggtgggtgtgggtgcccacttcccccccgccccgccccgggtcttgcttgtggtgactccccccggccctcccgccgcaggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtaagcccccccacgcccctccacgttgccgggtgtgcacccccaaatctcgcacggcgggcgcaacaaaagaaacgcgccgcgtgcgctgggtacgcgaagtgggggcgggctcgggaggccggagggagcgcggcgaggacagtgtacccgcgcgggattctggatcgcgggatgctgggcgggggaggggagccctgccttagatgatattctcgtcctgacagtggaacgcggtggggcaagattccttcgcgtttttcctgggagcctcatccgagagggccctggccccgcagctgccctgctcctcccttgccccgtggccccaggggctctggatcgggggtgagcctaggggcgggcgaggctgcccctgtaccttcccgggtgtggcagttcagcccgacttgccccaccgaggcgggggagcgttctccttggtcagatggcccctccccagggctgaattgttctcgccctttctgcctgcccctgccaggctggcgctaggtgcaggagggtgtgcgcgctcacacagggtctccttcctctttgttccttttgtgaaatctccaaataagtgcccgggctcgctcagtattggtgtcactgggaaaaaccattcatcaacctttccccaaagtgttttctgctgaatttaaagaatctcctctttttgaatgtagcatccaattaagtagtttctgtttgctaagaataatatttccaagagttaacacttaaaaatgtaaatagatctttgcatgtctaggcaattgtactgtaaaattcacatctaagaccatagacacagcatctactctcagcatcttgctgccgcttacgaaccaccacagccacgaataattcccggaagtgcttttctatttattttctcatttagtccctggtgaaggggctctgagccagggctctgtcttcgttccagcaagttggtgattgctgacggggtgggtgttgtggggtgggggtgtcctggtgggggccctgacccctgtgaaggtgtcctcccagctttattgtgtgtgtcgtctggggagggaggcaggagccgggaagaggctggcagcgggggtttcagttcaagaaagggggatcagccggccacacctgtgccccccaggccacggtggtgccactctgggccactgatggtccaggctaggctttgcaggaggggcagggctgcctgaggcctcagcttccactccacccctccctgtctaggcatcagactcgtccagttagcggggcctggccccgaggcccccacaccccctcctgcctgggcccccagctgctcggctgaggagcagtggcgcctgtgccaggaactccgtgtcctgaggcagcacctctatcaggtgattcccctcacttggcctgagcctcctctcttgtcctcagtctgttccattccagaaccatttggcacagttggtttatacagggaggagggtttcaggcaggtatgaaatcctcaccaactaattaggtcgaccaggagtagcctaggcagctcggaaaggtgatgagtctgctctctctgcaagcgtccgaagcggggcagccagcagggatgctcttctcgggtccagccagaccttccatcccggacttcccgccgggactgagtgtgggtacaagggttatggctcttgggatcattttccagaaggcttctaaggtcacaatgaggraactgagcctcagagcatttatgggacatacccaaggtcactgggctgaaggttacagtcctccaggatgcagaagtttctggcagtgcctcttactccacygtgcttggagccagatgtctctcacgtaagacctctcttaacctgaacaacagcaacgtgttgctaacggtcagagttcagggaggcgatgtcacctgtttcaggtgacatggcttctgaggggtggtgacacagttgggttataaatgagaatctgttctgagaacgtgtatggagtgctgaggtgctggggtgcagcggtgacagcagtcacagtgctggcagcagagtcagggctggtctcccctgacatttgccagacacttattctgcaccaggaactattctgccagttttacaggtttaaattcttttaatgtgttgataatgccatgakgtcactaccatgttacccccattttgyagatgtggaaatgcaggcacggagagtttgagaattgcccaaggtcacctagcctgttagtggcaggtggggatagaatccaggtcgacagaatattgatggggcccccacatacgggagaggtttccatgggtttcctcatcctcagcagtagccttatttcccattcattggccagtctaggcctgcgtgctcaaggtcacatggctagttgggtccagtcggggtttgaggatggcagggtgacacccaaccactgcctcaagcaatgagtgcctcacaggggtgggtgcccaggccaacccatgccaggcacccctccctctccaccgcaggagcactgggtggaaaaggagttggggtcagaggccaagagtgtggttacaaggtttatggctcttgggatcatttttcagtgaccctggaatgggctccgctgttctttctccccaaggctggctttgggggtcrtagcaccggatgagaggccctctggctgcccgcctggggctgaccatccccagttgctggggtctctttgttctgtcctggtccccaccatcgtggagagcaggtgacggactgcccaatgaaggggcctcgtccctcrggggagaaagagcttggaggtggctggctgtctctagtgcaacagcctctcctggaacctggcttggggagcggggtttggggattagagacctataacaccttgacactgctcttgaacacctcccagtccagtgggacagagaagtaaacagtccctggcaacgggtgtggtgagtgatgaaggcagcgccgctgaggccagggctgtgagtgtccagggctgggaggcttcttgggtccatctgaagctgctggggtgtagggcagatgcaagggctggtttccaggttggacaaacatcgttctgcttcacagtagggggtggaggggaatgagagcagggagaccctttgggggctgtggcaggggcagggggagaggaggatgtgggggtggagaccaaagaggttgatcctggatctgtttccagacaagctggtggccagcttctccagccagtcctggagggctgtggacagtaccctcagacctcctcttcttgtgcccatggtggcacagcaaggccagtgaaaaggcaggtgcagcctcccagcttcctgggccaagccaggctttggctctggtgggtggaaggagcactgggttaggagtcagctgccaggctgcatccccgccctgccgcctataaaccgcatgaccttggccaatgagcttaacttctgtgcccctcggttataatatttccctcctgggactgctatcaggattatgaatgggtcatttctctgaaagtcctgccacagaggagatttccaaaaagyagtggctgttctcgttcttgtgaatttcttcctggcaaatggtgactttgaatatgggagttcccagacccaccctctttgggcagatatgtctgaatgcatctgacttttgtttctctgtttcctggataaggtggtcgtgaaaactaagaccgagtatgaacctgaccgcaagaaagggaaagcacgtcctccccaaattgctgagttcaccgtcagcatcacggagggtgtcaccgagaggtttaaggtgagtggtcctgtgctgggtgagatgctgcttttgcccccagaaggggtctgctgagctgcatagatgccctgcagggagggccagggtttgacgccgtttgtctgggctcatcccagctgtgcacacccagtagcttgtgactgcctgccaagatgttgtccttgtgctttttgtacatttcttttttcttttcctcttccaaaatgatcacatattacttatttttataacagggaaaacccacccacaaactgtcttttaggcaaagattataaacatatgaaaaatcacttaccaaacattacaatatttacttaacagttccaggaaggaagcaggcaataacaaaaagataacgcacagcactgatcacatgccagaaaggggtcccagccctttacctagtgagctcatctgagcaaccctcctggcacaccagtactatcggtataacccattttgcagatggaaaggttgaggcacagagtggtcacagctctacacagcagagccaggatctgatctgcagggggtctggctttgggcctgtgtgtatcctccatccttccccccatcccaatgggatgaaggggtgctgctgagagcgggagggttccagcctgtctcggtgggaggagccttcttgccagcctggctgccttcagaggccacgttggttgaagaacaagttgggatattgatcaggaaactcattctttgggaaacatgagagagagagagtaaagcggtagcctcatccagattcaaggaggtgaattgagagacatcagtgggccccaggccttgcagagtggccctgtctggctctctggtcaccctccacttggcagtgtgagcagtttgcttgtgctgggggcacagggactcccacccccacccgctgcagtttccagagcccctgtgggtatggcatcatattggatctctgtgacaaccttgtggatcacagaaggtgggactgggagccatccctggttaacagatgaagccaaaaccacagagtgactggggaagccagggcgtaatctgactttcagtccctccttcttcccgttgccacacactgcctgtcagggcctgcctggtccagcgggtcccatgagtgttgctgtggggcaattacttgtgtcagctcagcaaatcctcccagcagccctctgcctgctccctactaatagtaggtactatttgtattaccagtgttacagatggggaagtcgaggcacagagcagtctgtgtctgtccctgctggwatgtaaggatgtcgtgtgtgccgagaggctcttttggtggctcctggctcggcccatcgtacgtttttgaggttcttggccaggaccaagacatattgatccgaggtcaatacctgtcttctgcgctggccagtgggattagcgcgtgccttatctgctgccactcacctgtcctgccccatttgcaccctgggtttggctgctgtccctggttgaggcaggagtggmcttgatttcaaggtcatggtgtcctctgtcctgatggctaaatgctgtgtgatgtctgagtgtgtctgggtttctcaggccccacttgccctttgctttcccagccccggcgttttaggtccccacagagcagggcgcagtgcggcacttgaacagctattccttcatctgttgagtgtctatgatgtgccagcctctgtccccgacctctggtgttcttcatttgcacttttcccacatgaccacctgaagcaggtccccaggtctcttgcctaaggaatgggtgatgcatatttgccaccagggcccttggcagccttggctgggactctgtggttacctggcccctgttgcccagaacctgaaggctcagaagaccatgggtgattatgctcatcccaatagactggctgctggcagcagaagccctgcctcatctccctgcctctacctcctgtggctgtctgagaaggcgatgtatgcagtaggtgctcagtacatgactatactggactaagtctgctgggtgtgttcctctgcttagttttcttttcctcctttatgattcacaactgccctgaaggggtggcatcggcccctttacacgtaaggctgttgagtcccaggtggtcccagggtggctggggtgctccctctgtgactctctagcttcaaagccaaggccttcccaacataccttgcaccacatccctccccactcccatgggacgcctgctgcttcccagaccccatcccttccatctcctcccagggcaggtgcagatcacacctctgccaggaagcctcctgggtcactctcatttgcaacagacctcaccgccctgtttccagtgccttttgtagccaggctgcaatggcrtctaacagtracggagtgatccatgagctagactctgcttcacactcctaatgctcatattgtctcatttaatcttcataaacacctcaggaggtaggcgccctyatagctccattttacatagaggggaaactgaggcagagagccttggcagcctgctcttggctgtggcaccagaggtccttggtttcttggagaagtgggtttgtgtgggagcactcaccccaggcgccatcgctgttgarccattccacttcttcaaatccttttcctttgttgattcaaaacccttgctctgctgccttgagccacacagaatgtgcrgcgccctccttccccatccccaaggccttcagagacatggcaggcacaggtaccccggaagcctccccagtgtacagcttctttttctcttgtgtctttctgagtcctggtttccacgctcccttcccccaggtgctctcttttgagggtctgggttgggctgtcttctctttgggtgtgaaacctgtgactgggtgtcctggcaaggtccattggtgtggcccttccaagcataggccccctcgacctgaactggtgacccgaggaggggaacaaggccatggagaccccctgagccaagaatgtcagccaagaatgaatgcttagggactctttgtgcagacggaacttactcatcagccgctctatgccagccatggtaagagctccttgatatcatctctctggcgcttcttgcacacacagtaacagcttgataagtaaatggatgactaattgtgctgctggcctcccatgaatggggtacttggcgagatttcctgggtctgcccrtgggtccttgcttgttgagtaagttcagctggcagctcattggattgaagcctctctcggggccatgcttacgcgtaagcctctaacaggtgatgcctgtcagctctcaccaagtcagacaggtgacctgctcaagaccacacagtcagtgagtggcagaggcagagtaggagctgggcagccggctctagaagcctgttgctgtggcatacttcagcccactagcttgcccaggaagcctgcaggctggactttcgcagctgaacaacttgcattctaagggcatctcttctctgtgcctgctccgagccccttctcaactgggaaggagatttacctagctccctgcccacttgctgtggggtggatgtgagaggcagcctccaaagtgctgcttccccaggtgtttctggagccacctgagtcagcatcacctgaagtttgattttaacttggaccctgaaccgcagggagatgcgttttgacaaatgctttccaggtgatcctaatgtgtcctgagttttcgagcctttccgatgggggtgcattccagcacagaagctgggaaggatgaggagggctggtgctttttgggaatgctaagggtgcccacctttctggaatgttctcccagctttttattacccagttagatttctggcatccctgaacgcgtgcacacaatgaggcgtgtgtgaagctgcagctggttgagggctgggcgggtctctctttctgaaacgggagcatatggggagcaggctatgctggagacacgggcatgatggagggtccgsaatagagattcaccctccctggcttgtgtacccccctgccagggcccagtcgaagctgtggttgggacagagcatcttcctcgtcccactagtgactggacagcttctgtgcagctccctggcccagccatcatcttagctctttcatctccatgcatgaattgcaggaatggaatctcgcctttccgatcttgaagtracaggtaaatcgtttgtcccctcctctctccaatttgtgtagctcagaagcacctcatctttataggcgtttggatggcatccttgaaacggagtgtctttttgcatgcagctttctgattgtcacttggggattaatctcttggctgtgaggttactaggctggttgctaggtaactgctgactgggagaaggttctgagagactccgccacacgggatggcaggaggactcccccagcggcggccagctgcttgggcttccaaagaggttcttgtcaaggaaagcagtcgcttaattaactggaggcatatttacagtgagaataaacactggctgagatgtttctcaaccaaacctaaacatttttgaaattgcacttccccactgatgcctgcagagtggcgggtcggggctgctggggccgctgcttgcagttctccttccggtctggagactgtcattaggggccgtcatcagacaggtgacaggaaggctccctcagggcccgctccagcccttcgtgcttcgtgattccggtgatgaccggttgctgacgctggagaggtctccacaccctgtttgcctgtgatgtgaggtcaggtttgggtggtccagccttgaccctcaccgggtaccatgtcaccctggggccttgagagatctgaaggtcggctttgcacgggaacacctttcaccgccagcacagggctggggagtgacttggcaggagagccctcgttagtctgcgtggtccccctggttggcagtccagactctggtggggacgtccctctgcatcctgtcgcagaggactctgtgggtggtttgtgtcttttcttcacatccctaatgaccttgagcttcctgctgcccatctgtttccacattctccagtaagcccctggtgtgttccctaatgaccttgagcttcctgcgtgcgcatctgtttccacattctccagtaagcccctggtgtgtttcaagatgcatttcttaaatatttatgaagagtgatgccgtttccttggcattcagcagtgggggtgggggttcttcccgtgggggtggtattggagaccctgaaggtgtgtgtggacgccccctcacctttagctatgcgagcattcttgtaggatacctggggctgtggttgcagagcccaccttccccaggctagctgtagtgtgggggcttcggctgaatcagataccacgtgggttcagtcatctgtgtgtgtgtgtgtgtgtgtatgtattcacttttgtgtgggttacctaaaatatttagtgctgtaaacgcttgaagatgtcgggattcatcttctttttccaagttttttcctttttttttttttttaaactgaattactcagcagaaatgctcatttccttctccctccgcctgagggtaggaggatggggagagtaacagcagccacccagcgccgtcgacctggcgccatcgacccagtgcatgcctgggcttggggcgccatgagcactgtctcgttccctgttagtctctgatggttgaccctgctgtcctgattttgtaggtggggaaataaggccagaaaggttaaggaacagacccaaggtcacccagctaatgagggtgacacaccaaatcccactgtgctccgtcctccatgccagtggggtgtgcagggcaactcccctgtggaccttgagctgggcagtggccccagacctgagagggcagacgggagcacagccagtgctgaggccgctcacgcttccctgtccagacggtgagcgttcccagaacaaggccacgggccactgcctttcacgtgagtgaccatgtaactcctggcccaggtggggcccttctgtgagtgacagcagacacagtgattggccaggatgctgggtggcggccatcacccaggacccccaagcctcgaggacacatattccctccttatccactcgttataaacgcaccctgaggcccagatcctgtttgtatttctctgttcccggctgttctttccagaaaacamtcctcaggtctcccttgccttccactggggctcatggcctcttgtcagcacmcccacaatagtttgcgacaccagcctcccgcctctctcctctggcccattctttatttttttctttttcttttttaytttttgagatggagycttgctgtgtcacccaggctggagtgcagtggcacgatctcggctcactgcaacctccaccccaccaggttcaagtgattctcctgcctcagcctcctaagtagctggkattacaggcacctgccaccatgcccggctaatttttgtatttttagtggagatggggtttcactatcttggccaggctggtcttgaattcctgacctcgtgatccacctgcctcggcctcccaaagtgctgtgattacaggtgtgagccaccacgcccggcttggcccattctttaaataattgtggtaaaatatgcaaaatataaaacttaccgctttaaggtaagtgccatattaaattcagtgccatttaatacattcaccatgttgtccaaccaccatcactaagctagttccagcacatttttatcaccccaaaaggagaccccattcccattaagcagtcactcccatgcccccccccacagcccctggttagccacaaatctgttttgtgtccctgtgacttacctattctagacatgtcatagaaatagaatcttgtaagatgtgatgtgaccatctatctggcctctttcacttagcwtgctatttcaaagctcagctacgttgtagcacttacaactgcttcattccttttcatggctgagtaatattccattgtaccgatagaccacattttgtttattgattcattggttgatagacatttgggttgtttccacatttgggctgttgtgggtagygctgctgtgaacattcatttacaggtttttgtttgaatacctgttgaatttttgggggtatatgccccggagtagaattgctgggctgtgtggtaatttgatatttaacgtattgtggagttaccaaacttctccacagagctgtaccattttacattgccattagcaatgcacaatggtttcaatttctccacatcctcaccagcacttgtttgtttttattttattttattatagccatcctagtggatatgaagtagtatctcattatagttttgatttgtattttcctaatggctaatgatgtcctgcatcttttcatgtacttgttggccatttgtatctcttcttcagagagatgtctactcaagtcctttctcattttttaatcagtttgtttgtgtttttattgttgttgtttttgagacagggtctcactctgtcgccgaggctggagtgcagtggtgggatctcagctcactgcagcctcgacctcctgggctcaagtgatcctcccacctcagcccctggagtagctgggactacaggcattcaccaccacacccagctaattttcatattttttgtagagatggggtttcactatgttgcccaggctggtctcaaactcctggactcaagcattcctcctgccttgggctcccaaagtgctgggattacaggtgtgagccacctcacccagccgtgtttttgttgttgagttgtaagagttccttatatattttggatactaagcccttgtaagatatgtgatttgtaaatattttctaccattctataggttcttttttcactttcttgctagtttctttgataaacaaaatcttacatttttggtgaagtatcatttattttttcttctattgcttgtatttttggtgtcatagctatctaagatagcggtccccaacctttttggcaccagggactggttttgtggaagacagtttttgtactgaccagggagcaggggatggttttgggatgaaactagatcatcaggcattagatcctcataaggagaacacaacctagattctcataaggagaacacaacttgcatgcacagttcacaatagggttcatgctcctatgagaatctaatgctgccactgatctgacaggagacagagctcaggcaataatgcttgctcacctgccactcatctcctgctgtgcagaccagttcctaacaggccatggactggtactggtctgcagcccaggggttcgggacccctgatctaagacaccattgccaaatcacatgaagatttttcccttgtgttttcttctaagagttttatggcttagcttttatatttagatatttgactcaattgagttagtttttatatatggtatgaggtaagggtcacattcttttgcatgtggtcctaacagcattgttgaagagactgttctttccttattgaatgaatggtcttggcccccttattgaaaatcagttgaccatggactcatagttttgtttctggactctcaattgtattacgtggatttatatatctcgtcttatgctaataccactccgttttgattatcgtagctttgtagtaagttttaaaattgagaactcctccaatttgttctttgttttcaagactggttttgaaaacagttttggctctttagggtcccttgtaatttccattttckgcaaacaaacaaaaagacctttgggttgctgacagagatggttttgaatctgtagatcagtttggaaagtgttcccatcctaacaatattatgtttttcaatctatgaacacagggtatctttccttttatttatatcctctttaakttccttcaaaaattttttatagttttcagtgtacaaattccttcactttttaatgtaggcagtaaaccacagaggtattagtagtacttgtgactttgtcaccaatgcataccaggtgtttttatatcacattgcagctgtgggacagtgtggtcttgggacagtgtttattgctcatggttcctttgaagccacagtatcagatcttgttcagtgtgttaataaatgcatatctatcacaaatttatatttttgtaatatttcgataccagtatttcaatataatcagttttccttgcaagtctatgtattgtgttttactcatttaaaacatcattctaaggatttgtggtttcacacagctgccaaagaggtcaatgacacaaacctggtggagccctgcacccgctgctccagtgcactatcccttaacacccacagcagtgggggctgggccaccttgggccaccgtgggatgcacagcaatgagtacaaatccctgcccagcarctataatcccattgcccctgctttagagcttttactgccagctgcacagaagtgatgtaaatttcgggataatgtagaccctgctgtaatacacacatgcatgcatatcagtggtaggcatctgtccttcagatgactgcttgtgctgtgagaaatgctagtttgtcacaaagtggcagttgcttcctggggtcctgaaacacccgggacctgtctgcttccagtgtcttggtgtggcagacaggcatctttgtcgccgggctcgtgttccctctcctgcagggtgtgcgatgctgcagccacactggtcgtagacactgggttttttgatgcttcaggcccgtggcacaaaccctttcttcctgctggactcccatttccctcctccctggtaagctcctcctcctttgggacatggacacctcctcccagaagccttccctagcaaagttatcggggctggctctttagcagttctcgccctgtgttgggaagagttaacaccagggtgacgctgtgggaccctacagccctgcagggctgctcaaccacgtcaaagcacctgagaatgtcccctggctgcctggggattccagtaagaaggaagaaggcagggccttttgggactgaggtgctttggccatcatggaccccttccttcattaaaaaaagagaaaattttgactgctttgatctaaagatgaatatagtccaggctgggttcctcaatatagattcaccagtgtcagtatgatgatgatgattttttgagacagggcctcgctttgtcacccaggctggtgtgtagtggcaccatctcggctcacttcagcctcaaactcccaggctgaagcgatcctcccaaatcagcctcctgagcagctgggaccacagatgcttacccccatgcccagctaatttttttttttttttttttggcagaaatgagttatccctatgttgcccaggctggtctcgaactcctgggctcaagtgatcctctcgcttcggcctcccaaagtgctgggattacagcatgagccacagcacccagcctggtttyttattttttcctttgattttttttttttttcgagatggggttttgctgtgtagcccaggttggagtgcagtccatgatcttggctcactataacttctatctcccgggttcgaatgattcttctgcctcagccctccgagtagctgggattatagacacgcagcaccacgcctggttatttttttttttttttttttttttttttgaaacggagtcttgctctgtcgcccaggctggagtgcagtggcgggatctcggctcactgcaagctccgccttccgggttcacgccattctcctgcctcagcctcccaagtagctgggactacaggcgtccgccactacgcccggctaatttttgtatttttagtagagacggggtttcaccgttttttagccaggatggtctcgatctcctgacctcgtgatccgcccgcctcggcctcccaaagggctggaatgacaggcctgagccatggtgcccggcctttctcctttgattttgaaacaaaaacttgaacatgttcatgggttcctgcaggcacggtgggcccgggtgtgggccccgcacttcctgtgcctggtggaagaaaggcccggcttctaaggaaatgcgcttctcccaacctagagactgcctggcccacctggagaagccaggcatgggaatcagacactgtctatcaacccacggggcgtggatggaagagctgccctggatctgcttccttcccaggcgagatcatttgcttaataaaaccaagacagccagcacctcctgcaaactaaatccacgttctgttcgatgcgtagacgttattctgggtcggctccaggtgtccaagagttgttcagtgtgtgttcattaggagatggagtatctgctggttgtactcactcactcactcactcactcactgaacgtgcaggaggcatcttctctgtgccagatgtgtgaatcacagccctgccctcaggggctccatctgtgggaagatgaactgaaaggagaggtgagtgtaacaaattaccacccatgccatggctgaagacggcgcacgggcattctccccaggcctgaaagtcagaagtcctaagtcagtttcattgcaccaaaatcaaggggtgtgccgggccctgctctgtccggaggctcttaggcagacactgtttccctgccgcttctgtcttctggaatcrcatggggctcatggtcccgtcctccgccgtcatatcctgtagcgcaatgtcttcaagcttctctctgctcttttctctgtcttcaagtcgccgcctcctcagcaggggcacctccctctgctcccctgctaggaggacacctgtgattacctttagagcccacctaatcatccaggataatctcctcttctcaaggtccttgacttgattgaatcagcaaagtcccttaccatatacatttccgkgagtaggacctgggtgtctttagggccgttattcagccaacgacagccagtttgcctgggcccagtcatgtacatctgagcctcagtttccccatttgtaaaacacagtcagtaatactgccttgcaggtgttgtgttaggagtacgcagactttaaatgctgaccagagtgcagaaggcggcggacgtctccagagctcctcctaatggtagtgttttgktgtgagagtataaagtctggtggggggtgtagctcgagagcccccaggaattctgcccagatgtggaatcctttgtttatccccttgcttccagcttaggctacatgcgggaggcatctggagagttttaaacttgctatgccgctatcgctacttggagtggagtccagatgatggggacattagagcctcccatgattctcattggcagccacagttgagtccattttgtacccaggctggagtcactgcgaatggccgccacctctctttttgcatagccaacaccggcctcttaggatcacctgggtcctgttggccgacttggaggtgctgccttttcaatgacaaggcgtttgttatgtgtaaagaaaggygttgaattggacggtctccagcttctgcccagcatggagcctgcaacattgtgtgggagtggggctcccatagggtaacaayggctcacccagctcaccgtgcccactgtttgccagccatggggtctcctgcacaccccatcatagacgcaggtgctgggccggcatccccctttcacaggaaaccaggcgttggggcgaatgccctttgcagggtcactgcgtgtggccgagcaggccaggaacccgggcttatctcacttttagtccctggcatgaatggctagttcgtccatcaagtattttcaaattggttgaacgatggagttgctggtggtcgtggttctccaagatgcttccgatcatggcatgttgttgtagaggaagcttaaaagatactgcaaggtcctggaggaaacgccgatgtctggctcagtaacatcatccaatgttccagaattcttctaagtatctcatggggagggggcagggacttaggaaagtctccaaactgtgacacttttatttcactttaattaggaaaaaagagatgctgggctccttggtgcctgcattcacgattggtgtcccgatagaggctgggatgttccagagccttcctggggcagggggcctggccagggctttgaagggcaaggagagagggcagggcagcctggcatggtgcggaaggaacggggtaatggcagagagaacaagtatgggggaggggagccagtcctgacccctgtgaagtcactctgctgttaggggccctataacaaagtaccacaaactggggggactcagagcaacagaaatttactcccccactactggaggccagaagtctgaaatcaaggcttcggcagaactgtgctcccttggaaacctgcaggggagactctgtccttgcccctcctagttcctggaggttgccaccatccttggctttgctgtgtagacacagtgctgtaatcttccgtcctcacgcggccctctccctatatgcgtgtctgtctacatccaaatttcccctctttataaggacacaccagtttggttggattagggcccaccctgatgggctcatttgcaaagatcctattttcaaatcaggtccccttcacagatcctgggggctggacttcagcatctctttttgaggggcccagcgtgctctcaacttgtggtctcttgtccttctcctgagatgcgtcagggtgtaaggcatggttcccccacttyggcgatgagatgtggggcccagagaggccaggtgacctgttcaagatcacacaggcagcagcttacaggattcaattccgagccagtttctggagaggcccgtggccctctctctccttaggccatggaccccatgctgtgccctgcagtggctgaggagaccccagctccagagtctgcacagggcagggggaagagagagctcagcctgtaggggagctctttgccacaccacgggccgcccgctgactctccctggatgtatttctttgcccttctccccttgactgttccagggactctygcattctcgttgcacggttcggctggctcctcagccgttgggcctgggatcctggaggaaaggcttggccaggtttcggaggacacccccgaggaggtggttcccccacagccctgcaggagagaatgggggttctttttaaatctagacaggtggggtaccaggagccaaactgatgtggcttcccaactggagaaacaggtttaatgatgccccatctcttcaaggacttgaaaccctcttctttttttgagacggagtctcactctgttgcccaggctggagtgcagtggcgcgatcttggctcactgcaacctccacctcctgggttcaagcgattctcctgcctcagcctcctgagtagctgggattacaggcactcaccaccacgcccggctaattttttatatttttagtagagacggggtytcaccatgctggccaggctggtcttgaactcctgacctcatgatccacccgcctctgcctcccaaagtgttgggattacaggcgtgagccaccwcgtctgcccctgaaaccctcttctaacaggacatctgcacctgtggtggcttggctctcttctcagaatagtgttttcagatgcacagaataaaatgcaaagggttacgaaggaggccagttaaatggaaccaagtccttctggaccaccctgagtgaggcagccctgcagtgtagacttggagaaaggcaggtagctggagcccgggcaggctggccccgggtgaacatgcgacggggcagctggttagagggttgagagcccgctctgctgtctgccaggcgcacaccccagggccagtgaggagatgagagtgaggataacagcagcgacagcagacagctccgtcatgctsccccccaacccaggtgctgttctcagtgtcccgtgactgtccctggaaggcgttcctttcactgctattcacaggctggagccaggtgccagactcccggccagtgagctagagccgcagggtctgtgctccggcccctgtccagagcctgtcccaaccccaggcaccatcagggcttgcggctatcatcgccaggcagccctccctggctgggctcctgccactgcctctggctgccacgtgcctcagacggctgcgccttctttctccggccagctctgcctgcttcatcacagctctgcgctctgctgccctggcccaggtgctgtgcgctggcctgtgcactgcagctgtgatctggactaaacggcgcctttccctgtgggcactgcggccctggggagcagcctggctccatcctgtctgtgtcccttgtcaggcacaggctccatatgcactgtaggccatcccagtggactggagtttctctggcccttagagagggtgatggccctgagaaggcaacctacggtcggggttgggggagtggaggcgggagacgtgactgaggaactggcaggacctggggaccaggaggatgggcctgctcagaggggatgtgaatctgcctgccaggggcctgaggggtccctccctaggtgaagggacacagaggggacaggtctcattggagttgtagtgggtctgagctggggagatgggagggcgggcggtgggatgtagcaggtagccaggcggagtgcgagagcagcctgggctggggtctcagggtcttggtgctgcccttgtcctgccccgggcactgtgctgagagcccctgggaccaatgaatctggcagcacaatggacaggaatctgactgcagagaggccacgtccctcagctctgagccaccccattcagctggtcctgtggccagggctccctgcagtcaggatgcaggctcggggacaattgtgaggcctggagatgaagacctccgggaagtggaggcaggggatgagctgcagtgactagtgtggctctccaggcatctgcagccttgcagagacggggacgtggtggaggtgtcgtcccatgtcatagggaaggagtcygtggctcagagaggttaaggggcttccaaggtggtgaggctggtaagctgcgaaggtgcagagctgcaggcagaatctgcaccctgggccctggtgctggggcctgagcggcttgcagggggtgcataggggcccccaaagagaaggagggttagcctcagcattcacggcagggtggccgcccgtctcccaggtgaccatgctgcacggctgataggacactttctcacgtacatctcctgcttccccaggaccagtgcctgggacgcccttggtctcctatcacagatgggaactggggactgcatggtgttaggggactccaagcctagagttcctgaagcgggcagggctcaggagggcactctgctggagggtctacccagttgagcttcgggactgcagccttaggaagcagcagagctccccagttctttaaccttgttggctgtagggtctgtatgtggccaggggagagtcccagcccctygcatcctccaggctgctgggaggggcggtggggagcgagcagctctgtgcatgttcatacgattacggaggccctgccacgtgctggcacctggcatcctcccacccggccagggagccccatcgctctctctgcctctctgggcaggcggagggccatctgcacgctgttttagctttttattgattgatttattttgaggtagagtctcgctctgtcacccaggctggagttcagtggcactatctcagctcactgcagcctctgcctccygggttcaagcgattctcctgcctcagctttcctgagtagctgggattacaggtgcgcaccaacatgcccggctaatttttatttttagtagagatggggtttcgccctgttggccaagctggtgtcgaattcctgacctcagstgatccacccacctcggcatcccaaagtgctgggattacaggtgtgagtcaccacgcccagcccgttttggctttgagacatactctcgtccctgccaggctccctggcagccgggtgagtgccttcaaggtccaggtccagtgtcatctagtgacccatgccccrtgccctccagccggggcaggctgtccccctccaagccagctgtcttgcagctgtcgtgagttcatctgtaaacaccagctgaacacctactgtgtgctggggctgtctagtgctcagcataccatggtgaagaaaaccgaatccctgtccctgaggacacttaattaaccacatgggaaaccgccgagggcgaaggccaatggggctgcagaggttctgtctttcctggtcccacgcaaaagcaggctggtgtccatgcgacactgcgtcccagcactgagcccagggctcaggacacatttgctgagcggatgcttggctggtagctgatgcaccaccgccgtgatggggcagtgggcagcccaaccccacttctcacacatgtgtcttagtggcccgagagctgcctgggcaacagtggggcttcttcatatctgtaccctgagctctctrtgcaggaccttgggtactaaaaataactaatttaaaatgaatgtcacttatgaatatggtgaaaaattaaaatgttaccaaaaaattgcccagtsaacagtgatgcttctaacctcttgtgcccagctgcccttaccaggttcttccagagatagtctctgcacatgctgtgtgggggggggccttygtgtkygggtgtgtgtgtgtctgtcctgctgccttccggccacccctgacagtcccacctctgcccacaggtctccgtgttggtcctcttcgccctggccttcctcacctgcgtcgtcttcctggttgtctayaaggtgtacaagtatgaccgcgcctgccccgatgggttcgtcctcaaggtaaaactccgttttcccccagaggccctgggacgcctttgcaccccatgttctctcccttgaactcaaggctgctcctgccgtctcccccagctggcccacggacaggccttagagcagcagggggccagtgtcaggagtgtccctgyggaaggcccacctggagagcagggcaggtaggcagggggcacatgagacccacaggaaggaaactcccggacttggcccctgggagctgacctcagcagtccggggaagggccctcctcgaaagtgggcccagccagggtctgccgtgggaaatgcccaggatgatacctaccggatcccagcggattgctstgggggagggagggagagagacgggaccatgtccgccacatgaaagaggagaggatgtactgggggaagccaagtcccacagagaggaaggccttgcccaaggccacgcagggaaaggggagcagggctggggggcacacccaccctcctgacctgtgtccctctcctgcytgtcccaccgcaggagccacactggtgctgggctctctacaggcatggaaatgctcgctttgcatatataatgctcattcccaaaagcccacaagtgacatgcaaggcaacgggattaaagggaggggagataagggtggaaagagaagacggagccaggggaggcctggccacgcatcacttagtgacgggaatacgtcctgagaaacgcgttgttaggcgactccatcattgtgccagcctcacagagtgtcctgtacacccacgcggcccagcctgctacacacccgggctggagggtatggccgactgctcctaggccacaaacctggacagcatgttgctatactgaacaatgtaggcagttgtcacacgatggtaagtatttgtgtatctaaacatagaagaggtccagtaaaaacacgttataacgcatggtccacctgaatagggcatttccatcatgaatgcagcttgcaggaccggaagctggtctgggtgggtgagtgagggagtgggtggtgagtgaatgcgaaggccgaggcatggctgtgcactcctgtagacgagtgagcrctggacatgtgggctacactccattcataacatactctttcttcagtaataaattaacctgagctcactgtaacctttttacttcataaactttttgtgtgtgtgtgatggagtctcactctgttgcccaggctggagcgcaatggtgcgttcttgactcactgcaacatctgcctcccgggttcaagcgattcttctgcctcagtctcctgagtagctgggattataggtgtgcgccaccacccggctaatttttgtatttttagtagagacagggtttcaccatgttggctaggccggtctcgaactcctgacctcaggtgatccacccacctcggcctcccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccacccacctcggcctcccaagtgctgagattacaggcgtgagccaccacactcagccaataaacttttaaaatgtaagtttttgactcttttgtaataacacttagcttaaagctcaaacatcttgcacaactgtatattatttttctacatgtgctttttctattaaaaaattttttaattctttttttacttccaacacatttttgttaaagctaaggacacagacacacacattagctaggcctgcacagggtcaggatccacagtatcaccgccttctgcctccacaccctgtcccactggaaggtcttcaggagcagtgacaggcacagggctgtcatctcttakgataacaatgccaggccaggtgcagtggctcacgcctgtaatcccagcactttgggaggcctaggtgggtggatcacctgaggtcaggagttcaagaccagtctggccaacatggtgaaacaccgtctctactaaaaatacaaaaattagccaggcatggtggcgggtgcctgtaatcccagctactcaggaggctgaggcaggagaatcgcttgaacccagaaggcggaggttgcagtgagctgagatcatgccactgcactccagcctgggcaacagagggagactccgtctaaaaacaaaacaaaacaaaacaaaacaaaacaaaacaaaacaaaacaaaacattgccttcttccagaatctctcttggaggagctccctgaagctcttttagagttaactttttttttttaataactaggcatgcactctaaaatactgattaaaaagtatagtacggtaacataaacaagtaacatacgcgtttattgtcactgtcaagtattatgttctgtatgtaattgtatgtgcaagacgtttatacagctgacagtgcagggggtgtgtgtataccagcacctccgcaaagtgaggagtgtgttgtgttccgtctacacggtggctgcgaggtcaccaggcgacaggaggtttcagctccgtgacagtcttatggggccaccatggcatgtggtccatcgttgacccraatgctgttatgccgcgtgtggctgtaaaacgcacttgctggttccccacagggaggagggggtggctaaaactgccttccctatcctgcaagcccaagtcccgctggatacctggcctgggtgggagaygacccaggagatgaagccccagtcctgtgtccggctgcagatgagactggcggccacaatggaaggggcctggcaccttttgtttaaaaggcgctccaggtgattcccatccacagccagccttgggaattgagagtcccctgataagttgttctggagtgatgtcctgtgggactttggcattttccactagcatctaatgagggggtgtcctttccggagaaggcacctaggaaggccagggagctgctggtctgtatccagctgcccttggccraagctggagaaaggagaggcgtgagctcatgaagtccccttgacctcctccctccatatttgtgcgtgtgtttgtcacacaccaacgctaggcagcttgtgtggggcttttacacctgttgctcacggaatccatacactcggtagctgtgggctcccgttatccatacactcagtagctggctctgaacttcccagagtcagtgtgagatgctcatctccagggcttggcactgctgagattaaaataaagcaggagaagccaactgtttctagcactgagcacgtgcacagggaagcctggcttggcagctgtcactgggtagcttgggtttgggtttcatttaggttttgttttttgctgatatgaggacgcagagagtccttacgcgattagcaggaaaggctggaattcacgttgtccagcccaagtccctttttctccttgcacatcatgctgtccttcaggctcccgacattcagctcttcctcccttgggcaggcatgtacatggcacccaccccgtgccagcagctcttgctattgttctaggcgctggaacacagccgagagccagtcaggtacagccccctgccttcacgaggctcttacattctcaaatgaacggtgaggaagtcagtcgtacactgaatgtgaaggctatagacagacaggaaagagggcccaggggttgggcatgggcatgtgggcggtagtttctagaaggatggtccacattggaggagcgggtctccaggaggtgagccagggagcttgcgggtcttgggggagtgtgcccagccaaggaaagcccccaccctttcactcatgttttattcagcaagccccgtccacgccctaggctggggctgggagagtttgagtctgttttggaggctgagaggacaccagggctttacaacaagcagaagcggagggtgcgggcttcagggaacgagggcagtgctggccctgacccagtgggaaggggtttgtgatgktagaggagcacagagggagcagcgggcagtggggacgtgctggtgggggtgtgctggtggggggctagccacaggcacagggaggcggcagaggatgaaccagcttacggccagagcgggtgcatcctgagtgccaggcacaggcccctggaggagggggaagtgatagggtgacctcttgggtcacctggggaggctggagattggaagggagagacggggcagtgagatgaccaaggagactgctgcagtggctgagggaagagaagactggggcgctggggatggaggggagactgcagactggagaactgatttaatctgggaggcagaggggtaaaaggaaagggcctggtgcagagctagttactgagggaggccgatgtcatggagagggagcacgggcaggcccaggagctggccctgagccggagagaggacagcagaggacagcttcctgggggccggaagtccccaccgaaactggctacttacaaataactgaggccagtggcttcaccagctgccctggagcttccttcctggctcatcctctctgggcctggagcaggttccccacagggaggagggggtggctaaaactgccttccctatcctgcaagcccaagtcccgctggatacctggcctgggtgggagatgacccaggagatgaagccccagtcctgtgtccggctgcagatgagactggcggccacaatggaaggggcctggcaccttttgtttaaaaggcgctccaggtgattcccatccacagccagccttgggaattgagagtcccctgataagttgttctggagtgatgtcctgtgggactttggcattttccactagcatctaatgagggggtgtcctttccggagaaggcacctaggaaggccagggagctgctggtctgtatccagctgcccttggccgaagctggagaaaggagaggcatgagctcatgaagtccccttgacctcttccctccatatttgtgcgtgtgtttgtcacacaccaacgctaggcagcttgtgtgggacttttacacctgttgctcacagaatgcatccagaagccctttgaggtggatgctgttatatccccattttaccagtggttagagggtgtacagaggctcttcgtggagcccaaggtcacgcccttcagttcacttggtacagtcagcatgtactaagtacctcctactatgtgcacactggactcgacaccttgagggcagggacctcagagccccaggcagtggggaggggacaggctttttctggacagccactcccagtggccccaagctgaggcatatcgtgaggagggtgaaaaaggcagacgtggcccgagaggacactaggtttctacctctgcctttaaaaaaaaamaacaacaacatgaaattactacatgttttataaaaaagttttaaacataatggggaaagtgccccaaatcccacatttttatactggcttttccctttatattggccattcttttttttcatgtagacaggttacacgttcttgctatgttgcccaggytggtctcgaactcttgggtttgctcaagtgatccaccctcagcctcccaaagtgctgggattataggcatgagccatcgcacccggaccttagtggctactcttttccagtgctgactgagtgctgggtgctgggaacacacttacgtagctacctcagtcctcccgtgccccacaagacaggtccgtcatcagcttcacttcacaggtgagggaatgaggcccagagaagttggggaacctccccaagctcctccaagtgcaggcccagctgagtcacgctcccctcaaggcacacaccccacaggtgagggtggctytgtatgagatgggtatggggggcggcaggagcctctcagaaagccttccctggcccatgtgggctcacggcaaggcctctgcattctgcttccgttgggaagcccttcaccccctggggtgctcgccaccatgggcaccaaggtgcctccccagccttgcctttgggcagccacgttgtctgggaggcatctggggactccatctgtccttctccctgggcggggcacctgtagggcagggccgtttctgagccatctcgtatgccagccctgagcggggccgccactccacaggtgttggccgcatcaggtcttgcaggactctgctgggtgccgaggtgggagggaagaggggaacccttggtcygtttccctgagggatgaygagcagcagatggagaggacagcgtgaaggggcgtggcggtgaggctggaggggagtttgtctggcctgcagagcctccttcctgatgcacgcgctgctggtctgaatgggctgtttgttctgtagcgtgtcaggtgcttcccgacgtcctggtgggactgagatcaagacgctgttgataaaagggctgtacttcagtggtgtcttttggctttcttttctgtccacactgtgacctggggcacatcctggcttctttacttgagccactgtgcattgacttgagtcctcagcaacacggtggtgtgactcattggccgcattttataggtgagggacctgagattsagagagaaaacactccgcacgtgaactcagctggtacggtgggcctggctccaaagcttcccttctcctgtagcgccgccctcctgccagtggcagcccctgaacactggatgcggggcagtgttggtgagaagcacattccatttgtcatttctcttttgaaaatagctctttgttcacaagggccttgcaggtataaagtattctcatctttagacttcagggttcaatgagctggtaacagagaatggattccccatgggggctgggtggcatcaggagctgatccctgtacacctgccttaagcccgtggaggtgagccactcacctcaaggacaggctgcagccacagctgccaaaacagggaaaacgcccccggccctgcctgaaccacagggcctggcctgcagggaatgggggtgtggatttgctgccagaatccgcttcctgataaacctctgtaagacccaagtgctgtctcgcactcccccaacccacggcccctccctaccccctcgccatcttcccagcccctagtcatgaccacctagtggctctgtgtgcctcttctgactcccgccccaaggcccctctctgctctggtttcctttgccttgagtgctgcccctccctcatctcacctagctaaggtctgctgagaacctagctcaagggaagctcttctcacttcccttccgtcctcatttgaattggttgttttgggatatttcataagttgttgttttccaattgattaaaaatgacaactagtgcaagatcttcagtgaagtaaggcctgctgtcccattacactggcacccttggagcccaagtgcccatctgccatggcactcaccagccagtctattaagaataatcaaggccaggcttcccctgtgctgtgctctctcagggcaagatccatgcccgtttttgctcatcactgtatctattcctccaagctcagggaaggtgctcagtaactgttggctgccaactggagacacactggcaccccctcttgcaccgacgcgtgctctcagtggcctcttgtctttcagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgygaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatmccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggacttwattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgytctgggggcagcagtctttggaggagtaataatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctgggcagggacgggagcacaggtgtttttatcacacaggattttggtttgagcagccctgaaatgcccccctcttcccacgtgctctcctgatcctggctgtaactatgggtgtcgttccatctgtgcttaccttgaatagatggcttttgagatccaccagaagacaaatgggttatatttccctctgtttggccatcatttgggtcctgcacaattctccctcaacacaactctcggaatcactcccttctgtcccagggttaagggccccgagcagagtgtgaccgcaagctttgtgtttcccagtaacatgatgtccgtggtgacccaaccctgaggactgagcttgggaaacagtcccctcaacaggatggctgtagtgtcctctgtaagcaggggccaggctctgacccctcggtgggggccaacgagctacccatgtacatccctggacatgaagagctggcctgaccctgccaggagtacccccacccaccctggattgctcctttggaggctggtgagccactgcctctcgaaagcagctggaggtgggcgacaggtggtgggtctcatgaacacacgcagctccgcggtcacacaattttgtgatcagccccgtgagctctgcccagcaaggctcctgggcagctgtgccggcgagactaacacccgctgctgggactcagtgctgcgccacgtcgcacctggggaacctaaacagtgcctacctctcttatgtcttcgttgccttccttgatattttcagttgcccccacaactaactggtgaatgctgtcaatctcagcttcctgtggaagaaaagataaatacaagttgagtatcctttatccaaaaacctgaaacccaaaatgctccaacgagcatttcctttgagtgtcatgtcagcgctcagaaagtttcagattttggagcacttaggacttcacattttgaagtttagggatgcttgacatatacagccacttcctcctccctgaagcgtatatcatgacaagaacaggagccgtcaccaagggctaacggctttacttgcatagccacaaatcctcacagcaccccaagaagtaggtattacctctattttatgaaacggaaactcacggctcagagaagtttactaacttgcccaaagtcacatcacacagcaaccaagtggcaggactgagacttttttttttttgagacagggcttaaacgatcctcccacttcagcctcccaagtagctgggagtataggcatgtgccaccacgcctggctaaatttttaaaattttttgtagagatggggggtctccctatgttgcccaggctggtcttgaactcttgagctcacaccatgctcccgcctcggcctcccagagtgctgggattacaggcatgagccaccgcgcagggctgagaccccatcttgttgcagtgctccttccgccacacttaccatccctcctgcgccactcgccggtgacggacaaaaacctaagagctattgtttgtggagcagccaccatatgccaggggcttcccttctagtctctcatttctttctgaagtccacagaagtaagctttaaaatgtatgtgcttcgaaatacatatgctagcttcaaaaatagtgctttgtgttttactatcatcatatctcttaaaaaacaggctaaaatttaaaaatcaaaataggatgcaggatgcttacagaaaacgtttactccaaacgaagccttgaaaagcttgagaagcgtgggataacacagggggcgtctggccccacaggagcagagacggtgctagacgtccttacaagcaggagtgcctgcttctctcctcctttcggtggtggtgaagctgcttcctaacagggtcagggcagaatgaatgctagcgtgggtttttagagaaacctgactgacacattgtagggaggaaggcagcatgtggcctctgattcccagcaatgaatattactgggatggctttgcctcatcatcacccctttttagagagtctcaaagtgtgaactaagtgaccactgccaaggttccaatgagagaatcaatatgaactacaatgcaacactgatggaaaaaacaagaaagacacattgttcctcaggacttaggaactcccagtgggccgggcgcagtggctctcgtctgtaatcccagcactttgggaggccaaggcaggtggatcacctgaagtcaggagttcgggaccagcctggccaagatggtgaaaccccgtctttactaaaaataccaaaattagccaggcgtggtggcatgcctgtaatcccagctactcaagaggctgactgaggcaggagaatcgcttgaacctgggaggatgaggttgcagtgagccaagatagcaacattgcactccagcctgggcgacacagcaagactctgtctccaaaaaaaaaaaaaagaaaaagaaaaaaaaagaaaagaaaaagaaactcccggtgagccaaggcaaggctctgcctatgctctgcacgcccctcccaggccccctggagccgctgggaggtttgaagcagggtagtgttattaaaaagggcgactcctatgaacccgaacttgcaaaccactgttagacttaatgtacctcatttacaatgatttcactctggctgtgtggtttatggaaagtcattttgtgagtgaagtatcttaagtcaagtagtccagtttaaaatactggagaaaattttgtctttcaaacgttcccatagtctttggatgctaaaaataaaagggcaaatttatcaggtcttgaaaagttttgccagttattggctggaagaatttcagaaaattcacttgaaaagaacaatcctatttcccacgcagacaccatccctgaggtggcatggaccgcgcgttgtgagaggcctgggtctgagctcctgtaacctactgactgaaaagcaactgcccgtcagcatcgtgctggatgcttctgcagttatctctcaaacagagaataaccctgcaggagtccctccctcctatagatgggaaactgtagcttgtgggggctacctagcttacccagcacatccagaaccctgactgccaggcctggactctcctcccacgtgccaccgcatgtgctaccacatggggtggtcagtgggtcccctgtggggagctcctcctccatcacacgtgtgcagaggcagctctgggtagtgagagcttttccctgaggagctctgcgcacacacacctgctagcaacacatggctctgctcctggctgtgtagagcagcagcctttgggaaaaatgtctcgtgctctcaagtacattcccctttgagtgaaaacatacagctcctttgtttttgtttttttacctgttgcaaaaccttttccgtgaatatctcttggagtctggaaatctcaaccactctcccttcgatttgccttcataaaaagaacagattacatattaactattagcacttggtaatctaacaggactgttacacacttctaaagaaatcctatcttctacgtgaaggtgggagagacagagggggcacactgtgtcggctgggggaagaggagatgggagaggaaggcgaactctccttactgggtcaccttccctgtcttctggcatagcctagcacactggtctttttggaagtccactctaccatgccaactgaccctcagtcccaagaggtgggtgtgtgcagtgccctttgcattctgtgtcactgctcggggaatggggagggcctggttgtgccccagttacagaaagcagtctccagtaagttctctgcctagcctcatcaccatggtaacacatggtggggattcagaaggtcagaatatgctgatgatccagctttgttaatgctcagcaggttaaagaaaaaagtgtatttaccttcaaaccaactccctgttccaagaaaaaagctcctctgattcatttagaaaatgccatgtcttggtttggcaacggagtgttctgtcggatctgaaacacttgggctagccatcttcctggtgtcaggggcagcatgggctaccctggggggcgggtgggggcacatctatttagaaacagaagctggcccaagctgaagtcaactgctgttccagcacaaagcagcgacaggaagtgacaggaggcaaaaagtggtgggagctgagctcctggccaggtggaagcagtgatgaatcccaacagtatcacagtggcagggggcaggggaggagatgtgggaagaaaagccagtgagtatctgggcatgggggagtagcggggtgggggcggtagtggggcagacagtgaaagctaggctgtcagaggaggactaggaggtccatctctgagggcagaaggcgaagagccccttggaggctgacacctacactgagaaagtcctcaggctgtgtgagtgcagcatcaggattgattttatttgggggacatgtccacaatacaacaggctctgcaaagtcctgggccttactttcagcatgctccaagccttcccacagaaactagaggctaatgggtgcatgtgtgagtgaccaaggccttgccttctgcattcctgactccctggtgggtacaggagcaggcagaccccagtggaaccatttgcagaagagggcttcccttggttagctgcccttcataagggccccatttcatttcagagtcgctgcgtggaaacagcccgaatggtggtggaaattatacgcaggtaatctgtagtcactcctgtatctctcggggtgggaagcacctgggccccccgcagcagtggcagcaggcaggaggtaacccacaggcccacaagctgagggagttgtggattcaggccacatgcccaccccagcccagtcaaaatggctgaggggggctgcaccagcccaagggccccatggggatgcctgggcaccaaggtaaataaagttcctagttcctggaaaagttgtaaagcaggctatcagctcacagaggagctacaaacatacctcacttcatcaaacaagctgttcatttcaccaattagtcgctgattttcctgttcaaactgtgaggaaacagacacactcaggatgacatcatactgaacttaggcaagagtctagcaagaaagcggacctacgctccaggaatcactgccgaagcccccatttccagctgcggcaacgtggcagccggtgctggacgaccgttagcattagtgtgaacaacgtccctgctttcaggagaaagttttaaaaaa

SEQ ID NO: 10743 - DNA, 134134 bp, Homo sapiens
  misc_feature (1)...(134134): n = A,T,C or G, or insertion/deletion polymorphism (see Tables 1-2)
tagatccagttcattctggcctctagttttccttgtgggacagggggcctggtcagttgtgactctccaaggggagatcaaagaagagatggggaaggaaagaagagcaccaggctaggcagccgcaggacttatcaaccacaagaaaggtacagacccagtgaagctgaaggcggcttacctgcagagctgagaacccaaacaggggctgagggccacacccaggaagtagaggataggtaatggaggaaggatgggcagggaaaagagttagggtacacgttaatttcctatggttgcagtaacaaatgaccacaagctttgtgatttaacagaaatttgtttcttacagtcctggaggacaaaagtccaaaatcaagatgctggcagggccacgctcccttcagagactctaggggagaatacttccttgcttcctctggtttctggtggccatcagcattcatgggcctgtggctgtatctctccagtatctgcctctgtcttcacatggccttccattctgtgtgcctcttttaaagatatttgctattggatttaggggtcaccaggataatccaaaatcatttcttcatttcaaggtctttaatttaactctatctggaaagacttcttttcctagtaaggtcagattcatgggttctagggatcaggatgtggacatatcttttggggggccaacatttggctcattacagggtgggaggagacacaaagtaggatgaaacaagccagtaggctagagcaacgggctcaggatctagaacaagaatcaggtaggaatgaggtggtggcagcccctcctttaggtactctctgtgtatgagtccattttcacactgctataaaaatactacccgagactgggtaatttataaaggaaagaggcttaattgactcacagttctgcatggctgaggaggcctcaggaaacttataatcatggcagaaggcaaaggggaagcaggaaccttcttcacacagcagcaggaaagagagagtgaagggggaagagccccttatgaaaccatcaaatttcatgagaactcactcactatcatgagaacagcatggaggaaactgcccccatgatccaatcacctcccaccaggtccctctcctgacacatggggatacaattctgatcacaatttgagatgagatttgggtggagtcacagccaaaccatattacttcaatgggcggtggggggacaaaggccacacctcaaagggctggaccacaacaacctcctgtttgcttcctgcctttccctcgcttttttttgcacatctgtttcaaagctaaacttctgggggagctgccggaagaaacccaccttgggccgagttcagtggctcatgcctgtaattccagcactttgggaggccgaggtgggtggatcacctgaggtcaggagttcgaggccagcctggccaacacggtgaaaccccatctctactaaaaatacacaccccccaaaaaattagctgggcatggtggaggacgtctgtaatcctagctacttgggaggctgaagaaggagaattgcttgaacccagaaggtggaggttgcagtgagctgagatcacgccattgcactctagcctgggcaacaagagcaaaactccatctcaaaaataaaaaaataaaaaaaaagaaagaaagaaaaaaaaaagaaaaaaaaaaacaagagaaatccaccctgaattctttatctaggttccctcttgggaacaaaagcttcttctttgagcttcccacccctagagtcagggtcctttccagagtccctgaggggggaaaaatggttttcaatgaatttcattgagtttacctcctaacgtgaaggtatatgtttttgaaggcctttcctcttgtgttataaattctaccctgccatggtcacagtcttccaaggtttctgccactctgtccctgccagcctggtcttttccattggttaggtttaggcacaactgttctttcctctccatgcttcattcactgaggaataatactgttacgatggtgagtggagaatacatctaatattcctgttttggtagatacctagatatgggttgtcatcaatcaggacaggctaattatgctgcagttaacaaacacccacaaatctgtggacaattctcaatcttagtacatgtctgtgatggttaatattgagtgtcaacttgactgaaggatgcaaagtattgttcctgggtgtgtctgtgagggtgttgccaaaggagattaacgtttgagtcagtgaactgggaaaggcagacccactctcaatctaggtgggtacaatctaatcagctgccagcatggccagaagaaaagcaggcagaagaacatggaaagactagactggcttagtcttctggcctacatctttctcccgtgctggatgcttcctgccctggaacatcagactccaagttcttcagctttgggacttggactgtctctccttgctcctcagcttgcagatggcctattgtgggacctcaccttgtgatcatgtgagtcaatactccttaataagctcccctttatatatacacctatcctattagttctgtccctctagagaactctgactaatacaatgtccttggttggctatgctccatgtcatctttacttaaggactcaggctgatggaacattggaacattaagggttgtcatagcagagggaaaagagcatcgtgaatcatacattagctcttaaatttgctgcccagaaattacacgttggttttcactggcagcctacatctagtctccttgcataggtgttgctgctgtagtgagctatatttaggggtgccaatacagttgatccttgatgactcctccacccctcacagttggaaatttgtgtataacttctgactccctaacatcttaactaataatagcctactgttgaccagaatccttatcaataacataaacagtccgttaacacatattttgcatgtcatatgtattagatactgtattctttcaataaagtaagctagagaaaagaaaatggtattaagaaaatcataggaagagaaaatatatttactatccattaaatggaagtggatcatcataaagtaaaggtcttcatactcaccatcatcacatcgagtaggctgaggagcaggaggggtgggtcttgctgtcttagggatggcagaggcagaaggaagtccgagtattagtggccgcatgcagttcaagcctgtgctgttcaaaagtcgactgcgtatttttcagaacagtgtctggcccactcaatgtttgctgaatgcataaagaaaacaaaatttgtatactacatccaactgggcagttgtgtgctacctccaacaggccaggcatggtggcacgcgcctatagtcccagatactcaggaggctgagccgggaggattgtttgagccctggagttgcagtagtatactctcacaacatttctgcacatccttttaacccacatcccctctcagctttatggggcttaatattagtcaactgtcaactgaagtcactttgctcttttaaattaaagagtaaacacaaaatgtaaaaagcacaaccccatatcccatggtctgtggaaagttcagcagcctcctcaagatctttgtgacttatttaggaattttatgtacttgtggtcacttgtggatttacagcctgatgttttgagctcacttgggtcttatatccaccacaatcttctctgctcttgcaaatccagacagaaaacttagatctttgtccctacccttctacccaaaatatccaactgcaccaaacacacggtttacacaaggcaccactcactgaaggcttggtgtagttcagcctccctcccactcaaagatccttcccagttacctactttgtactttcccggccccctccctgggttctggcttctcttttcttccccccaattcaatccccctcactttattatgcagggcaatctctctttccttctactctaccccaggcttaactttgcatggccaaaaactgattaatgtctggattaaacaaagggccatttatgcaagatagaatcattggcagagattttgtaatttctttctcttttcctcagtaggtggaagaaagctgtatggaaatttattttccttaaactgcaagaagtggctacagtttgggtttaaataatcttttcctggccgggcgcggtggctcacgcctgtaatcccagcattttsggaggctgaggcaggcggatcacgaggtcaggagatcgagaccatcctggctaacacggtgaaaccccatctctactaaaaatacaaaagaattagccaggcgtggcggtgggcgcctgtagtcccagctactcgggagactgaggcaggagaatggcgtgaacccgggaggcggagcttgctccagcctgggcgacagagcaagactccgcctcaaagaaaaaaaaaatcttttccttcctcctttctggtaaatatatactttcttgacatctatttctgataaactttatttttttaacacagtggttctcaaacttttggtctcaactcttttgcacacttaaaaattattaagggctctaaacaattttggtttatattgacattatcgacatttactatatgagaaatcaaaacaaaaacttgatgtttttgaaagtctttttttggagtctggcttaatagaaaacagctgttctgcatttactccgttgcaatatcacagtctccagcaaactcaactgtatgcaactcataagaaaatcagagcgaaaaggcaaataacatcttagtattgtgaaaattttatcttgatgaccattaaaactgctgttttaatacatattctacttgtgcttcctctttatgaaaaaagaaatcttgaagaaatcaatgagattttgaattaaaactgaaccataggccaggcacggttgcacgtgcctatagtcccagctactcaggaggctgagtccgggaggatcgtttgagccctggcgttccagctgtagtgagctaggatggcgcctctgactagccactgcaatccagcctgggcaacatagtagacccccgtctcaaaaaacaacacaaaacagaacatgaacctaaaatgcagaagaaactcattgattgagttgtcaattttaatagctatggctcaagacggtacaattaaaaactatgcatgaaggatgaagagaatccagcggcattagggccactctttcacctttgtctccatctaaacttcctattcatccttcaaatctctgcacaggtgacgccttttctctaaagcctcttcctttaccacaaataacagtgattataataataacattattaacgattactaccatttattggccacttactaggagccaagcaacatcaaaacacagcacgcgtcagctcacttaattttcacagtaaaccccgaggaggatgctggcttcactttaaaaagaggtgactgaaggttggagaagaaaggcctctggcctctagctctgtgccttgcacacctgatctgtctcagcatttattgcatcccgagggtcaccgtccacgtgcctctatcctgctcaaggtgagttcttgcagtcaaaggtcaagggtggctcgtctccacttcccccgcaaccaaaccgcccggtctcagtgagggagccgccagaagggaaggagcctcctagcttcccggtcctcacgctcccggagcccacacgccccaaacagacacagaagagctcgctgagctctccgcgcagctaaaccctccaagctttgctgggagaaaccgatgcccgagagcgcgtcgcgaggttcctcctccgccaggtgcgccggctgaggccggaacctttttcctcccgccgcggtagcagggcgcaggccggaacctttcttctcgcgtcgccgttgccggggggaggcgtgtggggcaggaccagtccttcagcggccgggttcgcgccgcggtcgccggytgmttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccrgccgggcccgcgaagtggtgagctggttgctatggaaacggcgggttgaggagggggcagtcctgcgacagggaccccgggccccaaacsagaccccgtcccgtaagcattgtgtgaagggggtggctctaagggggacagaagagttggcctcagagaccctacagcttyttgggggaaggaacagccttattttgaggaagggggacgcatattggggaacagatttctcctgcggcgacagggattgggggacaagaaaggagatcctcagaaatctctatctggaaagtgcatgggcggctttgtgaggtcatgagttcgccgtcactacagacttgcactcaggggaaacctcctgacagtccttcgcttcctgttgcagcactgaccacaccatatttgcctgttctatttacttgtctgcctcccacccctagttgagattaaaaactgtattcagccgaactctttcttccctttgtctctgcaataagtaggactcagttcctcttgagacgggtttagggtaatctttcgcaaacacagtgttacagtcacctcaactactttctgttccctgatcagagcaggtgtcccttcatctccctgggaacaggaaccttttccttaagggcagggacagtgttgttttcatctcagaatgcatgactcatagcattgcttagtaaatgtttgttgaatgagtgaatgaacaaatggctgtctttcccattaaacagaaaactccataaggggagagctgtttgtcttgttcccttttgtgttcgtgacaccaaggaggtatctaggttttgtggggcctacagcttatatagttctgtctgccctcttcaagaaataaaaatcaccaagaaagattcagagctttggaagattgaagagagggaccctaaagcttaagcctcattaatttcacagtaaatccttctctgcttggcatacacttggcactgtatagacactcagatatttttgaatgaatgtagtcatgcatgcattaatgacagttagcagaggatacttaaacattagaaaggggattggaccagatgaatacactcgccctattgatgaccgtctatgaagcacctaccttctgaccagcctcgtgttagagtaatatgatgtaaaagcagtggtggagtagacggacatagacataaaacaagtgccataaagccttgcaggtgttgtgtagggcacaaaaagaatgtggtcagttctacctgaggaccagaaaaggctttatagaggcgatgatgcctaaaacaaatcttgaaagaggattagttggttccagtgcagaaggacatctcaggctaagagaatagtatgcgctaagctgtggaggtaggtaacagtctgacataagttggttcaataaacatttgagtgagactggaatgtgggactctcataaaaattggacgcggagatcttaaagggcttwgtgtatcattgcagagtttgaattttgccctgtagatggtcagatgttatctggtagagaaagcaccagagaaggagccaagagacgaggttgttgtctgaaccctgcaactattagctatatgatttcattaagcaagttttaagacctcagtttatttacctgtaaatggtcctttttttctcctcctccttttaaaaaactaccttggtcctctatatgtaacaaattaaagtgggagcttcctaggttgaaataagaggaagagaaacaggacactctccctcccagtttggcccaagcacttcttgagattctttttgtagaactgtggtatgaatatcacagtattggctttttaagggtcccttctaactctgaaaccactgatttattaacactgtgctaattttgagtcctgctcagggaaaggggggatttgggaatggtagagacaggaggcacagttgggttggcaagccctttggagagccctgtgatcacttccacctctccctgagtggtgaaaatgtgtttgagttttgagttaatgggcctcagggacagtaacagtcccatagggtgctgagttccctgtcactggaagtgattaaacagagtgatgactgcttttcagagatgtttgagaaaagctttgtgcatatgtcacagggttggaccgcatgacaatgcaacttgcagttctgctatgtattgatgtgagtaggtgtcacatcaccttaagtgagttcatgggctgtgttgttcagggacactgtccccctgacgtagaggaaacatacattcttttaagcaattttgattttatgttgtcattgctttgtgtattatctcctgttcttgcaaccgttccccactccccatcttctcttgtgggaagtttaactagaagagctagtgatggatgtcctgtgcttttactacaattagatgtcaaaagtttggctgttattttgtttggcctggattccttatagagaaaagtctggtaaataccagaagcacatattctaattcaggtttagccctggttgtcagacttaatgaaatgtaataagttatagtatgccttttggtaagtgccttccttgaagcatttgctgttacttctaggatgcgttttatctggttcaatttctattcttccattccattcctcaaatatatgcctgatgccagatttccatctcactgaattgttgtagaggttatattaagttgaataaaattgcattgaaactgcaattttattgcagtccctaccttccaacaacaggctgattgcttctgcatcattcttttaaacatttaacttttatgctcaattttactaaatttatatatactcaaatgcatgtctacccattaaattacaaatggagagtaacgacttttcarattatttgggggaggaacttatattattcgaacaactccaaataataatgaatatgtcactctgcaatgggaatttgattagttaactcatttgaagtgtgggactagtgaggatgatgggattggaaagagacctgggccttgggttcaaatctcgcttctgctacttagaaatgggtgaacttgggcaagtctgactctcgttttccatttctataaagtggacgtgataataccctacttaactcacaagctaagtagggtagcttctgagttaccctactcacatagtctatatgtatgtattttaaaaaaacagactgattattattgttcccccaaactacctcccccctcctcatgtaggccatttagacatattttctttagtggcaccaagctgtattttccaaaccacttagttttcttgcactttcattccttaatttagttaagtgcgtgaggaatgagtgaaaatcctgagcaggtactgatgaatcagcggtggtgcagaagtactgtctgcattcgtaaaagatggtaacatttctttgccaaggtgaaactctttcagtgatggcagatgtgtggcaggtatgcagcttttactttcttttcttccttgtgatcatggaagccagtgctaatttcttagtggatccctatagctcagaatcctttgcaacattgtaccccaggagccgttacctgttattaggcttgacattcaagttgaaatctacttgacatatagtaacagtagaatctgtatgcttaaagcagacccatgtttgtttgtttgtggtttttttttttttcactcaaaaggaccttgtgttcattttgttaatagataagaaaactaacacccaaataaatgaaattacttgcccaaagtcgtagcagttgaggtcatagcacagagccataagtagaagccaggtcctttgacctggtttaatgctgctctccctctgcccactacattctcctgtaatttttaaaccagaatttgtttggtttctgaatggcagtgagtttcttcttcttgagttaattctgaatactgcatactgaatggaacctggggcagaaagacttggatttgaatgtgtcttatctgttatatgaacttggggaagccacttaatttcagttaccttatggctaaaatagagtgagtaatagcaaccttataaagttgttaggtgaaataagaaaaggtatgcaggtgcctacatgagtccgagttcttttgtttgcaagtaatagtaacctaatgtaaattaacctgaacaaagtgggaataccttagctcatataactggaaaattcagggatagagcttctttctctagctcttatccataaagcccaggaaggaaatctagttggttctgcttgatcctctgctctctcttacagtagtcattatagccagaggaatgtttctttaattggtcaggtctatgtccacctcaatctgtggttaataggtggcttggatgctatgtagcccccaccagaatcatggaaaaggcagtgccctgtctgggaatagggagtaaggaatgttgggcaagcaaaagcaacaaaaacatccctcacagtgcctgggacagtgcctgatgtgccttcaccttgcctgcctggctgtcttcaactctgtggggaatgagaaactagaaaatgcaggagtttataatgacaggttctggggtgaggataggcctagagatgcctcatagtggcagctcttctattctcttactgacttataaaggttacaggagccagggggggctaccacacaggtaagcaagaaacccgtaagcaccgaactgctgtgcagaggcagcaggggctactgaagagcaccgcacaggaaagcaggaacccatgttctagccgcaggtctgccagtaagtgggctgctcatgtgatttctctgggcctcagtttccacattagtaaaactgaaagcttcgattagataactgcagagatttcttgtagaataaggacactttgattctaaataaggtaataatgatcctgaattgctgggaactctattttcagattaggcatgcagatgagattttgttcttgataatacattcttttgtggaagctaaacttcgttttttatttacttatttttaggaattgattatcttgaatctttggctgaaattcagagttcttggagtggcccaaagccagatgatctggccctgctccctctctggcctcacctcctctccccctccttttgctcactctactccagctattctggcctctttcattttctcacatgcatcaggcacatttcccgcttagaacctttgcatccctctacctggaacacttttctcctagattccatatggcttgatctctcagttcctcaggtctctggttaaatgttgcctccgtgaggccttccttgaatgccctgcgtaaagtggcctcctttttctgtcccttcccctagcagatcatatatccatttatttgttgtttgtctactcgaatatatgttttctgaaaatgaagaactttgtgttgttagcactgaatctgtagcttctagaacagtgtggggatgcaggtgcttaataaatacttcttgaattaatgaataactgttaatctactgtctctctcagttttggggctaggtgatctctgtccaaggctcattgcagttctaaagctctgtgatmctcacatgattcttgaatattacatgatgcacatttatacttagtccggtattaagagtaaacattcagtaaatagtagcttttattactaagattccgttcctccctcaacacatttacattctagtggaaaagcagacacaggtagcacaacaactcaggtatgagtaacaactgtaacttttttagcattgattccccaggtcctccttgatttccttttcagaggcagtgttgactttctgtgccagtgttgggacccaaaggttgagctgggaccacctggattataaattttacctaagggttgagtataatcatagttaggggatttcagttgagggagcatgattcaaagaagcagtatcatgcaacaggtacagtgagtccatgagaggcaggaaggacaggagatagggccaaaccatacagaagtaggattgggaaacaatggaggtttagaatgcaagctgtgaacagagcatgagtgtgctgaatcatatagatttctttttaaatatggcaggaaccttttagctaatgaaataaggagcagctttggtaaaagctggagtgagaggtttggggagagaggttcattcgccagcctactacccttctgttaccttccccctctccttgaggaacccctaggaaccaaccagagggcccagagacacacagtttaaaaaccactgctttaatgctctccagggcctgttttagcttcatgatgctgtgtttttatggattgcaataactgagtgtgtactataaggagagctcagcactgcagagttttcatgagattgtgagtcctttgtgtggattacacttctgaattttgcccaagacttaggaggactgtaagttttgaaatgtatttattcaataattgatttataccatcatccaataaacactgaacatctggtgtgtcaggcattgtggggccataaaaaaactatgaggcatattaacctgttctttgaaaagatagataaaggatacctaaatctctttaggggagaatcagtggaaacctcaaagtgatcatcaaacttggcttttaaggagaaaaaccattccaccagacgtaggtagaagggatgggtgtgagcaaaggcagtggcacacaacagtagggcagtttggggccagaggcaagactggtgtgactagagcccttttctggaggaggcccgggtgagggtcagagtgtcagggggtgaggttgtactgaagtaggttagagcaggggtccacaaactggcccacaggccaaatccggcccactgcctagttgtgtaaataaagttttattggaatatgtcattttcatttgtttaaatataggccaagaatgctttcatgctgtagcagcagagcgatagcctgcagaggcctgcaaaacttaaaatatttactgtatgaccctttagagaaaaagtttgccaactcttagatgagagcgttgttagcagtgctgaggagtttgtactttatgctctgggctatgcggcagaggcacgaaaggatcatgtttgtattttaaactaatccgcagtgttgatgatgggtttggaatgtaacaagactgacatggagagctaagcaggatgctgttgcagtaattcaggtgaaactgaggagccggtgacagtagggttggatgggagaaaaatagatgaagtaggtatttagtatttagtaggtaggctcaacaaacttagtaaaacttagtaactaattagtggaaatagaaagaggaggaggtagaataatttccagctttctggttgaaaagttaaatggtagaagattacaataacagagttttcagggttagagttgagtgccagttattcatgccttcttcttaattctaaatagtagagaatagatccaaggagcccatggacactggagttttattaagacagcatgtggtggataactccccagcagcagtgcttactgataaacctggattgaggaactcaatggggtccttcagctttgccacatttagaccttggagacagttgagtacaaaatagatacccagtgcctatgtacctatgcccagccagttgcatggagattgagacctgtctcagcaatacggccatcactaggctgggacttatggtggcgagaagtacaaggaggtagaaacttaggatggcccgtgtggatgccaggttctctcctgttattctcagttctgctttctttattcttgaatgaaactcatcttggggttaatgattatatcacatgttgtagaagcatgattctcagggatagttgattcattttctcctgcattccatgaagaatctggagtgtgtcaaagagttccctctttcctcacttttgagttggcagttgaccaattattatgtgtctcacctactagggtagggctgcagaaacacgtcttctcagtgtgacgtttttagtgaattcttcccatcaggggctggcttcattttggaggcccaagaaccagatttttctacatattgaggctagagccatctgttagggcagatatcagccaagctcacgtcaacttgtgtgtaagtcagaataccagttaatttgttgtaagcactgtaactaatgtgcagaagaatacagattttggaaactcagtcatttttgagcttctgctataggtcaggaactcggttaaggactttatgtgcccgatctcatttaatttttctctttttcaggggatagaaatatattattgagtgattttataatattgattgtattatgaataatgtggttgttgaattcatgtaaacttgatgtttgacgtctcttactacatggaaatccacatggactccctctggtgggtaaagtatcagtgaagtctacacatgttaattatggcttatggtatgaaaaccattttatgtttaaagcgtattacatttaatattgacttaaaaagaggcaacttcaaaactcctctaaaagaaagtgaataaaccagaggaatgaaagtatgatatattgaatgaacccaataactcagatatggaaagcttgcagcacagttgaaattttaaacccggcaatacttttttctttgttacagactttcagatcctcaaagactatgaatactaaagtttgccagcttctacttatcaccatctaacatatgtctgtttgtcaaaatgttcttaccatggaatttgtaagctgtatttaaccaagagagagacacttccatttcacaatattgtaacatttctatctaatttgtagtcaaatgataagaaaactctggtgaaatgaacacttgccttttcttggacattttctccagcagtgaattctatagtcttagcagaagtaacaggctacagcatatcttaactcagaggaattgagaaaggaattaaaaagtgtacgtttcgaattgtaaatacttttggcctttgccaatagcttactatgtgatcttggagaactcacctaacctctctgggtgtcactcttctgatttttttaatgagaggttttgactagataatccataaggaccttttcaatgagatggttgcatgactcagtactctttatctgaaagtcccaggatgtatttttaaatactttttgcagtgataactgcccattaccttgtgatattttccctgagtctctgaaagagtgaggttttttttttgttttggtttgttgttgttgttgttgttttcaaagttagcatttttggtgtgttttcacaaatgtatttgatttaaaagtggtgatataattttataatggaattttattagcagggcacatttttgaagttgactattttaaaatctgattataaaattagtaagtgctcattaaacagaataaagaagaaaatagttcacatttagtaccagtgtcaggaaatagccatagttaaaattctggtgtttaactttccaaacattttttctgttaaataaaatcaagattcttctacaatacggttatgtaatccctctccatatgccctcccctcttccttgggggagtagagaggggttacataacagtattgtagaaaacaatgtattttggaaatttttaaatatcagtatgtattgctcttaccaccagtttatttggctgcatagctattaaaaatagtaataaataattgatttatctgaacccctgttgaaagctatttaggctgcttctagtttattagtattttaagcaaacagtatatttttaccaaatttgtttcaaatttatcatagcctcttaaaaagacaaaaaatgtagtttgttttttgtttaatcttttctcaaatgtaaaaaattgaatgttctagtattgataaaaggaaaattattgctatattatttgaaagtattaaatgttttaggacttattaccagttctggatgagtatagaaaaaggcatgtaattagaggcagtctacttaggaaagctttgacctgggagcagatccttgaagagcaagtcaagtggatggatggtgaacatgagcctggtgtgctcagtgacagtaaggaaaccagcgtaacaaggccagtgggggcttcttactcagcagtgtgaaacggggaggtgctgtggcctgattacagaggcctcgagagccattgtataacattagtgggcaaacatcaatggcgatcctatatttaattaataaccatttagaatataacgaaacatttatagtagcaacaaaaagagtttctagtaataaccttaaaaagaaatgtaaatgacctagttgaagcaaactgcaaaattttgtagacagatacagaagatttggataaatagaaacacgtattgtgtacctggaagtgaagaaaaagtgttgtcaacacagcaattattactttaatgctcactttggcagcatatataccaaaacattttacaccaaaaaataatatatgcatatatgaattttttagtgaaacccattagtccagggtgtgtgtgtgtgtgtgtgtgtgtaaattttatccatgccaaaggatgtgttgtaaatcagtaagaaaaggaagatttattcagtgattggcggtaattggttagcactttgggaaaaaaataaatttttagttccttgtttcatacatacattaaaataaatttctagatggactaaagatttaactgtaaaaacaaaactgaagaaaatgaagatgaatgttgacatactttgtagaagtgggaagtctttctgagttttaaaagtttgaccgggtatggtggctcatgcctgtaatcccagtactttgggaggctgaggtgggtggatcgcttgagcttaggaattcaagaccagcctgggcaacatggcaaaatctcatcgctataaaaaaatacaaaaattagcctgccgctttggcacacacctgtaatctcagctacccgggaggctgaggtgggaggattgcttgaacccgggaagcagaggttgcagtgatccaagattgtgctattgcactccagctaggaaaaacaaaacaaaacaaagtttgcagcagcagtgtttcttttcttttctttttttcacaaagccttagaaatgttcacagaacagcagcagccttaataatacaataataatgattttgatgatgatggtgatggcagctgtcacaagtaccttacatagagacactacagcattattcccaagtatagagaaattgttaggtaaatgtgacatactgaagagtatgtcatgacatgagaattatatattattatatataattaatatatgcttatattattatgttagcttaaaaaaataactacccaaaccaattacaattaaaactatgtatgcaaacccaaaaaactctaggcatggaaatgactggaagggaactcaccaaaatgttaaccatggctttttctgagtgatgggacttgggtgatttatttttctgcttctatcatccagaatttctttaatgagcacatttacttttgaaatgaaaagcaaaacagaacaagtaaaactcctggcagatgagtttttatttgctgtggtaggaaatggagaattaatagcttttgattagaaaaatgttatgagcaagcaatatctaattctatattaaatgtgcagtggaggggtgggggctatttaaaggaagtctgtggtaaaatcttttgtaaagggagtaattttcctgtaactcagctggatttccaatccagactttcttaatctatatgagaaaatcatccacaaatgttgcattgatgtcttagtttctggttgttattctaaagcataataaatgataataatggctaccacttgttgagcacctactgtacctggccctgtggtaaaagctttataatttatttgactatcctttcaagttaggctcctttattcatgaagaaaccgaggttcagaagggtaagctatctcccaagatgacgtccctggtgctgtgagatgagtagtcctggcacgtgtgtgctgtgcttctccggttgcctgctgcctccccagctcttgggcatgcacaggtgtcctgtggcaagtgtgtcccaggctgggaactgtgctccacttggcattccacagaccacgcctctggggatttgctctttagtatgttatcacatcatctgctgtctttaggagcatattttggtgcatacattatatatttgaaagtgcttgactaacttttggggaaatatggctgcttccaaaccaacctttttcttttaatcaacaattaccttgtgaccgtgcatttcttttctttcttttttttgagacggagtctcgcccaggctggagtgcagtggcgcgatcttgattcactgcaagctccgcctccctggttcactccattctcgtgcctcagcctcctgagcagctgggactacaggcaccagccaccattcccggctaatttgtgtatttttagtagagacagggtttcaccgtgttagccaggatagtctcgatctcctgacctcgtgatccgcccgtctcagcctccgaaagtgctgggattacaggtgtgagccaccatacctggccaaccatgcgtttcttaaagataagtgttgtggtttgcttttggggaaaagagaaaaggatttgtggttttagttagtaaaatcattgagagggaaggagacccaatttatggattatagacatttgaaaaaaaattgtaattcccttttctgttgttgggataccagtttttgattttatttgttcattaaatggtcagttccgtggagatctctggagctgagatggctttttagaattgcccaattgaggcaaagggccagggctttttaaccactgcattggccagccattgtctgtgggcttctcccagggaagggccctagtgttgggtgaggcaccttcctgctgcttgagacacactcggctgtgagccagcagcaggcagttctcctagtacctgggggcctcaatccgaaagatgcartttagccacacaacctgtattagttcattttttgcattgccataaaggaatacctggagctgggtaatttataacgaaaagaggttaattttggcttatgattctgcagactgtacgagaagcatggcatcggcatctgcttttgtgaagcctcaggaagctcacaatcatggcaggaggtgaagggggagcaagagtgtcacatggtgagagagaacaagaagagagaagggggaggtcccagactcttttaaacaagcagatcttgtgtgaactgagcaagaattcacttatcaccaaggggacagcgctaagccattcatgagggatcaaccctcatgatccaacacctcccagcaggccccccctccaatattggggatcacatcaagaggctgatctttatgggctgcatagtggggtttccttgccccctggcttctgataggggtcaactaatgggaggctccagcaggagatgggaaggctggaaaagaggagttggcttgggaactgggtagaagctttgcatccacagcccatgactcaggttaggtgtctgcccaccagctctagaatttttccgctgtgtaagtctagcatcctgggggttaggatgatttagccagtaggctagtaccagccagcaatggacaaggcagcattgcagcctcactcagggtgaccctgaaagacagtggctaagggatgtcttccccatgcccagaacttgggccaaatcatcactgccttttaatttaaggtagtttttaatatatatatatatgtgtgtgtgtgtgtgtatatatatataaagacatatatatataaaattatatatatataaaaacatatatatatataaaattatatatatataatttttttctctatctttcttccttaggctcagcattacagtgggaaaagtcaagtattttaggctcacacagatttttctctcagtgacgtggcagttcatactttccctccaaatatgacctggtaaatgactctgtggcatgttgactgcaaatctgaactgaaatggaatctgtaacccattatcagatcctgaatcaagctgccttgtccttctccagtttttgtttcagtggaaatgtgtgtttttattctgtcaatggacagtttacatacctaatattaaaagggaattatataatgaacacttgatgtaaaagagactagttaaatacttcaactccaaaagtttccattaaagtaataaggaaattacatttaattttaactggtagaaagttttaaaaaatgttattgctattaagcatttattacccacactcaaccctttttttgtgagtgaattcccaaagcacaattcatctttatacaggtagaaaggaaatattcttgcaaaatatgtagtttgatgtcatcttaactgtggagagaagcatatttttccaaagaatagaatgtgatggttgattggaaacttttggagttacaggctagctctacctcttgaaataagaaaatatatataaataggtccccagatgaaggcgtcgtggggtactttacagccccaattggctccagacacagaggcagtgatttgtaagcaagcaatgacaagaggaagttaaatcaaaattaaattaagagaaggaagaaaaagaagagctatcaaggagaggtgatgaatttcctgaaagcttctaaatacctatctgtgggtaaatgattgaaaatctgtgaatatatctcacttatgtcaaaagatgaaatctggaaacatttcagtcctaaaaaaataccttacttgttatctttgaagcctttttttattttttcaattttttttttggagatagagtctcactatgttgcccaggctgacctcaaactcttgggctcaagcgtcctcctgcctcagccttctgagtagctgggattatgcatgtacaccaccatgcctggcttcagaagtcttttcaaatattcattacttggtacagttcaaccagtacaagcatatttgcttctatactttcccgttgactcaactgcgataaaatcagcatcttccatggtgcacatgaagtcgtatattgggaggattggttttcctgtttacattttgacgttttgttgttgttccagcttgtgtaaataaaaatttaggaattcgaactcaccagagagctcctccaccctgactgccatttttgcagttacatctgtcattctcccttttcctgtcctctatccagttaattaccaagcccaagaagatagacactgtgttccactcccctcacagcacagagcacagttcagtacatagtatttggaaatcaattaagtgaataagcacctgcactttctctccgtctcatccattctgctgctaccataggagttcagactcctaccatcttgtgcctgagctgacacagtaacggtgagccctcagtccctctccaagctaagccactgcacggaagatgttgctttcatcattactttggctcagaagcgctcagtaccgctcattctccacgcaaagattctcagatatttggtctttataaagctagcctacccacctccagtgttaaaccccacacttcccccatcatcccaccagttttcaccatgctgctctgttagcagtcccctcagcttcttgcctccttccttggctcctgctatttctcttgcctggactgcttgctctccttcactttctcaaattccattgatcttgaaaggcacattctagcctatactagtctcctcttgaattgaaagcatttgctgcctgtattcttactatggaaatatgtatggcttgtgacatcccttgccttattattttgtgtttttatctagtaataacattgtcacttaacctttcagctgcgattgtgttatctctcaaatgatattgtttatttgtgggcttatattgggcacaggggatggaaaaggagagagcaggactctattttcatgcttctttgtatttagcacagtggctcttgtacccagtaatacagcctttagacagaacagacaccatatcttcttggtctttgtattcctagtgccttgcagagcatctggcccatagtagggattcatacatggcatttgaataaatgaacagaaggcacacctcaaatatttgtttagtagttttacccccaaactaaatgaatcaacacaggtaattttccatcttttaaaagccataaaaatccagttttccatttagtttttttcatcattaacagttctccctcaagcacttctcctttgcctgcyttgagcttcatactgaaatttaaatcaatttcctctcattcttttccctgtgaaattggagaacagctgtttagtcacctccttataaataacccttcaacaagttaaattgcctctaggatttgctttctccagattaaattatcccaaagtcttttcttttttctcataaaggccttttcaaaaagaaacattggttacttttaaaatttctttttctagctctttataaaactttattcttttcataaatgtaccacaggatacccctatgtgggcctgactgatgctgtctggaatggaaagctttccttccacatctggaatctcattcttctattttgtgttgtaccttgttagcttcttttcttttcttttcttttcttcgtatcctatcaaatttaatttgcggtccactctcaccctctccctgtttgtctcctttttctgtacatttcttcaaatgtgtggcttgattttcttcccataaacactaacttgctttatcagaagtcttactaaggttataagttacagagaatccaacacaaattagcttaagtgatcaaaggaatttattgatttatatcactgaaaagtctagtggtatgacttaacctctggcatggctggactcggtgaaccaaacagtgtcaccacaggcctggtttttcttactccctctgttctgccttgcacacacagtgttggcgcctttaaggcgcctctaacgcccttgctttgtggcagccactgagctgcagcacttgcaggcctcactttctcataatgccccctctggaggaagagagaggctcyttgcttgactgggtttcactttctcttactggctcaaattgagtgatattcttatcctcaatccactcctgttgccactaaaaggatatactgcctagcttggtccatttaggacccagctctgcatctgatgcagtatgttacttccacccaatacatttggctgagaatcagggacgaattgtttccaaaggaaatttggggagctgttcccagaaggaggggagcaatgcatgggggtggccaacaagagatgtacattgcattcaaaattgtgcccattcactctgctttaggcattataaataccactttgaactgaaggtatctctgagaatgaattatttattcacttactcatagtcacttactgttaagcaccaactatatgccaggcatacaactaggttaggtattaggtgtacaaacgtgagtgagacaatgtctgactttgagaaacacataatctagggaaaaaaatagacttagaggcacataactaaagcatgttctaataagtgctgctatcaaagtgtctgtggacacaggtggaagtgaagaactcagtgggaggggttaaagggagagggcataacaggagaggtgagttttgagttaagccttgaagggtaaaaagagattcccctagaatgggagaggaatggcattatctcgaaggccatggtgcactagaaaaagttttcagtaggggactaatgtggttaggtatgtatttgagaaagatcattctgctggcagttggtggattcggcagaggtgagaaggactggcagcaaggaggaggaccagttgagctgttgcagtaatcaagtctagtcaagatacagcaaggacctgaactcagctcgttactatagagctagggagtagactcgatatatttgagaagagctgggacttgttcaatgtaggagatgtgaatcagtggttatagatgactttgaggttttcattgtgataggtaggtagttaagatgagttcaggtttgtagttacttgaggtgcctgctgaacacccaagggacacgtttcccaggcagttgtaaatatagaaatgtactggaggaaagatttctaagccaggaatttagactggaaaagacatcagaatgtaaatggagattgaagccttgaggaaagagtgggatcaccyaaggggaatttcaagtcagaagaaaagagggcctcagagtagtccctgggaaaagastacatttgagaagccagcagagaataagaagtctgaggaggcagctatggagaacgtaggcctgtggatccctccaagtaataagcttgtttttacttggattagaggtaatgtcacctggaatgatttgtgccatgatggttaagagcatggactctgggctctaccacctcctgcaactgatctgtggrtaaaatatttaacctcatttcctcatctatgtaatgggaataaagtagtacctaattttggagaattaatttgagtaaagcaccttgaaagtgcttagcacataagaagtgctatagaatgtttgataaacacatacgccagtaaacacatgtgtttgtacatttctgtctctctgcactcacatagctgctggccagttaatctgaaatccaaaattagtttatttgtacttaaataatttgattttctggaaactctgctagttccaatgcaacaatgcaagtatcttgacttcttgaaggttttccagattatttgctggattatttttttctactgatgattaattttacctctgactttgttatacttttctttgtttcttccacacttcacatattttttattgttcctaatactttatagcatacagcttttatttatttttaaaatttactttctcagaattattcctaaagttctggagtgctctgtgagttgctcctccacatttcggtcagtttctagtgtgttacttttaatcaggctagttttctcatgcatctaaaggaattggcaatattctcaactcctccccattatggtcrgggatatgaacttactgtcttcttctttcattttcccaagtaaatgtcttgaaccactgattagatctgtgtgcccacaataacataagcaggcacgaagcttaaatctgatttaaaggagagggctgtatagtctattactccattacgtttttttaagtgtctagattaaaatagatcagtattcagggtgtgagtatattgctaagtctcttaacactcattgaaccagacgtcgtgtgtgttcattttyaaatgatggggtggattacttttatatttattatgaacacaaacactgatgctaacaactgacatgtgaaaggaaagcaggcaatagtgatgaaaaccatttaatgattagtgaggaaacaaatattgtttaatgaaaataaaaaccatgtctaaagggcctaatgctgacttttggaaatataaccatgttgcggtcttttgtgtaccctctgtcctgtacagtagatattgtttaaaattgcttgggaactggagcttgcaattgtgagcctggaatgtcctgcagataattaagttgtggtcaggctttggaaaaataaaaagttctcgaactatgattttataaacatgctacaataacatttctttatatttaacagtttcttatagaaagttgatactctcatgaggcattgattaaaggtaaaacatcaagaaagaaaaaatattaaattaaaacttcacttaggatgttgacagttggcttgtaatattaaacagatgtgtatgttcctggggatattcttctttctgaactgaattgctaagttgtattttttttttaatgacaactacaaatatttgatcagttaataattttaaataccctttctacaatcatctgtattctaacttcatctgtagtttgagccctctcaatgatataatgattggtgaaacctttgctgcctcttcttaagtctttcattttctttctttcttctttatcctcccccgctctaaaagcttaactgggctcttctgatttcatgatgcatacttggagattgattccttgaaataattttaggatcattgggtggaattctacccttgcagatttatgtctgtagtttacttccctataagcttcactttggcatttgagtgcataagctgacctacattgtggtattgtgtttgtgtggtcaattgtaaaggcttcataatacgtctgtatagccagccatgcagatcggcctgtaccccatgctgtggggccaaagaaatgtcagtgaggggacctaaaggaaaccaggccttggagtcaaaagagattcagtaactttttctttttgcctatgaggattttgccagacttttgcattttattggacaaataacagagtctagtgagagctgtagagtgggttggaggggtgggttagatgggtgagtagtctttggtaaatgaagtcaggtgggattttgtaggatgtggtgaaaatgtttwtcatcttcaaagattgttcaagtctttttggaagactagataaattgtacaatgttgtttttgggatgatgaatttttttagatactaaagatcattttgattgtaagtcttmaacatgtggacatcttatgttttctgaaagatatatttcactaggcaggagtctttgattaacctggaggaagttttgttgctttgagtacatttatttatcttggaactatgtattgtttgcacagtcttctttttggaatcagtgtttttttttctctgcagattccatttgggaagctttggtttggggccttaagtatatggaaggcattttcagtaaacacaaacaaaggccagctagactgtctgaacaagtacaacgatgtattttataatacaaaactttaacttcaagaataatgaattcatttttaatagcacattatttaaaagtggctatttgttcttyacatctaatagtatagctttttaggtatcttattcctttaagtctgatatagaagcaaaaatatttaaagtgcatttttatgtgaaaggatttgatgagttcacatttcatgtcttcaacttttgttctctagctcactgttttrgaattgcacttattatattttgtgtgtgtggaaggaaggagaccaaatttctgtgtacagtgtcttaacagatttaatcgaatcactgccatattctcctggaatttgagatactccttaacagcaccctattgggaaagagttgggatctttgagctatatgcaaaaatactatttaatttcagcataattcgttatgagcarccattttaatgtaagagtctgaaaagcaataaaatgtatctgttaaggtttgtactagttagcttgtttctgggcttcatgtttatttcacttcaattctcttccaatgttttactgtgaaggaatgttgcaaatattttaaatcatttgttgtaactggaatttgtaattatgaacaggtttaagtagaaaatgctgttttgttttactgttattactgcatcataagataaatgatattcttttatagatattttggcttggctcaccaatcctaatttcagtatcatgcctgacttagcaataaactgctgcgatcagctacagggaattgtattaggcaggctttatttttctgtatcagtgtggtattgcagtttcatccacctttaagttagaaaagcatggttttagtatttcaattttcttgttcaataattctaccatggggaaacagaaagtagaaagttttccagagtagatgatgatttaacaactacaccatttgaactagtcgtccttttaaaatctcatttgagcattcccttttttgcctatatagtgttcagttcttctcagctrttttacagctaatgatttggttctattagggagaaggtaatacatgcttattttcgcagcatgttaattctattaactgttcagtaactgactcgggaatggaaggcacctattggtccctagtggtctgaaatgggaaatgcattccctgaaaatttcattaggactttccataaagcttaacatttgactagaaacaraaatgttagtagctttagatagattgattaggttatttaaagtgttccttgagctacagatgaagttaataattttcttaatctcttattaaaaatagatgaactacatataaaaacttcagtcctagattagcacctgtatttcaagtcatttagggaatggtggaaaactctgtaaatgcttgtgtgttaagcatattgagtaaactgtcaagatttttctctttgtcatctttttgtcagctttatcatgcttaattttcaagaaaataatgtgtytgttactgtggtcacaccgtgattttgcattggcttatgtatgatattttwttgtctctgtcctagaaaattatagcagtttttatgaggagtggtttgtgggttcacacaacccacttggagtgccatttactacaattctcttctaaaagaaccataaaacatcatgtaaattgtttaaaaagggaaagacctttttcgagaaaggctaagaagaaatctttccaggctttcttttgtttcttatagtcagttttatgattttaagctcccaatttatttagagcgttaatgtcataaaataaagtgcacgtgtgtataagtaaaccgttgtgagctagagctaggctagaactgggtgttgttgatgcagataatatcaaattcattatttyataatcttttaagatatgttttctgtgactttggaaatgaaattaaagaaattaaggaagaaaggaaaagagagaggaaggaattaatttatagcttgtatatcttttttttaaaaacccttatgttttcttaagtagtgatgtgtttataatctacattaaggcacaatttttggtaaccagtcctgtgaaactcacatttaaattcacaaatagatttacttagagaaactttcctcccttaggagttttaccatttagattggcttgttgcactcagtttgtatacaccctttcgaagaaagaattaaacagcacaataacaaggccaaagttctgtcatagttttctatacaaatgccttattctgatattatcttggctttgtgcatgagctctcaggagagtaaggacgaacattgttaataattttctacaacatttacatggttctctgtgcttttagtcacttaatacaggtatatcttacgtttaacaaaccgttataagaaaatccacatatatctgaaatataaattggggcagttgttcattttgcataaagatttaacacatttataatagatttaagttttaaagccacttccttagcacatgcgagatcattatatttgcaacattttataagaacacatataggccgggtgtggtggctcaagcctgtaatcccagtactttgggaggccaaggcaggcggatcacaaggtcaggagtttgagaccagcctggccaacatggtgaaacctcgtctctactaaaaatacaaaaattagccaggcgtggtggcaggcgcctgtaatcccagctcctcaggaggctgaggcaggagaatcgcttgaacccaggaggtggaggttgcagtgagccaagaccacacctacactccagcctgggcaacagagcgagactccatctcaaaaaaaaaaaataaagaaaaaaaaaacacttataaagggaatgatgattgctatattcatgtaggtagtgatatgaacatttgtctctgtaaaatattatcttcttttgaaattagtggtttttaaaaacacaagattatctgtgtggtttagaaactccttggttttatgacaggaagaggttataaataaatcacgtttatgcattttgtaaagagtgttagtaaaattgctagattttcttgaacatggttgtaaatctttttgttttaattataaagctttctacatacatgtgtgactttatgaagaatgtcaacttaggttttaattatgtgactgtaaattccccttttccttctgtgtgaaaacacaacaccaacaagaaaccaacttcctaaaatatacaaactttttgggattattctttattctacactgtcttactatttttatttttctgatgttggggtgtttctatttagtatcacagtagctaactgaagtaaattttgggaatagaaaatgaagctataattggaaaggagattttgaaaaaacagaagcacctaatgtcatgatgtgggtgggaatcaggggaagaatgtactgacgagccccaataccgctggttcagaacagccctgggaattctatagctgttttccaaaggattgtttgatacagtcgggagctcccgtgaccaaatctaaagcctgagaaccaactttctgtgataaagcatactaagcaaagaagactctgtggcattgtaaccgatgctactgagtatgccacaaatgttcatacaaattttgtgtatagcgctattgcataaatcgttttaatatgggatgtttggaaataagataggtactacactgaagggaccaaatactgaattctccaagttagatactgtttttcactatgaatttataatatgttgttatataacaacatcattgttactgcaagtgatacaaaatgttatgtttggagtttttctctttttttttagattggaaaatagttttaatgttagcacagacaaaatatttcctatttatttatagttattaaataaaaatgcatagcacgttagtcaagaatgtattgttttataaattattcagttgcaagtatctaagattactttacttacaacttaaatgcagaatgttgatgtttccttgtttctgtttttcacttgagtcagttagaaaatatttttcatggactttgtatataagctaaagatttttttcttatatgaaaatcatcaatatggccaattcctgtcggaaaagaggcataatttttcaattttttcctccaaaactgcaacttcagaaaatatgtacgagatgtagcaattaacctacatgcacatttataatactagaaaataggcagctagttatattcaaagactggatctgataggcccaaattgcttaaaacatcacagttattgaagatataccccagggaatttgagaaaccatttaacagatgaaagtacattttgaaaagtctgaccttacaggcaatcataaaatgaatcaaaacagtgcttttttccccctgaaatgtacagagcccatctgtgtctaatccagtaattatagactgtgttcaattaccttttcaaacttggagcagactggagactaggcaatgaacaaacatagggttttgtctagacctcaattgaccacagtctaaaagttgaatttatatctaattttattttttgtttggtttgatagttcttaaaggattcatttttgctacttggtgttttaccttcttagatttgaggtactgccttttctcatcacaaaagcttttgtatcagctatagcttatgctgtaatcagatgctgttttcggaatacttactcttgcctgcaaatcaataatttgcactgcagaaaagactgcatggggttggggaggggattttaccagtgagtagtatttttttaagtagcctttaaaatgttgctgctgactataactcttttttatgtgctaggaaaaaataatttattttcctcttaaatttagaaaactataggtaatttccagttgggttgtacacttaatgtctccaaaaatacatgtagactgctaaagcacgtgtgtctctcttttgtcagatgtcttatcgtttttttctaggtacacatttttattgcatttactaatcagactggtatccagtataaaatacagtgtatagtattcaaagtccatttcaaatcgtgtctcttaataaagtcagtttatgatctgatgaatctttaagtgagaattaattaccatgaaccaccacagccagttcaaagtatttaaattttatccaggaaccttggctattcaagtttttcttaaaacacaaagcaaacaaaagatgaccacaatttttagaactgcttatgtggtagtcaaagttctttttttccattatttagtatttacagttattcacattacaattatcactggaaacaaatgttttgaggtatttattagaagtaatcattgcatattagaccatgaatttttctagaaattttacaaccattcctagtatattatattattattttttaaagttttattcatttaggtctcactatcctttggaacttttaaggactttgtcattggggagagaagcagttttatttggttgcatgaatgtactttctgagaattatatggagaaagtgaaacttaaagaggattacaagtaccttatgttgaatgttttcatgagacatttacttgtgaaacttggataatatgatttccttccctccttcctgtccccatagtttatggaactattgttataattagcctccattgtatgcttcttaggatcttcatagagaaggcaaaagattagtcttcctaactaggaacttgagagaccctttggatcctctctcatatacccccttatctgatccaaagaaagaattctctagtctttttttttttcccacagaccagaggcccctcctagttcctgctttcattacctaatgtatgggtacctcctttggtggtttggattttatattctctgattaacctgtttatgccactttcactggattgtaagctccttcggatcaaagactagatggatgttatcctatcctrttgtattactgcttaaaacacagtgcctggcttgtgacaggcacttgctccttgttgaccaaatgaggacagagtggatcatccattcggaatcttagtattgaaaggtaggagtgaagaatttttaaaagttagtagaaatcacatctaaataacatataactctcttttttgccataacgaaataactgaaagatagaactttttaaaatttctcactttaaatgtttttaatgagaccagtgagagaatgaattttattcatgaagtctccattttccattgaagctgcactatctgttgctgtgcttaacaagttgatagctttacttatggcaatttttatggaactgctttctccatctgcagtgagaagactgagaagcatttttctgattcatatatctacgtgtatccttttcttcatgattcttggagaagccttgcagaaatagtcagtaaacagtattgaatacttactactttcaaggtgccgcttgatacagtgaagccatgatatacaagtcctggccatgtggattttgaagtatgtggttgatgtcatgtctcctttaggctggattctctcctgcaatggaagctgccctctcgagttctttctccagtattgactcttaacgtaattacatgtccttacccccgctaaggacgtcagtgtctttatcacacccctgccctcaggttaaaaggggaagaaatcacatcatttataaaagcagtgatggaacatcagtctttttaagaaaaaaatagaagtttatgattgtctcatcacagtcaactggcaattcattactgcagtagcaaggagatatcccagacctctggctttgctgtcaagattgagtgctggggtagtttttactcagcattaaagatttcattggccatgctgttttgtcgggtatctgtttaagatgtagcagtgtgatttttactaacctgattttagagattttcagtgtgtcacatttaaataatctacttttgaaaacagtagtgtctatttgagtatgttgctcaccggggaatgtggcctctaaaagcaaccataagatccaagaacagagcagtgagggccatgaccattagatgacttccacgaagcagtctgtgactctgttggttgaaatcccccacactttcctttccttcttcaaacctgtttctctatcctttggttatgattggctcctggctggataaagtggtgctgcttctgggataaagctgtaatcaggcgcttgagtctacttctactggaagatcccagatgaatgggaaaccccatgagctctggcttgcctaaggcaaagctgagatttgagatccaggccagacgagggtccccccctctatcagaatctccactctcaaagtacaggtacttctttacttaacatagaaccgaatttctgaggtttcctaaagagacaaccagggaaggatttcctgtgtctgtctcctctcattctctgggaagtcttaaaatttttcagcttagactgcttccttctttaaattcyaaattgaatacccttatgtccgtttgatatgtatattattattatattcctggattttattcttgaacccagttggagtttcaaggcaaacatttggttttctgtcagcccacaaactgagcaatggttggtcaattatggtcttctgttgactgaggcagagtcgcatgttaaaagtatattttattaatagcccacaaagcataccaactgccagctttttgccatgtctaactttgagcaatatttagtaacaatattcccagttttcatctgtgggttacttaaatgtgtcatccaggaagtcactgtaagatacgttggtgaaaaagccttcaagcttagatattgtgtattctgcttacctgcttaccaactcatgcttyccagagtacctaactcacaaacgtgcctcaaatgcagaaaagcaaatctagttcagtattatacaggactggtaatgtcctggctgtttgctctatggtgtgcttgttaatcagcagtagatgattgtggcacatacctattcttggtcctgaaaccacccttctgtcaacaatagtgcctgccttcttcctgggaactcatccccactctggcttcaatcaagtggtttcagtacaagctgctgtgtttccatagtatcttctactctctaggtcatggaccaggggtagcaaccagactcaaatcaggccaatcagaatcctttcctaagatttttttttttaattggaattaggaaaaagaattattcttagtccagaggcctggatttcagcaaacaaagctcgggagctgttggtggccagttttcattgctgagctgcaatgagaaaattaaggctaaaatgcagacaaaacaagtaggagttaagagagttctagaggagttttaaatatctggtttagttgttgcagaggctagctgtatccttgccgttcccatcttttgatcatttaaaccagtggctcgtgcaattttgcttctaggggatatttgccaatatctggagacatttttggttattacagctagggggctactactggcatctagcagaaagaggccaggaatgctgctaaacattctacaatgtacagctctcccacaaacacccccacctccgcccccagacaaagtattatccagcccaaaatgtcaatagggcttaggttgataaaacctgaactttaacccatccttcatacattaccttagtatttttcaaatctcctctccttctgttttggaaagctagctagaattagtttatgcttaagaggaccttaacctaggggcatacacacacacacacacacacacacacacacacacacacacacacacacacactaatcatgagtgttgtttggtgattgtatgtattttcagtcccatatttaagatttttcagtttatagctgccctagtatacaaatacgccatcacccaggtttagaaggactattgattcccctaccacatagattcaaatagctacttctagactgccttgggtacctaaacaatacatattccaaactattgaagcaaaggctattcagaaattgctactaggattgcatcaaaattatgctgtcctccctaagatttgttttacgattaatattcaactcatgtattagagatgaaatcactatttttaggaatgattatgataaaaatcaagtgttcagtttcatagaacaaaacatagctgtcatatgaagtccttgataaagcattgctggcacaaggaactgtgagagtccacattagcgtaggctggacaagctgcattcctctttgaaactgtcagaatgcattgtacctttgattcatcttccaacctacattcaagccatggcatggatttctttttttaaatgttttaaattttactttaagttctaggatacatgtgcagaatgtgcaggtttgttacataggtatacatgtgccatggtggtttgctgtacctgtcaacccgtcatataggttttaagccctgcatgcattaggcgtttgtcctaatgctctccctcccccttgtcttccaccccacaacaggctccagtgtgtgttgttcccctccctgtgtccatgtgttctccttgttcaattcccacttatgagtgagaacaagtggtgtttggttttctgttcctgtgttagtttgctgagaatgatggcttccagcttcatccatgtccctgcaaaggacgtgatctcattcttttttatggttgcatagtattccacggtgtatatgtgccacatttgctttatccagtctatcattgatgggcctttgggttcgttccatgtctttgccattgtaaatagtgctgcaaaaaacatacatgtgcatgtgtctttatagtagaatgatttataatcctttgggtatacacctagtaatgggattgctgggtcaaatggtatttctggttctagatccttgaggaatctccacactgtattccacaatggttgaactaatttacactcccaccaacagtgtaaaaacgttcctatttctccacagcctctccagcatctctgtttcctgactttttaataattgcatgtcatggatttcttgatggacagattgatgaaaagaatgttaatgaataacttgacaaggaggatctgagacatgtagcaggtacctgcagttaatcacctagattaagacccagatttaagattacttatattttacacacaatctttttttcttaactttctttgactaatttttttaaaaaactatgactggggatgatctgtgtttctcttcctctgccttcctccattgctttggttaaactaaaattaaactagcagagtattttgtgaagctgagtttctctttgtgtctctctcctttgcacacagttgacacatagtaggcacccattataaaatgctcataaaacgatgcgtggtgatttcctgcagccccctagttctaaatattctctgtagtccagaaactcccagatttatatttccaggtcagacctctttgaaaccctacacttagaaacatctatagttgtctacctacctgacattatttctgttacctgagtatctaatagacagtcagtctccttgctgttcttcacgcatgcttgatacacacctgtcttagggcctttgtacttattgtttcctctccttggaatgattttccctaagtatttgcctggagatacctgcctgcataacttttacttctccttcaaacattttcttatatgtcatcttttcagtaagttcatcctgaccaccctgttgaaaattagaattcacctttttccctacactcttcctagatttcccttactttgcattacttttgctttttgtcccgtaacactttcaccacttaccatactttgttaacacacttattattgattttaatatattgattatacttattattatttgtctaaaatatggctggattgtaaccaaaacccatgatcatttaaattagggtctttcgactccaagttaaatttttgttacaagacagcctttttgtcacaagaatgggtgaaaattttcgtaatctatccacctggcaagggtctaatatccagagtccacaaggaacttaaacaaatttacaagaaaaaaaaaaccctttaaaaagtgggcaaaggacatgaacagacacttctcaaaagaagatatacatgcagccagcaaacatatgaaaaaaagctcagcatcactgatcattagagaaatgcaaatcaaaaccacaatgagataccatctcatgccagttagaatggcgattactaaaaagccaaaaaacaacagatgttggtgaggttgcagacaaaaaggaatgcttttacagtgttggtgggagtgtaaattagttcaaccattgtggaagacagtggcaattcttcaaataactagaggcagaaataccatttgacctagcaatcccattagtgggtatctatccaaagaaatataaatcattctgttgtaaagatacatgcatgcatacattcactgcagcactattcacaatagcaaagacatggaatcaacctaaatgcccatcaatgatagactggctagagaaaatgcagtacatatacaccatgaaatactatgcagccataaaaaggaacacgatcatgtcctttgcagggacatggatggagttggaagccattatcctcagcaaactgacacaagaacagaaaaccttataacactgcctgttctcacttataagtgggagctgaatgatgagaacacatggacacatggtgggggagcaacactcactggggactgtcgaagtggggactagggagagggagagcatcaggaagagtagttaatggatgctgggcttaacacctaggtgatgggatgatctgtgcagcaaaccaccacggcacatgtttacctatgtaacaaacctgcacatcctgcgcatgtaccccagaacttaaaataaaagttgaagaaaaaaaattgtttgttgttacacagcagctccttcttgttaacttcaaaataatcctgacattttagaatctggcactcctggtctccaagtaacaaacttctcatgtatattttatatataatctttgtgcaacacacaaaaaaaaacaagattttcaccagatttttgggatcctctcaagtgaaatataggatatatgccataaatgggaggcaagaagggacagttcaaagagataggttgttgtattctagagaagcaaaaacgggggatatgtggtgaggtccacatatgacatacttaagacaccatgaacagacaaaaaacaaaaacaaagtaacagtggtttcagatatgagccctaagttgaagtcctaaaagcaggtgcttttcacacgggcacttcagtgtcctgtgcactagggggagtgtcagccatgatccattttatttaatagtgattaataattctcctgagcagtgatggaaggccagctagtgttgaagttaaaaacatcctataattggactcagaataccttttacttttgtgttaggatagccaaggtcatttgttctgaggtcgcctctgtggcatggtgaccgatcagtggtaagcaggcagtaaatacggaatgcttcctttctaggctagaacataagggactaggaaactcgtatatttttctagctagctgccgctttttaacttttttttttttttttttttttactgtgaatatattttatttagtcatttttgtttacaattgaaactctgggaattcaaaattaacatccttgcccgtgagcttcttagagacaccagaaaaagtttcagtctgtgttccacgttgttctgctgggctttgtccaaacgaacctttatgagccggctgccatccagttcacgtgaattctcttgcccacaatttcgcttgggaagatcaagtcctcaaggcttgcgtcgtgcacagctgtcagagtgcactcctgggacgcttttgcttattttttgtgcggctttttcgaattggcttaggcagaattctcctctgagcgataaagataatatgctttccactgaactttttctccagttcgcatactagccggacttggattttctggaaagatttcagtggaggaacgggaacaaagattgtgatagctttctgacyaccaccaacttcaatttccttggctgccataatattcagctctgtgagctgagccttgaggtccgagttcwtttccagctccagaagagcctgggagatgccggactctttatagtacactgtaaagtatgggttgtttaccctcataattgcatggctgactgagagctgctgctgagcatcaagagggagtgtcatgccgtcttgtactgtgttgctagcattctttggaactcacctggcttcttgccattgggcttcacgatcttggcgctccaactgaacatggccttctccttgctgagcactggcttaggaagagctgctttttaaaaatttaagtgttatttgtagattagcatacagtaagcttgacctttttgctaatacagttctctgaattttagcattttatgtacaatagtcccatcccccatgttatccacagtttaattttccagtttcagttactcatggtcaactgtggttcgaattttatcctctcacttcatcacaaaaagaaaggtgagtacagtacaataagatacttggagagaaagagaccacattcacataacttgtgagaattcttctattttattattattgcatttattctctaactctacctaatttgtaaattaaactttatcataggtatgtatgtatagaaaaaacatagtatctatagagttcaatgctatccttggtttcaggcatccacggggggtcttgtactctctccctgtgtgtgtatgtgtgttttgtatagccatttccctattaggatgcagaacagttccatctcccttcagaaactcccatgctgtccgtttgtggtcacacccactcccgtgaacccacaaacggttctccattgctataattttgtcttttcaataacatcatataaatgagatcatatataccctttgaaactgacttcttttagtcggcataatgcctttaaggttgattctagatgtgtgtgtatcaatagttccttctttattactaagtagtatccgttacatgaagttactacaattatctatcacctgttgaaggacatttgtgttgtatctagtttttgacaattatgaatagaactgctacaaatgtttgtatacagatttttgcatgagcatacattttcatttctctagggcaaatacctaggggattcctaagttatctggtgagtgtatgtttaatggtataagaaactgcctgtacacaaatgttcatagcggcatcattcataatactcaagtagtgaaaacaatctgagtattcatcaactgatgaatggataaataaaatgtatatccatacaatggaatattatttggcaataaaaaatgaagtactggtacctgctacaatatggataaaccttgaaaatatgctaagttaaattaaaaaacaggcacaaagggccacttattgcataagtccatttacacatggtctccgacttactaaggttcaggacatgatttttcaactttcacagtgctgcaaaagtgataagcattcagtagaaaccatacttcgatttttcgtttttgtttttgttttttgagacagagtctctgtcacccaggctggagtgcagtgcttgatgtcagatcactgcaacctccacctcccaggttcaagtgattgtcatgcctcagcctcctgagtagctgggattacagatgtgcaccaccatgcctggctgattttttttttttttttatttttagcagagatggagtttcgccgtgttggccaggctggtctcgaacacctggcctcaagtgatccgcctgcctcggcctcccagagtgctgggattgcaggcgtgagccaccacacccatccccatacttcgagttttggattttgatcttttcccaggctagcaatgtgcggtatgacactccctcttgatgctcgacatcagctctcagtcagccatgcaattatgagggtaaacaacccatactttgcagtgtactgtgttgccagcattctttggatatgattttgttcaactgtaggtaaatacatctgtaagtgtactgagcacacttaaggtaggcaaggctaagctatgatgtttggtaggttaggtgtattaaatgcatttttgacttcccatattttcaatttattatggatttattgggacataaccccacggtaagtgaaggaactgctgtatatgaaatgtccagaacaggcaaatccatagagtcagaaagtaaatcggttgcccagcactgggggtgttgggggaaatggggagtgaccactaatgggtatgggattttgggggtgatgaaaatgttctaaaacagattgtggaaatatgattgcacaactttcaaatacactaaaaaccatggaattgcacaatttaaatggatgaattgtttgctatgtgaattagggctcaataaggctactattttttttttaaacagctacttattttctaaagtggctgtacaattttgtgctcccaccaacaatgtatgagaattctagttatttcacattctcaccaacacttggtatttttagtattttttatttcagctattttaatmggtgtgtagtgatacatcattgttaattagcatttctctaatagctaatgaagccaaacatctttcatgtgccccccttgccttctttagtgaagtgtctgttcaagtcttttgcctatttttaatttagttttttgttttcttagttttgactttgmgagtactttatacattctgarcaacaagtcctttgtcatgtgtataatttgcaaatattttctcttagtctcccatttaacttcacttttccttctctgaaagtaaatacttcttgctaagtttcgagaggtatcagagctttattgtctgtgtactcctgtatcctgagtgcctaataaagtctggcacaaaacagatattcagttaagatttgatggatgaatgaatgaatgaattccctgtttttactgataagcaacagattttttctgagagataataaatacataagaagtaaatctgaatagatcattttcctgattamaacactcccttccaggtatctctttagaaaaaaaaataagtaatctctactctagattagaaagcatggcatgatccagcttgattccttgaacattttatgttctcctccacctcacagcctttacaaacgctgttcctctgtttcaggcagctctcatggtatgcttatgtttttgcttcatagaattttatttgtaaatacgtgtttagtgtttttctccctaccagatgtgtaagtcagtgacctttacacatttttattcatgtatcccctaaaagaattttgaaaaaaactgagtaaccgctcatatgtatctattaatctgacatctataattctttatcgtaagtttaaataattgcaaaggatatagttttcagtgtgctataaaacttgacattttaaagtggaagtttttatcactcttttaaatatatctcatggaatctgaataccatatttgatatccaccatcatttgttgaaaaaaacattctcaaaaaactttacagtcatcaattttacaaccttttcctccttgaactcacatttccatttcactttccccacataatatcctatcccggtttatgcttggaaatatttttaaaatttttatttcagtaatttttggggaacaggttgttttggttacgtggataagttctttagtggtgatttctgagattttggtgctcctgtgacccagaaatcttttattgatcattttatcatagttctgtgcgacagaaatagatatgcaaattgaaatttaatttttaaaaaaatttccagtgawgactgaaagtctctaagtgttgtatgttgagttctgtgttgagttacctttgtaattattactagtgtgtgtggattaaacaacaacaataaaaatacactattttatcagaagagcctctcaaggtgatgcataggtttagttttttctactgatgttgtgtgcaagtagatgaatattacttttttaaagaatctgacaaggtttaatatcaatttcattcttaactttcatttcttagtgacgttaagagctgagaaccctcatttacataaacaaggagataagaagggagcttttgttagggcactgccaccccacgcagttcttggaacttcctctgaattacatgccgaaactgtcattaactttttttagtgacctgccagacgacaactcagttagattctctattaattttgttggatggaaaaaaattgggagcccttgacttgtgagaggctctgttgtccagtcattagagtcattcacgttctcagcttccccaggatttctgagcgttgttttgtttgaggtttttatatccgggacagcgcagcatagtggggttgggtttggtgagaactctgtgttttctgaagtaggaggagattgcatcgggcatgtgggaaagtagagccgatgaagtgtgtgtcatggcagattctcatgcagatctgcataggaagacagatgaaggttagggacctagacatcagttcccttgaaattacatgtgcygcacacacaccttagcaattcagcctccacttccagggatacccatccctccgttgtgtggactgctgctgagagctacaacagggcaaagagctgtgtatttttttttcttcaacacagtttcctcaactcaaggcatccagtaagaactcaatatttttttttcactgataatgaatacagggaaaaactttttatgtaaaatttgactccaaacctgtgaaccttttcagtttcatttgaaaagatataaaaggaaaagttttatccttgagtagtcttttatgccatgaattttcaagaacagaaatattcttttacaaggacagtttttattgactcctagcttcttgctaacttagtaacactgcccatttccctaaattctttttctctgttttcccaattacattgttttaggtaatttttactgtttttcaggtaataagaaggttccactcaaattctttactaaaacaatgttagggtggttttggtacattttatactaatgtaattttcaccaaattaaaaaaaagtgctgtcatttgtttcccttttgcctatagtgctttcgaggtatctggcagatacttttaggtatattacacctaatagaggtctttgtgtgtacatcaaatgagtatgttctatgctgtttagacatattaactgcagattggcagcttcatctttccattaatgtgcaggttcttaatgcttaggagtatcctggagctttctgtttttctgagaaaatctaatacagattttcagttgccttttaaaatgctatacttctccaggaaaccttatctttaatatagcatctggttttctgtgaagttacaagtttgaatcagaatttccagctgtggcatctggttttatggagcctgaattgagaatcaaaaactgggttatgtatttaaataccagaagtaaatgttatctttctttttataaaacagtatggcattcgtatttaagtatttccaatttgccgagttattgttcatgatctgcttccagagaagcaagattaaataacagctgaacagctttaagtgaataggttacattttgttattctgttagtgtcctgtgatcccaaacactcggtgtctccacagcaaaagataagaatcataaaatgttagaacgcaaaacagtctgagaggtcatgtagtgtgactcccctcattttccagatgaggaaactgaggtcttattttccctcatatagattttccctcacaaaataatcactaacgagtgaaagaattgggtttaattgcattagaataatcatgttgtttactgtttttaaaatgcagtcattctgaccgacagtgagagagaggtggcagcaatggtcctggagtgtggcctgcctgcctaggaggctgggaggggtgctgtgaggcaaacagaatgaggaaccatgtcrcaaaaatgtggctatattttagaaatgctcctaacttttaactttgtaactcctttttaaagctgttatgttaaggaatgacaaaatcagacacaggttcagtgaacaaaaatactctggtatagtttagcaaaaagatgttcattacagcataatttgtccttgtgaaaaattagaagaaacaaactaggtgtccaacaacagagaaattgttacattatggtaaattttttattttactttattttttttgatatggagtcttgctgttgttggccccagctggagtgcaatggcgccatctcggctcactgctacctccttctcctaggttctagcaattctcctgcttcagcctcccgagtagctgagggtataggcgcccgccaccacgcccrgctaatttttgtattttttagtagagacagggtttcaccatgttggtcagcctggtcttgaactcctgacctcaggtgatccacccaccttggcctcccaaagtgctgggattacaggtgtgagccaccgtgcctggccaaattatggtaaatttaagcaatgaaatgttatgtagccattgaaggtaattttttagaagaatttgtaattacatgtactcatggtgttgagtaaagtaagtagaatacaggaattacatataatatggtttaacttatatgagggctatatggtcatcccttggtatcctcaggggattggtttcaggactccctctggataccaaactctgtggatgctcaggttgctggtaaaaaggtgcagtatttgtgtataacctacagacatcctcctgtttatttctctggattacttataaaacccaatacaatgtatgtactatgtaaatagttgttatactgttttggttagagaatagtaacaagaaaaaaatctgcacatgttcagtacaggtgcagcatcctttttaaaaaaatattttccgtccatggttggttgaatccacggatgtgggtgtggaacccatggatacacagggtcaagttatgtgcataaaatggaaaagcatatattattacagtgataaaagagtttctttctaggtgatgttattatggactgattttattttcctccttatattttgcatatctcgtaaactctccactataagcagaaaataaggttggagaaaataagaattgaagagctaaatttttttttaacaccaagtgatagaaaactctaaaaatcccattgaagataggatcatagacaaatagtccctgatgcctgtgctgggatagtcacacacagctgcctcacctctgcccccatggtgaggatcccagtggtcagggacagtgacccatttggaacatgagcagttgggtcaaatccacaaataactgttttaaacagcagtcattttatttgaaaaaaaaaaagtcgatttgaaaagccatttccccccactgaacgcacattcttttattcttttatttagcaagcagtttggagtgcctactagttagttcctctgacctgaagataacattctgctactagtgattttttgcccagtgattgttgaagttttcataaatctcgttgatagaatgttctattgtgtaagtaacttgacagttcctgttctcacctggttcaggtttaatgattaagttggattagctattgaataatgaatgtttgtgtagaagccagtcagtgaatacctatgaatctgaaaatgcagctttaatcagtgctaggcttgctgggatccattttgctgtttctttgcagtacaacgtgggcaagcatctgtgcatatgaaatgctgtttttctaaaaggtaagtttttccagagcacagtatggttttctttgctttcagaatctttgaaaaatctttgaatattttgaagtcctccattccactttataatttcagattaataacttcttactactgtaatttcatacattttatactacccccaggaaaaaaagtatttacttacttcaaatttcttgtattgatttcagttggtctcattccacattacaattatggctttccattccacaaggtacggtttagagttgtgtttcaaatttgaaatgggttgtgcattaataaagctactgtttttaatttgaaagaaaagatcttttaaggaaagtttgttaggcactaggataaatttttgaaatgtttgtcttatgtaaattcatgatagcctcaaattgttattcctctcctaagaagtggcactttcagcttcttcatttgctggtttggcttagttgtatattttgtttcatatgccataaccaaggaattctagagctagtatatgctatctaggtgaactttgtcttcttgcaaaaataaccctaaattctgtgaaacaggtgatgtcttacttattctaaagaccttcagagaaagaaattctgtattcttcctagtgtttagtttctttcgttgtccacatctttctctctctttttatcaaataaaaaaacctagatctttttcttaaaacttaaactgctttgctatttgatttatgcttacatgaatataatctattttttattatgctccttaaatgtcctgactgcctattttgtattagttgatagttttgctctgacaatagtgtttgtacaccagcgaattagtatcacaaaactattctccttggagagataatgaagtctttgattttggattggagcaatgatatagataatccaaacacaggtgcttactttaatttacttattcagtaaatattaatggagtacctattatgtgccagtcattgggctgaggattgaagatacaaaacaaacaaaaaccaccagtgctactgtgttctaatttagtgttttaagatrtagtaagtctaatagggacacctttctgatatattggcagtaatattattttggggggtatattatcatcattgatcttattatgcagtactattttgcgaagaaaagtcactgcaaatctacttgcttctttttgctgggagtgcctcccttcagggaaaaaaaaaatctaaaaagaaaaaaagccctcaactttagggaagacatacatacatgagttgtaagtttttctttatgagaaacagtatgcactgagtgtctgtggaacaagaattccccttatctagaaaaggatgacttagtttgaatttcctaattaataccgttattaaagtcttatgtgactgtttttagtacgwaggaaaacacaacatcgcccacttacatgaattggtaatcatccctttctttgacagaccatagaccttagacggaggcacctgtgaatacattctctctggacagaggcatattacctccttacattcttgtgtcttggaaggtaaagttgatgttagtttacctctgcaggaacaagacaaattttattctaaatacagttgatatatctcaggaaaataggacaaggtgatcctgaggatcggcgaacacatttttttactggcagaccttatttgtatttaaggtagtgataacatggtaggcaatatggacagtaattaggtgtaaagattctagagacagattaactgggttttaatccagttctgctatgtactagctgagggatattgagcacagtgcttaacctttatgggcctcagttttctcctatgtaaaaccaggataatcagttttctcatgtataaaataatgacaatcttattaggtcattaatgagaattaaatgagttaatgtttgtaggacagtataaaactctggtgcatagcgttacgtaagtgatattgaatgagtgaatagacatttagttaattcattgctgttttcggttttaatcacatgttgtaataaagtaacatgttctagttccagggcctgatcagtcagtgatgattaagtacatttctccccctggtttttctgccctgatggtgcattataagcattttagaaaacagaagtctgygctcctccttggcatattgtccagtaatcctgggaattcagcctgtgcctctgagagcaaattggaggtcgagctatcctgaccccataccaaggagaccttgtactggggagtgtgtgagtcatcttttcttgccctcgcctggccctggagccggagggggagcctggacagtgtccaccgtgggccagtagagccaatccagggcctagattcggagccatcatcctcacaaactgctctggttgaaacgctggctttgtggggtttgtttcgcgtaaaacatgaggaagcccaccctgacattgtctaggcactctacttaagtcttctttagatgcaggctagtttgtcctggccttatgaaggagttctccccacctccttgaaagggtgtgtaagtcgctgcttcccatgcatatcatgtagttatttcaggcatctgttcttttttgcatcctaagtgcttaaagcttactgaattttagtctcctgcatgacaccatagtgtaacatgactggtggtaattttttctccaaactcatggtgagacagctgtttagcatagaaaggattagagagaagatgtcaacctttctacccacagttggattgggcagcaccatccaaggctgaagaatgacatgcagaagctcctgattataaaatagcacaaatatgttaggcctcagcttttcctccttagcgcaaaggcttgggtaagctcagtgggtggtgtgggagagtggatgttgcattagaaagggtagagactgcaaagacagggccacaagtgaggaatccaagagcgaggctgatggggtgagcgaaagggggtgaatttaggagcccttaaagatgtagaagctggaggacttgatggcgggttggctgcagtggttcagcaggagacagtgatcagctgtgaggttgttctcataaccaagacacaggatctcactggactgtgtttggagatgggggattatcaagttgtgagagcctcagcgatttttgggtgccagttcatcctgctgcctaggcctctctgttaccttaccactggcgttgctatttaagaaatcagtgttcatctcgcttattggcagctttggcaagtccctctgacactcagtttcttcatttttaaatggaggatcttagattgtttgctttacctttctcttggaaatgtaaagaatttataaaaagagaaatctcatttttgaaagtgtatatggaaagtttaacgtgtcttaatgaaggtacattacttgaggaaatatagttcaactataggattaaaaaattgcgttatccgataatcatagatgctcttattcaccttcccagtatttcaaacatgaataatttttagagcctgtaatgtgaatatggacagatagtaccactgctctgctattctattttgcattttaacttgttccatttctttgcactaggattaaaaacttgtttgagtttactcaacaaaattcatttgcctaaaaatgaattttattagatcattttcctgtttaaaaatttggtctgggggaggtgctggaggtggactaatacaagattatctttgtttttgcgtttarttgtacaatttaaatataaaagaaagcaagccaaggcaggaggatctctagaggccaggagtttgagaccagcatgggcaacatagcaagacctcgtctctcaaaaaaaaaaaaaaaaaaagaaaagaaaaaaaattagccagacacgcgtgcctgtagtcccagttacttgggaggctgaggcagatgggttgcttgagcctagaagtttgaggctgcattgaggtatgatcatgtcacagcacagcagcatgggtgatggaggaagaccttgtctcagaaagaaagagagaaagagagagagaagaaagacaggaaagaaagaagaaaagctgccatcttgcgtccccatcatttgtaagagaacattttaacattgttggcttacagaaatccttcactagacatttgaggtcttccaatattagcctagaacttatatatgccaggcacttttctaggccctttgcatttcatcctcacacacactctgaggcatgtactatatctttcctattttacaagtgaggaaactgaggcaaagacaggttaagtaagtttggaatgctgtataattcatgaatgtcagcctgcattagatccaggcagtctgattccaaagtccatgctcaacctctttcctctggctcctacatcagtggttctcaaccctgattgtacattagaatcatccaggggccttatggagcagggtggggaagggataaataatttttacagggccctacatgagaccaatcagatcttccctcttctcctgctttcaggttaaaagtcactctctctctgttttctagacctttgtaatctcttctttccttgatttcttggcacacgtggggctcctaatgaccttttgcaattaaggacacacagctttttggtttagctctgtaagacaggcaccatggagacagggagatgcttcccacctgtatgtaacctgcgcaaagcattttacaggtaacctggagcttgattgttaattcctcagcatgtgattcaatatattgttatttttgcatcaggggaagaacaaggatagttaataagagagatctaggattaaatagcaactctaacatatctgagccacactgttcttacctataaaatgggagaagtgataatattagaggacttttgtgaagattcaatgaaatatggaatatgctctgtaatgtagtcatcagaaatgaatgctaaatccattgccttgtaagtgaagcacagcaccgagacttggatatgaaaaatcacttgaaagtatgctgttcagtcttcagtcaaatgcaagaagccagggaatttggggagctggactagaccttagggatcagggaatgcagtctcttcattttattarcaaggattgaagcctggagaaggaacttgaccaagggtacactgtgagcccaaatatatgtactgtacaatatgtagtgtacaaatagttaataaatactttcttggtgctgtgatcattatcagtttttacttcgtagcatttgtcttctctatcacttcagtgtgctcatgtatatgttatgtaaccctcaaaacaattttgtaggcctagcttacctgaccccagtgtaagactttgagataaaatcctaaaggataccaccatgggatatgggcttatggaggtactgaaaaataacatatatttaccttgttgacttttcttgcatgagagggaaaagagttaaagacattcaaaccacatgtgattgaaagcccacgaacctctttccagttctgttttcccatgaaaatgaggctgttgtatcttcataatttcttgcatgtataaggttaaaaacagaggggaatgaagatattccagctacatttctagtagaacacctacattttgtttttctaagcatactgtaaaaacttcaaaacagcattatgctttgcgcttattttaaaaccattattaacaatattttctattgatgctttagtatagatttagacttctagtatcattgattattataatttgaattaaaagtgaaaattcrtgataggtactgtttacttggaggaccaattgctgtggaagtgtgcagcctacaatgaagataataagatgcgtcatttgaatcaatatttctcccacctaaacaaaaacaattttttttaatcatagaggaatcatttttagaactaccaggtgaatatgctgtggtgtcaattaaatacagtggaaactacctattcttactatttacaattcctaatcactttctgtctctttctgcaactcattacgtgtaccacgatgtcttgattccctgaagtgcctagtaaattttctctttgtaggactatgaaattaaccatgggcagtggagggggcgggggggttgggaatgcctgtgccttttccaaaaattggggttgcttagagaaaatgataatgtttagcatttttagtggtgcctaaatgtgtgtagagaaacacctatttcaggcctctccaaagactttgattgtctgaaagcagaaatatttgcagtttgactttacttggtgtttacagtacactttctgagcactttatggatatttaatattgtatgacatgatcagcaatatctttttttccaaataagtgggtttttaaaaatataatggaatcagaatgtgaataacttttaaaattatttattatgcagagaaaaatctgaagccatgaattttaaatctcatgtaagttaaatttggaagtacacagatttgcccagaatctgaattttataagccttaaaaactttgacattttaaaaatatttgaggagtttgttattaccatctcttaaatgcacacatttttttcagactactagggaagagagtggctaagcagagcattgttgactgccccagacatcctcgactggtttctaaatctgaaataaacttcttagtcatatggtgataagcagaattcagaacatgtctcttttttaatgcatgtgaaatagaaagtgatagtcatcacaaaatgaaatttgatttatgatgtgttgatgcatcgtcatactaaggcacgctgaaaaatattttcagtttcctaataaaaacaaagtgacctccccatgagtgattctcctaattgttattgtyaaatgcttttctttatgctttttttcttgctcacactcagataatctacaaacactgtttgaatcctgtgtttcactttcttttcttatgaaaagttttcagtgaatatagtccctgagcgaatcctttccaacaaagtacttaactttctatgcacacaattcaaaagtcaattaaatgtgcgtgattcatttatcacaaagagtaccacctatactctgtggaaaattctttctgttcgaaagaaggttcttatttctaagaatgagctctgattttaattaaataaagagcattttatgcaatttttttctaaagcttaagattaatttctatggttactagggatataaatctctagattgctttaaaacaaagatttttgtccaggagagagttracagctccctataagagaagctattacttaatttttctttcctaagtttaaacacataaaaatatttgtaatgataccccaaaggcatcataaaaatgtaaaataattgtactctaaaatatctaaaattacaggaaatagacctcattttaaaaaatgaactgagattcatggctgggtaaccggagtgtgacatacttcaaaaccagaatctcttgtcaggatacttttagttttttaatggctaaaaaaagaagtcttttgtcaatcataaaaactttaaaatatgttcattctattaggaaatcttactttttagtttcattacctttaacgtatattacactgtggctgcgctagatccctttgagaggcacatttcagtctttagaattaggtggcatcactaggcttgtgatcaacgatatcacaagacaaccgttagactgtttttaatgattattttttaaaagtacatagccattttctaagcagctttgaaaaaaggcagcataaatcgtttccagtgtcttacttacccaaagtatacttcctctttcggtagatgatgttaactggtaaattgttcccaggttaaaggtttgtcatattttaataaatgtagtgtaaaatctatagtagagacacttcaaggaaaaaaccctcaacgttttcagtaaatgaaattaatatatatcctttttcctacgttagtattatggtatcatttcttttgttatttttatttactaaaactttaattgagccttatatagtaaaatatcctcatgtttttaggaaaagtgaaattagatttataaaatgtccagactgaagttttgaaagaaatggcattttgtatataatatggatgaatgctgttgaggctagacgtgctcgtagtttaaaacatgcctgatccgggaatgctttgcattaaatgagtttatattttgagagcaaaacagggaaagaaaacactttccttctttttttttttttaagagacaagaaaattaagttgaatgcgtatattgaaagtgctataagccgaatgtttgaacaacaaaagtaaacactgattattacaaatgtacatttggaccacgttgcttttatctttcaagcaaaacatttcccacagtttttgtgggtttttatttaagttgggaaaacttcggaagtttgtgtgaaagtataaataagtttggaaatgtcatgattagagtttgataataaacatgcaaaagcaaatgggaaactctattaaagtcagatgtaacattaaataatgttttctctaaaatgtatttgcagagagaagaacagtgatttatgtggatttgaaacaaagactttggctgtaatttaaaataaaggttaaatgtgaattcttcagcctgaacatggatgaagttttttgtttttaagagcttccttagtgattgttataggagcctctgtgcccttttccaattatgggcacagaaattatgcatgtatttatagattccatgtaaaaaaattcttagtttccaataaattttaagctgcattttacgaagtaagcatctgtagagaaccttttggagaaaaaataggagggaaaacgtttcagtttatgtaattattgaaatataccactgtatagagaatgaatagaaatttaaaaccgtaatctgaaatttgttttaaatctcattgttatgagattgacctcataattgcaaatcggcattttgtgttcagtacaactccaattcttaaggaaatttgtctgttctattagagtaatactgtaagtttaggaagatgcccctttggctattgttacatatgggcccttttgaaaatagtggtcatgctaatatttgatcagataatgctgactaatgctgtagagctttcgaaagatttcttgaacattgtcaagttttactttcctttcttaggtacatgactgtgtatctcttaaaagtgtatatgtatttgtggggggcagttagtgttacatttttattgtaaatttattacarttcgatatgtgattttgagtgaaattcattgcaatatgaatgaaaattttttgtatgtatggtgtttcaaatgctttacctaattaattgtctgaaaaactgttaaaggggatttaaattgcatatactagttttacatttaaagctttcacactgagctgaattcagatacaggaccttaaattttttgtccaaagaaagtaagaactcatgtagaatgaaaagatataatttgagtctcaaaatcaagatctttaatatactgctcaggacctaactattatttttctagtagttttcacacatttttttccggcaaatgttatgttacggagtgattattttgtgttactttgtacacttaaggagcaatccatttttagcagttgagccctcattttgtaaaactaagctgttggcaatttgctagtttctttaaattctagaaaccactaagttttaccttttcatttatttccaaacaaagaagatgttagaaagttctgtaacttatctcttgaaataatattttctggccgggtgtggtggctcatgcctataatcccagcactttgggaggctgaggcaggcagattgcttgagcccaggagtctgagaccagcctgggcaacatggcaagacctcgtctctaccaaaaaaaaaaaaaaaaaaaaaaaaaaaaaaaaaaaattattttgcatgtgtattgaagtgctttgagtttcttgccttgttcactccaaagacgatcataatgactttcctcattataggaaaaaggaaaaaagggatctgtatatttttgaggacagggaatgatgaagcaagaccctggactttgcttggaatttggacatttgtattattggtcaaggccagcatactctgcattttattcccattcacttagttgaaagatgactttggaggcaaggacatatatcttgttaccaaaccctctttctcagaactttgagataaaatgaacattcattcctttgcttttgtttttgctaaaagagaaaaaaaatcagtttgagtaaagcaaaaacatttctacttttggggtttgaatgataacaaagcagttgagattaaattattgacatctgwcaagcagaatggatgttgaatgtatgttcttgctatgggccgcttgaagttgcttttgctattctctttgctgatgtgaagcagaaaatgaacaaggtaacagttttgatggtgagattagaggtagccaggctgactgtctcctggctcttagagacccttataagctcagggccaccccctccccttgtttagatattacttgctcttttgagtttcagattacaggagcaattggtctgcatgacctatcttaagaactttaactttgcagtagaaacttaaaccaaatgtatatcctcaagagacaaatcatcttaaaactaggctgttgtcattttgatgtactgtactgctcactgaggaacagtgtggtggagagcaccacctagtggatgggacccatacttgatggrctgtgtaggagatttcgtctacattgatgtaactcttgcccttgtcttgcaaataagtgatttttaatcgtcctagcacatatttttaagtagcgctaggaccccaggagaatgagattgggagtagttgtgagatatgtcggttttctttgtagttttcgcacttctataggtgtatgtactggtgcttgacatctccacattcttataagctgatattataattcaaacaaaacttttttttttaaatgtcagtagggtagtatttagtctttgggaattttgtgtttttgagtgcttatgttcaacctcggtagtaagagacggctttggatagaacctgtttgttgccacaaactttatactatgctgctaatctgttcacctcacgagaggaggagttgctgctgattataaactgtaggtcataaattgttacctgcttgtcatagagactatatgccttttgagtgtactaaaatatttgcaaaaattagatgaaacaattccacatttaaaaaaaaaacaacttttaacacatcatgaccacaaattttaggtacagccattccttgatatttattttagaatgtcaaattcttgataaaatgtatcacctcttcgtttgttgaatgttcctagacatttgttgagctaggaactatgccaggctttgggaatccaaagtgaagaagacatagttctttttggacttagaattttttaaagttttaaaattcttcaacacaaaaagagtgagcgtattcctgggatgtgggatgtattatgttggggtataaatacatttttttgcttaatattttctgacatttagcaaatgcttttgaagaaactgctaaataaaattgatgggtttgttttcatgggtttggcaggggggaggcgacagaaggctgcaggtaacacctctttggtttcgttcttcactgagttttatcctcggagagcccaagtttggaggcatagagtgaagaatttaagagcacaggcttagagtctattccagagtatggaccctggcttttcaacttgccaggtgtgtgcctttgggcaagtgtactcatctgttttctcatttgttgtgaggattcaatgagatagtctatacaatgggtttaacatggtgtccgacacataggaaacactaaatgttcaatatgatttattatgatgatgatttggaagtttattatgatgatgatttggatgattcagtgtaggtggttctcatggtgcactcagtctccccaccacctgcaggccccagatccctgcttagtgtgaccatgcagacaaacccccactgatggccagcagatgtctgcgggtgctgagctagaaagttcaaagttcttccttatgcagatgatgtttacagaaagagtgtaccctcgtgtgtctcgtgtgtgtgtgtgtgttgaacagtgtttacaatcagaggcacttaacctgagctccatgaaccaaaagcctctgaagctcaaaatgacaggcagaaagttttttgtttttgtgtatatgtttatttcttttatagaagagatcagattcatagcttttgtcagtatctcaaaggcatctgtgcccctaaaaaggtcaagaactatactttagatgttcgtgactctgtgtaaggccactggagaaatttaaaatatagtcccctcttagaaagtgaaactcaaatatgaattttgcactatttgtttttgaagatatgtaaataattttaaagatagagttgatattttgaggaactcaaatatgagtaaaatgttttttcctctcgcccctcttgtcaaggttctgaagaattttaagagcaaggaaaagttaagaatacaggctatggagtagacctaatttcaaatacagctccgacacttcctaatgagtcctcaagccagttaacttggcctctcttctctgtaaaagaggaatcctaggggtacctgcctcctaagtttataatgaggattaaatgcaataatctgtaaaaagcccttacaattcttcttggcatatagtaagtactataatagtgtttgcggtgatcatttttgttgcatattcactcaaaaacatttataatgtatccacattcgttgtctgttatgaattgtcaaggtaattcttttcttgtctattttacctccatcttattgacatgtgaatgacatttctgatttcttatgagcagactttccaaagttctgcagctgaaatgccctaagtctgataacctcagtaactagaatcccaaatgtacctggagccttagaatgattttggaagctttggaaagcataaaagtagaaagaaactgacggggttggtggtaggagctttcaaattgattgaacacccaaaaattatcttggaatttctgagctggaaagcatttgggggttctttccatgcaaccttcaaagcacacaagtgaggaattgcacatcacccggtgactccaaagtcagagaaccagctgggagttaccatgtgcctggaggcgctgtccccgccctctgcctgcgtgctgaccatccaccactcgtacttctaagagagcaaaggatataggctgctcatggaattctagtataagcagtgatcccagaaaaagtgtgtggtgagtcaaagactgttccrtgcaggaaagtaccagtagcatcgagaaaaaggagagctttgggagcaggagaaaagatacggaggagagcgcataggggacagggcagggacaggctgcacgctgtaggtgcatcccacagaaacctaatggtaggaggttatctatgtgtgcttggcagaaaagaaatgcctgtttcagcagtgcctgccgtccacccagcgtgtgtgagctctggggtgagggygagatggggcttgcgaatctgccgttcccatcattggttttgttccctagggcctcttctactaagagtatcttgcttactgcctgcgagtctagcattttcactgtcatcatgtctcctaaactcaaaccagccacttcctctgattcacaactgaagaaatggcagtcttttccaacactgggctgggggcactggctggtttgaacccattgcaagaatgtgttgaagtccagagtggccttgtggccttttaaaattgtcatttgaattgtgtatgcttttcaccttatgcactaaagttcaccttgccctatgggtgagactgaaatagtgatgaaatgaagaagaaaacttagagtagttgagcacctactgtgtgccagacacagtgtcagactcttcacagacattattttcatcagtgacctgtagtcaccttcagcattattactgtctcaagtttatacctcagagatgaaggctggaagaggttaagtgacacaaagccatgtcactagtaagtggcagagctgrgatctgaacccaggtctgttttacctggtttcatcctttgcagtatggagactcagaagaatgcagcatgcatgcacactctccacacacagcctccagaccagatggggtttggattgaaacgcaaagcagtgcgaagttgggtcggatccttgggttggaacttcttgttctgttctccctcctcccttcctcttttctttattacctccgtccttaatgtgcctggcccatgctgggtcttacatatttgtcaagtgaacaaatgaaagaaagttttccaagcacacagaaaagaaagtagtcattattaaccggcagggattcagaagcctgagccatgtctttccagcctattgtgtagttttggattgggttgttaggcaggtaggggaggagaatatttgtttttagacggcagtagttagcaaagcctctccgtgatgtttttgtggaggaaatgtttttaaaatagacccttagggtgttcgtgactagttgagctggctgtctacagggaggggtctccggttctttgttactttttatatcccattttcatctcattttttgaatgatgatttttcattatagatgtctttaatggcataatgatcagaattgcaaatgacaggaggccaggaaaaatgtgcatataatgaagacctagtttatcagcagcactcatggaaaaagtcattttagtcgatgtaaattcagctcgactcagtgacatgaaggtgagcatgcccttaagtggcattactagaagcccagagtctggaacaagggaagcaatggttctgttttcctctgcactttctgctgacacagagagtattgattctattctggaaactgtattttatttgggaggcccatgaactattttcagaggtagtaagtatggccagaagccgcagatgtatttcatataaaaaattcctgagaggaaggggccgggcrcggtggctcacacctgtaatcccagcactttgggaggccaaggcgggcggatcacgaggtcaggagatcaagaccatcctggctaacayggtgaaaccccatctctactaaaaatacaaaaaaattagctgggcatggtggcacgcacctgtagtcccagctactcgggaggctgaggcaggagaatcacttgaacctgggaggtggaggttgcagtgagctgagatcatgccactgcactccagcctgggcaacaggagcgacactctgtctcaaaaaggaaaaaaaaaattcctgagaggattgggaatgattagcttggagaagagagaagactcaggtggagtagatcacagtagctgacctcgattcagagtaagaaagaactttttactgtctgaggtgaaatggatggccagggagaggcagtgggtgccctatcatgctgctcttttggcaaagcaggtgtcttctagatccttgctagtcttaaccatccaagcagggaggtagtcactgctctgtgtgtcatctagcctgttctaggcaaatagtaaggtcaggtaaaccgggagtggacagagcttcagaaatagtgggaatgtgttcagtaatgccaaataattgtagtttggggaactagaagaatgggaatgaagatgtttaattagattgaagttagtaagttggggctggaaggagtgaggaggaagagttgagtgcataataaacatttgtttttttctatgggtgtaagagtcctagaagtcttttaaaatggaagttgcattgagtttaatgggaatcttaagcattataaggtgccactcaacttttgaaattaaatcatgagttctttgtgtcatcaacactaagattctaggtttttgttttttttaatttctgggtttctttaaagatgataggggcttaatattagaaaggaagctatacgttccaggttgttagaaagttagttgctaatatgagaaattagactgctaaatccacctacctagtgttaaccacccatgcccccctgttaaccagcctcattgtctgttacttgagactctctgcagtaagaaggttggatctagaaaagtcagtctcctcttttgtgcacatgttttctctccttctgtctctaaaaagacatatgctgaattctggaagccgcagtcccgtaagattagtattggttcttagcaataggttatttagctattgattatacttttcctaggttaagatggccttatttattttttctggtaagatttccagactgatggaataaagaacttgatatattcagctaacatttatcacttacagcttgcctcaaggaaggtggaaagtgaacccagaatactatattttaaagcctccttgggcctgcaattttgagtagaagttgagtgatgggaatgaagacattctgggcagagagaagcaggtgccagagtgcagggcagagaagaggaggcttgcttaaggaaaggctctgtggtctggcacgcaggtggttgcaggaagtgcaggaacagaagctggtagatggagctggctcctttagccagtgtttaacaaggtgagtsgatgggactgactgaccaatttcatttgtagggtgaaaaagagagaagagtgtaaaatggccaaggtgttctaacttggaatctagaaaggatgaagactttctctttggggccgtcagaacaggagggactaggagtaagccagagggtgtgagtggctgcatgaggataccgttgggacatattgcttttgaggcgtcagtgggacacacagtggcagtatctaaaaagcatttggatacactcagcttgaacacaggagggaggcagcggctgggtggacaattcatgtagacagtaaataaagctatggattggaatgagtgagcttagcaagaacatgtaaagaaagagccaagggctgaacttacaagaagtttcagagattaacaaaggcagagagggaatgaatgaaggtgaagaaaaggagttataggttttagaaaagaacctasagacagtggtgttctggaacccgagggaggctagtgcttcaggaggggacaaggaaggaggaggcaggagcagggaggagagccatccgagtttggtgaggcctggtgaagagtgtccccctcagtaggaattgggggaaagtgacaggagttgcttactcaacaactgctgaaagaaaagaagaaagcgagaaaggaacagttcctttatgtattccctcaacaaactcgctgctgtggtcctgagcacagtggaatgtctgtggctgtgctagcctcttttgtgggtgattggtcactggggagcttcttttgcacagggataggactcagacagtccccactgtgacatcagcaggtcaacatgctccagaggtgtgttagttctgaacttttagctctgacttagtaattgctattgatgcatttttcaattaagagtgaaaggagttagactcggaatttagtcagtgggctccaaattaaacttgggtacatgatccttgtgaaaaatcactttaacttgtcagtagttggcaaacatacagcagtggtttttctggctgtgcctttggctgcatactaactgaacagcaagctgtgtccactgattgaatgaaaaaaaaataatgattttgtgttacagggamctttttacaatatgccagagggacctactggagtctctttaatcttgaacaatgcttgtttcttgcagaggcaaattatgcaaatcagtacttagtgttccataatcaatcaggtctttgttggaagtgttgtgagtgccagcagaacagaatttctatcatcctgggaagggtgagggggtttgcaagtcaaaccactgctgtgatcagcaaaggacacttgccgactgctttgaactctccccacagtcagaatgcggtcgctctttgagaagaatcccatcattttgtaccagggtttttgttgtacagtatatcgtgctttgggtaattcacaaaacacccacgaaggaacagctagcaaggctgttctgtgggtgacacataaaaacaaagctgggcctgccgcctgggatggcagctggcagccatgctcccagagctccctttgtgtggaatctgcctagagtgcagtgtttcagaatattcctggactcaactcatctgtagtgcatatgtatgcttaaaaacaatctcatttcagcttcctcctgcacagaatggtgaacctttattaatcctttgattccagatcaaaagaatcagagaaatttttaaagtccttgggaaaaaactgctgtttttgagaggtcctgttattactgctgctctaatacttgtgttgccatctagtggataatgggaagtatgtggctgccttagtatgtttggagtttattgtaccctattactgattcttgaaggggatagaaaatcaattcaaaaagttttttaaaaaaagaaaatcccatgtggagcattaaatagttattgaggagccactttgggctaggcagacgcctcagcagcttatgtcagggagacatgaaaacaattcaaaactcagaagatggtgacatctctgcaagggatgtatttgcaagatggatccttaacctggcctcgagttagcagggaagcctttaggaggtgtgacacctgagcagagcctcacgcataggagtgagtcagaagacaggattgggaagcagggagggctttgcgtctggagacagcagcagagcgtagggcactggcgggccttgggcatgaggatgtgggcttatcctgggttaaaggggaaggtaatgtacagttttagtcaaggaagtatgtgggaagattcaccctttttgattgtttaataacatgttttatctgattataaggattttacgtagtaactgtagaaaaattttaaagtgcaaaaagtatgaagaagaaagcagtctccaaatcttaccacctacaatcattgataccttgccgagcagtcttttagattcccctctatgtatgtatacagctctaggtgtgcatttcctatgtttcacgcatatgggtcacaccatacatgctttgggcaacctctgttttgtctcagtttttccccactaggtaatatgcttatgggactttcatccatgttagtagttcctggtgttgagtccatgtcaactgtgtagatccactgataggaccagctctcacaggagacctgtttgcctattgggatgctgtgttgttttgtttggtgtttcctagtaaaacctttatgtgtataagagcagataatgtaagagagtctttttttccccctgtcaaatgcatctcatgtagggaccatactgctgttttataatgaatttggttttatggtagatgggttttatggagaatttcaatgtcttgatgatctaggaaattagcgtcattaaaatatagctagttaaaaagtaaacttgatttatctttggagaaagaatgggatgagtcagatgaatgcctgtagttttagaatggagtttaaataacttgtttggttaagtattagcctaatgaaggagccagagcctggctgatcctggattgtggctgttagttctgtgctggcccatagctatagacagtgcctttcacctgaacaagttagatctcactatgtcccttctacaggtctggtaaatgcgacctgcagtgacttaattgtactcagatgggacagcagagtcatctttgtgggtagacttgcagaagctaaaagcacacaggcactcggtttgagacataccaaacaaaaatttatttttgtatttatttcaaaccatttatacaggatgtgttagtttactgtcttctcatctgcaaaagggtaataatgatacctaccctaagggattgttaggagaagcaaatcggatgcatagcatttagattggtgcctgccgtatagtatgtagtactcamtaaaaattgactattaacttgtgccactactattttttaaaaatagtttttacccaattcccttttgtagtgaagcccacggagattaagcaacttgctcaaaatttcagctggcaaaggttaaaagttgagtggagcttgtaaaatatatccctttcttcccagtccagtggaactacctgaaagaaaaatacaggagtcagcaagaaaaagccaagtggagaacctgactttagagttatggcccaatacgagtggggcatgggccagaatataccctctctgctggctggtcgatctgaaaagaggagaggacagggcagcatgctctcccttctcaaaatctgaacacagctctctcctcttccctctaagaagagtgagtaaaggttgggagataggccaggaagactggtccagctgaagtccctccacatgatgcatggcagtggggaataaggaatcccttcacagtaagtggcaaagcagggagtagaacccaggcaccttggccaactccctggatttcatgcccatctttcttttgtccaccctgattcatccaggccccccacagagtcttttcctctgccctctaccctattctaagctaaaaactgaatatagatgaactcaaacgggagaatgaacaatcctggatgttgctttcgttacttgtttaaaccatgttttcaggtggcttgatgatagatactcaaaatgcactggtcaccgttgtactgccagtctttctgaccattctttttccttgctgtatttgtgaaccttcttctcaatacccctatgggcttgccaatccaaagccccccatgtcgtaaaacrcaaggaacagtagtagccaacttcagaggagacaaatgtcaatcagtgaaaacgtttttgttttttttttttgccgatctttctgtatccagtgtagttaatttgttaaaaaatcaacatatacaaatactctcacaaatactctcatgaagctcagtttctttctatgaagaaaaattcagacctaactaagctaaacataacatgaacacygtgagtcatacagatctgtgatcaatgccaattcttccgtttattagccttgtgaccttgcttaggtttgtttccatgtttactaggtggggcaggaggaggtaatgtctaattcgtacgatcgttatggaggggtggaaaccacagagcacacgtcaagcagtttatgcactacctggcacacacgtggcgggtgctctgtaagtagcgatcacgattgggtgaaatcaagcatgtactgcatgttgaatagagatgtagtacaaaaagaaawgagcaggttgatgttgatattgcccacgtggaggctttttctcagttcccaggtgcttccttgcaaatatagcactggaaaactgtagttgtgacttgccaggattctgtgtaaatttggcagttaagaactcaagactggtacttagactggctggattggatccaggcttcaacccacatgtccctgaggaaattccttatcctctctctgactcggttttctcatccatggggcagccatgatgctgtcactgctcctgggcattgctgggagaagtgggtgagtagcacacacagagctcttttggacttccgcctgactgggagtgaggtcccagtgaaagttttgttgttgttttttggtggcattgatcctgttacatggaatttaagcaaagattgcaagtacttagaaataaagtagccagagattgttgggatttagttgttactaagtaagggttgttcctagtttggtagcagaaaatctctacctcaaaatgactaaaaatgttaaaagaagaaagtactacatgagtttgttttgtttcgttttgttttgttttgagaccgagtctcgctctgtcaccaggctggagtgcagtggcgcgatctcggctcactacaacctccacctccagggttcaagtgattctcctgcctcagcctcccgagtagctgggattacaggcatgtgcgtcaccggctagtttttttgttttgttttgttttgttggtttggttttttggttttttttaattgtatttttaatagagaccggggtttcgccatgttggccagtctggtcttgaactcnnnnnnnnnnnnnnnnnnnnnnnnnnnnnnnnnnnnnnnnnnnnnnnnnnnnnnnnnnnnnnnnntttttaaaataacatgttattatggaaaatttcaaatatatactaaagtggaatagcacaaggaaccccccatataagcatgtactcaccttcagccttgagcaactcaggactcatcctgttgcatctgttacctccccctgtcttattgtgaagcaaatcctgggcattgtataattttacttgtaagttgttccgtgtataaaatataaggattctaaaaacagaaagataaatgaaaacataatcctagtacataatatcattattacacctaactgaaatttattattccttaatatcactaaatattaagtaggagattctttagtgaaataacaatatacagtggacattaaaacgactttaacatcaaatgaaactaaaaaacaccaacatatttattaatttaacagtactgagggagcccatgctagttccccgtaatggttaagggttctagttccagctcagtcagtcttgagctttggtttctttccactaagaatatctgtttccacaggttatcagagttaagtgaaataactcatttacagtaactagtatagaggagacattaaataaatattacattcctttcctttttcttttatctacagttcaattcttgttttaaactacactttatgttagaaatacagaattctctattctttgtccatacccttcctctctgatggagacatatttaatatggcggtgtaatcaaaccgtagctcactgatgaaaactcttttccatgatagaccatcagtctgatggaagactgttcacttgtgaggacagatgatcttgtgaagctgttaggttgcccagtcttagtagattttacatggtgatgctgcaccttctgaacacacctcaagtaagaggcattctcttgatgtatatacttattcctactttatcatattaagtgactcttccaaaattagcactgcatgtggaaacatttaaagtccaaaacataggccggatatggtggcttatgcctgtagtcccagcactttgggaggccaaggggggaggatcacttgagcccaggaatttgagaccagcctgggcaacatagcaagaccccatatctacaaaaaagaaaaaagaaaaatccaaagcatacaactacttaacctctctaaaaatgtgaaaatgtaatgagcacgtcagaattgtatgcgctataatatgcggtctttgccagtttattctgaaaaataggactgagtctaacagtaaatagattaagcttggccaagagtctttataaagttaatggtagtcatgtgattaaacagtcaaatcattctctgcagagataattgtattatgctatttggggacttaggtatgcctatgtagataaatcaaagatttgttgaacttttttctttgttgttgatttgtcatgtttttttttttgtttttttttaaagaaattaatagaaaattcagagctctcaaatttctaaagaaatcttaatgttcctttattttttcattctcagcatttaaaatatcatacattgtgttcctgttaagtattgagttattatactgatgtaatttagtcagtaattacttaacacacctcttatcaagaattctgtttaatcctgaaccacctgcactctgttttaataacctcgtnnnnnnnnnnnnnnnnnnnncaacctcttgtataataattatgtgcttgtgggcctctgtggagcttgcttgctcctggcattcatccctaggcaccatccctcccttgtagaatagaactaactaaaagtaggggtgggcagctggatctaacctgtacagtagattcctctgcacttttcaaaactttgtatggaaaactttatggcttctaaaaaaacacctgttgtggatagtaaggttcttagtaggtgtattagtttctcattgctgctgtaaccaattacrtcaaacttgtggcttacaacaacacagatttattatcttatagttctataagtcargtgtccaaaatgggactccctgagctaaaatcaaggtgttggcaggaccgtgttcttttctggaggctctaaggaaggcccattgccctgccctttccagcttctagaggctgcccacattctttggcttcctttccccatcttcaaaaccagcaacattggaatgagtctttctcacattgcattactctcactctcccttctgcctcccacttccacatttaccgacccttgtgattgagcctacccagataattcaggataatctctctactttaaggtcagctgatcagcaaccttaactcatgtgctgcattaatgccctgttgtcatgtaacaccatatagtcacaggttctggcgattaggagttggacatcttacagggggatgggcctgggsaagctggaaaaccattattctgcctacggtagcaggtataatccttctgggattattcagtacccactatttattcaatatttagtaaaagtttctgagggtctgctttgtgccagaaactgtgcctgacaagctctggggaaagagagaggactctctgccctctcagagtttgcagtctggtgaagggaaatcagtttatgaactagtcattgttatcatgaaggaacaggtgctgaaatagatgcacatgtagcgttttgtgcgggaatgggatctgactgcagctgggagtgtagggtgagtatgaggaggaaaagagaatcttgaatgaggaggaagaatttgcctgggagagaatgatgggtagggcgttccagggaaagggagaaccatatgggtatgcaagtgaggggaaggcctgggacttggaggctggagtggtgcggggtgtgcggcagggactttcagcgctgagttgtgaagggccttgagtgctgcatttgggagtttggactttttcccgttgtttagacactgagatgactcattggctttcctttggcaaatcagcatgcagagctgcttcctttaactgcagtrtattttgaaaccagaattcaccactgtcgaatgtattctacccacgcatttcccttgctttgctcatttatgctgttcacatggcccctggaagtagttgagtgtttgacccctggtaggcaggggaaggaggtaaggagatggaaaccattgaaggttttgaaacagaggagtagcttggtcaaatcttktatgtgatggaatgaacaccttgcttgcgtatctcttaatttttttcccaacagacttaaaagtcagatttccgaccgggcgcggtggctcacgcctataatgccagcactttgggaggctgaggcgggcggatcgcgaggtccggwgatcgggaccatcctggctaacatggtgaaaccccgtctctattaaaaatacaaaaaaattagccgggtgtggtggcgggtgcctgtagtcccagctactccggaggctgaggcaggagaatgacgtgaacttgggaggtggagcttgcactgagccgagatggcaccactgcactccagccctggtgacagagcaagactccatctcaaaaaaaaaaaaaaaaaaagtcagatttcctgatgcagcctaagtggaaagcaggaacaggattgtaaggcaggcaggcatggtggtgcactgggaaacacgctgaatttggactcagtcctgagcttttgaaaccaagctcacatactaaatgtgtaaccttggacaagtcacttagcttttcccaaactggttaatgagaacagtaagaatcatagcacagcagggttgttgggaagagaaataggccatgtacgtgaaagtgttgagcagtgtcagggatggtggacagtctctcagtcctgatttgctatctgtgaaataaatgaatattgtgaccatacttaattctttttctttgatttgtttgcttacaatgccttagggtgtttttctgaatcacatttataataagagtctagactatgtgggaaatttagctgaacccaaactgacatatctccagacaaaccatggatgtttcttttgtgatcaatgctattttgtatttaggcatatactcattccacagtgtttattgatcacctctgtgcttcttgttgtgcttacaactgtagggaaagatgggcagcccctccttgcatagttctgccactgacaaagaagtgtgtatataaaagttaggtcagagtacatggccatgaataattgagtgccaagagtgtggtgtgcagaagtccttttaagatcagagcaaagtgaaaattagcctgggttggccttgacagaaaaacttccatggaagagatgaaagttccgcagaccttgcaaggctggggccacgtgtgtttggaacgagtgcaaagtgtgtgagtyggaagctggagtaagacgtcgtcagaggaccagcaggccactggctagtaatcattctccctctggaaacacrtttgtccctattgactgtggtctgagcgttcttcccaccactttttatttatttgtgaattgctagttccatgcacagtacctggcatgtagtrggtgctttagaataggtttttattatactagaaacagccatcacaaacacagtgctttgtacctgtatctttgagttctttttcttcatccatggaaatagcccataggaaagacagagatttgctatgtggggataaattgttacccctgaatctttgctttaactctgctgctctgcatgggccctatttacaaacscaacagcttcagctttagaactgtcccttagaacacttggaagaaggaatacttgctgtgcaattttagctataagaaaagaaaaggaattaaccttattgaacacatgctatgtaattactagacatgcattatctcatttcgtctttaacttacctagaaatcacctactcatagtgtcataggtcctaataattagaggtggaaggaaccatcgatgagagactgaggcccaggaatggtaactaatttgtgacygtacgagagtccaaaaccgacggtgctcagtttgtagcttcagaatctttctgcaatttgcattttattctctattaatttaaaattcattacatgagtgtaacatatctatataaactgttggctttcttttttaattttagatttctcacattggcaaactgagagattttcttctggaacacaggaaagattatattaatgcttataggtaagtacatatttttttaccaggactttggtgactgtgttcttttctacacctatatttcttttgcgctttttgccctcacctttttcttaataactcagagttgtaatgaggaagaccagtttggcagtggaaaaatctcctcaaagtaaaaggctctgctgtactccatgtcctcaaagtcatgaaatcacaacagcaatatcttnnnnnnnnnnnnnnnnnnnnaactccatgagtacttacagagctgtatttgaagttggggacacatgtatttgtatgccctcaacctgtggaagaacaaagttttcaagcctctgctaagctatttttgcccatctcttgcggtcccagtctgtgacaccagttttgctggtttggtgacgttctcatgagcacatttcagtccttaccctcacgtcgctggatcatgcctccctcgccaattcccagtcctcagtcctgatggccattttcttcttttgtccttctcccaggcttttgacacctgctagaggcagctacacacccactttggcatagccttcatttcttacggcacttttgctgaatccttctgttcatcccctaatgttactcatgttgacattccttctggtggctaagtctagtttctactcagtagccagagtcttttttaaactttaattggattatgtcaccacctgagtaagcccaccatgaatactgcattggaattagcattaataccagcctctacactgcggtctccccactcctgatctagcccctggccttatttcaaacaccgccttcccacgacggtgctccagccatgccagccttccttaaaggtgccatgccctttcctggtgcagggcccaggcctatgctgttcctcctcttcccatggtggtttccttttcaaacttaaaggctcaacttaatagtccctcttcccagaggccttctctcactaccctttataaagtaggtctcttctgttagttagtttctccaccctgtatattttcttcagtaacaaaacacaatttgtaattatttaataattacagtttattatctgtctttgtcaccaggctgtacatgtcatgaggtcaaggaccttgtcaggtttccatcgtgtttccatagttcctcacccatatttggcactcagtaaatacttgttgaatgaatgatttcctcctagtcctaaagtccatgactagcccagcagcactcaactgtggtgattttgcaccccaggggacatttggcaatgtctggagacatttttgtttttcccaactaggaagaggagtattgcgcatttagtgggtagaggccaagaatgtgcacaactcaggacaactctccacaacagggacttacccggcccaaaactgaggaggtgctgacattgagatcccctgctgcagcctgacccctcacttcagattaaacttcctggttcgtcacaggtttattgaattctagatgcttagggcacatctgggggtaaaatacaaatattcctgccctcatggmgtttgcattctcgtgggctggcaaagacaagcactacgtgtatagtacattaggtcataggtcctatggaaagaaaaggaagagtagaaccaaggtaacagggatcgggagtgctgggaaagcttgtgattcttacacagagtagtcaggaaggccccatcgaggtggcatcagagcctactcctcggtaaagtttggaacctctaatagggtctctcagtttcctcctcacctcatcaccttctttccacctgtcatagagaaacccctctctttgtttttaaggatactgtcctacttgtgtataaactaaagggaagaaaaaagccagacgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctttgtggacatactgatttatttcctttgaataaatacctaggggtgaaattagtgggtcatacaaatggtaggtgcatgctcagccttaaaataaactaccaagcaattttccaaagtggtttttcactccttgtagcaatgcatgcgagttataattgctccctatccttgccaacatttggtgtaaataggcttttcagttttaaccatgataatgtaaccgagcccaggcttggctgctcaccgcttgcaaagccaataacaaggacgaaaggaaggtgactttatttccagagcaagcagtgggaaggcaggagcgatgctgcgtactaggtctgtgtgtctctttctgatagctatcatcgcaggctggcgacatgtcagcaatggccgggttgtagactacccgccttgaggtaatctctggaattttgcagttaggtctccgtgctcagtctatttcaagttagcccctgcaacttccaggtaagcacataattagatacatacagttaggtaaatgtgcatggtgtaagggaatgtatggtgagaaagggaggggacgtggtgtttcagagaaagtacgtttcaaggctgtattctaagactaaggaggaaaaaaaagggtttctgcagtaagccttaggattacatcttgagactagggagaaaagagaaaaaggaataaaaagttttaaagtgcactttcaggctagcctgtctaattccagtgacaaatgtgaaatggcaagtcactgtacttgaagtgtgtccttctctaatgagaatgatgttaagcgccttgatggttttttctcagctcttctactttgccacagcctttgatcctgttgaccatcatcagtttcttgaaatttcctattcccttgacttccattacagtatttttttggctcctctcaccactcatttttgcctctttgtccttcatctatcccataagaactccggggctctgtttcaggcccttttcttttctttgtctctactttgcttagaaaaaaagttctatctacctccctagctaccctcccacccaccccccatgcccaccttatctttccatcctgaatgtttattctgtgttaggtactctgataagcaccagttattcatattttatctcatttgttcctcacatcaaccctatgaggaaggcactgctgttaagcctgtgtggcaggcaggcaatgaaagcatagcgatggcataacctgaagatcacagctggtgagctctgagccagggctggccatggaatccttgcccttgcccaccacacattcttaccacctactgtggcttcctctctcaccagtatgccagtagtgaaaccacctttgcaaaggttgtaacagtgagaaagttatgacagcgaacgagatctgacctaatcaactccatcttgcctttaacctcccagatgcccttgatcattactagtcgtaggccaaactaactttgggaggaagttaatttatagtttaactttgaaacaaatgtgataacagcccctcttggaaacaaacgcccttcttgcttggggacaaggccacctttgtaaaaccaacaaattagccacgagattagaaattatggctcaggagtcatgtagccagaggccagaagactgctaacctccccatttgctcctatagataacattactgctataaaacctaagattgatgttagaggtattttcagaccccacattttgatggatcagctggcaccatgcagaccaggacactggctcatctggtcttatggcccccacccagaaactgactctgtgcaagaggacagcttcgactccctaggatttcatccttaatccaaccagtcagcattccccattccctagccccctgcccaccaaactggcttttaaaaatcgagcctccaaatcttcagggaggctgatttgagtaataataaaaccccagtstcccttttagacagctctatgtatatttaactctttctctattgtagttcccctgtcttgataaatcagctctatctgggcggtgggcaagatgaacctgttgggcaattacagttgttcctaaatgcatgtcataggcacaggcttctcccagtccccattgccactgtcctgctcgcccagcacctgtgagcagcaccattcccatgcatgctgcccgctcctcccatccgctctagagtgcttcagtgcagcctttgtcacttgcctgatctctttgttctcaactccctgctctttgtcccttcctctcctggtctgtctggaaggcacaggtgtagtccttatcatcgtagatggaatcacgtgcttccctcttcaaatcccttctctgcctgcaggatgtggcccatccatacttcttagataagcaagacttttcattaccctcacccacttttccatcctacccctttccttcatgtgccctacagctgcattcagaattaacatttgttctgcctccaggcctctactcacactatcaggttggcctgttgctcttcactccaatccacacatgtcacatgttcacatgcttccatcctgagagacccatttatcaccaccaccttctcggtagagcctgccctggccctgccttcctatctgaaagccatctctcctgcctctgaatactgacagctctttttctgtgcttttcttatggtacttttcacatgtgcctggtagaagagtaatttgttcgtaatcacttctaccacatttcttgaggtgaaaaactgtgtcctactcatctctgcatgtttatagtgccatgatttgatcaatttgattcattaatcagcttattcattctgcagttatttattgagtgcctaccatgtgccatagactatgccaggcatggagtataaaatagtgaacaaacacaaacatggttgtccctgccttcatggagctgctaaggtattcatgtcaacaggtaacattgcagatatgataggtactgcaaaaacagtacagatagctttttatttttccaacttttaagttcctgggtacatgtgtaggatgtgcaggtttgttacataggtaaatgtgtgccatggtggtttgctgcacagatcatcccatcacccaggtattaaacccagcatccattagctattcttcctgatgctctcccttctcccacccctgatcctccaacaggccccagtttgtattgttscccaccgcctcatgtccatgcgttcccataattcagctcccatttataagtgagaacatgtggtatttggttttctgttcttacgttagtttgctgaggataatggattccagctccatccatgtccctgcaaaggacatcatctcattcctttttatggctgcatagtattccatgatgtatatgttccacattttcttgatccagtctatcattcattgatgggcatttaggttgattccatgtctttgctattgtgaataatgcagtgatgaacatacaagtacttgtccatgtgtctttataatagaatgatttgtatccctttgggtagatacccagtaatgggattgctgggtcaaatggtatttttgcctctaggtctttgaggaatcgccacactgtcttccacagtggttgaactaatttatgctcccaccaacagaacaaagataaaacttaccagaatctctgggatgcagctaacacagtgttaaaagggaaatttatagcactaaatgcccacatcaaaaagctaaaaagatctcgagttaacacctaacatcaaaactaaaagaacaagagccaagagcaaacaaaccccaaagctagcagaagacaagaaataaccaagatcagagctgaactaaaggagatagagacacacacaaaaaaaaaaacgcttcgaaaaaatcaatgaatccaggagccacttttttggaaaaatccaggtttttgcaaaaaattaatgagatagactgttagctagactaataaagaagaaaagagagaagatttaaataaacacagttagaaatgttaagagggatgtcaccactgaccccacaggtatacaactgcatggaaatcaaacaacctgttcctgaatgactcttgggtaaataatgaaattaaggcagaaatcaagaagttctttgaaactactgcaaacaggtagcttttgaggaatttagccttgtcagagaaagtgtccttaaagaagtgacatttgagctgagctctgaaggagtacgagttacctaggtaaagcaagaaggagggaagggaatccaaatgcaaaggggttggcacgtgcatacaccctgcagacagcgtctgtcctgtagtgaaacatgcagagatgaaaaagatagtttctcacacactaaatatttatcgagcagatgaaggaatgatgcaagtcatcgaaaatkccatttggaaagaaaaagagaaaaaaacattataagcaacacttctaaaacgctttctggaatagactccagctctccatagacagtgggagtacaggtgtcttgtctcgtctcttcccctagctccatttgcactggctttaggatggcattttaccgtaggactcatcttcaaatgtattatgtaaattaatgaaaaagttggatttgacagataagataacatcattaggagcatctttttaggatttcatctttataaaacgaggggtggttgcctttcagaagcattcctgtcacaaagatagagaatataaaataaatcctgcttttttttaactttgtcaatatatgcaaaaatggaaatacttcttataaattctccaatagagaaaaataattataccctagttgaattttaaataatccttgatgctttgtctacttgcacttaacatccataggcaattttatgcttttaaatgcacttcatttgcattattttggaatatactaaaataattattccgatgcatagtaccaagaaaaccttrtttttaagctctgagttaaaaatagttggttaacactagatcgcagtgtcaattttatttctaaaggtgtgtatgtgtatcaaatactgatttgataggctgtaaaaaatggaagctacagtgattttgtaaaactttacaaaacttgtataaagctctcaatttgtagcttctttctttagtatctgacaagttaggttgacgaggtggttgtaaatatctttcatacaaatcacttattaacttcccttttccttgaaaagaaatccagcaaagtaaatgmttagagtgttggtttgattcacaccactccttacgaaccatgtgaatctgtgaaactcagtgtcttcctctaatgctacaggtcagcaaataacagccacaggccaaatctacattttaaatatacttttaaatgtagttacatattttaatgttggggaaaaagtaataaggatattttatcacatgtgaacattatgtgaaattcaagtttcagtgcccataataaagttttattggcacacagccacgttcatttgtttacatattgtctagggctgtttttatgctacaacagcagagttgagtagctgtgatgggctacaaggcccacaaagtctaacatgtttactctctggcccttttcagaaaaaatttgcaaagccaacagtgggagggatactcactcaggaagcagttgagaggttcaaagcagacagtatgattcaaatgcaatgtgaaaagaacaacacagtggcatccgggtgttcttctgcaactttgcagttgttttaagctttcgatgtaatagtgatgttaaggcagttattatactcaaacagcaaaaggaggctcctgcacactgtttttcagtgttcccagactactgcagcatggattctcatcttagtacagtaaagaagggcctaagccttcccctttcccagctacaagggcagcaaatgctaggactgaggattgggttccctaggggccagtgccagctctgccacttaagggcagataacttcagaagatagaactgttgtccccgaggcattcttcattttgttaggtacatcgcctcattctagaaactcagtcttttttttttttttaaggtggttttgctatgttgtccaggttagcttcaaaatcctgagctcaagtgatcctcctgcctcagcctcctgagtagttgggactataggcatatgacatgatacccagctagaaactcagtcttttatcttttactcattttcccgaggccagttgttcattgccaactcatgcacactgaattctactccaccccctgttttggtccctgtgaaagagcatgggctttggggtcagtcacacctaagttccagtcccaatcctgccatgtatttatcatgtgaatgaatataacttgcctttgtgctagttttcttttttataaaatgtggatgatgttctcgtgaggattaaattaggtgggtatgagagttcctgacacatagaagtctcctggtgaatgataattgaattggaaccccatttgacctatgctgcagttgcagggggttggagggtgttggttattgaacaagacaaaacccacctctgtttcctgccagagagctgggaggagggagaaagaaagaaatggaggcaggagtcagatcaacacagtggagacccacgtgtcatatcagctttatcattggtaaaatctaggtcagcaaacaaagctttggtttgcaggcgggtggccttgttgatactctgctcttgaattagacacactcaggcattagtgccactgcgcagccgcagcccctggagcacagacagcagggacaggcccctttgcaacataggagagagaggaacagagcggaacctctgctgtctctaagtaggtaaaagagaggagagaaaggtgtggtgactatatgcacacsccatgctttctgcgagggggccagagggaggaggctctgggaggaggcaaggtgtcatttggggaagttggttcccacagaaacatgaggattagggaataagcattccccccggtagcccaggttctgtccaggtggagaaagaccacccttattgtctctcatcaagttctccctcccaaaggtggtagactgcttaaagcctttcttttttactcttctgccctcccagtgcaatgtgctagccttggcctgctcctaggaacattttatgtggagtatgatcatggaattgaaagaatatgtgtagaaatactgccttcagacctatgaggctttgttagtttgacataattaggaagctgtaattttttccagaatgtagagctcagactttattgacccatttaatttttttttaataatgacattttactagagcagaacagcrtgtaacctagatagcctgtggctagatctctgaatgattttaattaaaaataatgtctccacttctggtagatggactttttccacaatatcctggcaacaaaacaatctgggagaaaaaacttccttggtttctgttgttcttactaatagaataaccatactgtcaattttcaatttagaaggttaatgtatatatataatgtttcctaaaggaacattaccttttaattaaataatcagttttatcaaattaacctttagaccttttcaatttcactgagctgagtttccattaaatcaaaatatagagtaggaggatgttaatcgaatgttcttggaactagtcatttctaggtctgttctgtctgcagggtacatattcactgagttggtacctttctgactcatttgtccctgaccccgttagcctctatttccgatgagaaggttcctagtagggatgaacctaaggctttggcccctctgcttgccactctggctcctccccagaggggagccattcatctggtgttggaggtgggctggggttggggagaggggatcgagcttgctggcttagcgcctttgtgtcactgttgggtcttccctcggacagagtccattctctcatggttgccatcccaagcctaagtaactaatagaacaagatcctaaggagcattggaataaggaactaattccatgtcactcttcaagttccactgagagaggatcatctattccctaggaggctggaggctgtgggatttctttttccaactcttccttagaaaatatggaagtggggtaggggccgtgggataggggtgactccaagggaggagaggatgcttatctggtgattgggagtgagaaggacttcgtgctcatcttacccctttcttttttagaagggcctgtcctcaggatggatgtattccctgtttgtttgtgccttaagtttcctagagaaggctttgggagggggatgcctacctgtcttggggtggggggaaaaatcggtttaggaggaacttactagggagcacagtcgtagctgtgtatcaagcatattctccaactcaggctcattcattggttcagttcattcaaaagtatttattactgatttattaattgatcagcctattaaaaatgctaggcattgctcttgatgatggggatacagcagtgaacaaacagaagtccttgcctttgtggaacttacgtttttagaggggagagacaggcaagaaaagaaataattacacaaaatatatggaatgttagagtggggtaagtatctttacggggaaggaagaagggaagtgggatagaaaatgtcagggaggggacagtttataaagaaggattagggaaggcctcattaagagggcaacatggagtaaacacctaaaagaagtaagggatgcattgatgcagctatctggggaaagaacattccagaaggaggagacaaccaacacatgtaaaggtcctgaggtgggagtgtgcctggaatgtttagggaacaccctccaccctctgattcagtcattttgtagtgtgagacccttcagtagctgcgccaytgttctcaaaagcagagcctacattctttataagcctggcttatgctgtagccctgactccacgctccttctccctctccctctccccatctggcttacgtcagttgggtctattccggaggattttctaccacacacccttcatatgtgttctactatctatctagatggttctctcaccttttcacctggcctgttcctcctcacccttcwagtctcagcttaaatgtcacctgatcagggaggccttttcttctcttcccatcccactcagactatattatgttytcatttgctgctgccctttcctttgctgtctttttttagccataccatgtctgaatatgggaggatgacagacacagaacgagaccagatagaccaggatgcccagatattcatgaggacctgttcagaagcaattcagcaactacgaacagaaggtaaagtgctctgaaagatgcaaacaagcaaccatgaatatagcaagtagttaaacaagatgcatatggtgcggccagttaaaattccctcttcttatttcgatttaggttttaaaacgttaaaatcttttctttcttgatcaatgttttaaccaaagctgttaaaagtactgmaaaggctgtatcattcaagttaaaccaatgagaggagggagatggaaaggacctctccaaacagaaccaaaaatatatctaggggccaggggcagtgaagacaaatttgtgtgtgtgtgtgtgtgtgtgtgtgtgcgtgtgtgtgtgttctgtgtggcaaattgtatgtgtgtgggtgtgtatgtgtgtatgyacatgtgtgcctctgttctgtgtggcatttagtgggatgggagttgacagcagcctggggtacttaagctctacttgtaatattcaagtaaactttcctatcaaaccttcaaggttaggaggaaggctctggagccagggctgcttaggttgcaccccaactccacccgtccgagccatatagccctctgcaaatcacttaatctccctgggccttgttttttgtctatgaaatgcagacaattagggaatgtatctctagggttgttatgagcattaagttaaattcctacagcatgcttagaactgtgtctggcacaagagcgcttattatctcactttcgttgatgtttaattctcactgagacaatgagatggcttcccaagtcacgcctctttcttgattcttttttaatttgcttaggcatttacagagtacattaaatagtaagtagagttcaaagctgccagatgctgttgtgctcacaacacagacttttgttggggaggtttttattagaatgctgayggaccacttggagactctgatggaagcaataggcattcttgccagaaaaatgtacatacacaaaattctatatgcaatttcacagagctcctgagtcccccacacaaatcttgggttaagcagccctatagtaaggcagaaatcatgccctctacccttaagggcatatacattcattgagagacctaaaaaatgcacaggaatatttaacaaaacctacatttacatatgaaaccatctaaccttgggctatttattgcctctgaaccttagtttcttcacgtgtaaaaatcaggaaactcggaattgctattgtaattactagcagtacatatgtaaagtgctagcagagtacctgcacgcagtaggcactcagtctctcagtcagtggtcactatcttaccaaaaccagtggcacagactttaggtctggtaaggccttttagcacacttctgtgtggtagttcccaggagaaaggcatctttgtggctaggagtcataggtttcctggagacagaaagtttgactcattgtctaagggacccttagaatgtgagtggccaaggggagaggatggggcactacaggctgaaaagcagcacaggttcaagcagggaggagtgtgtgatttcagttgtttaaacatgttcgctgaaggtcagcttgagcattggatgctgttaacacagatggggtcagcactcaagaagtggctgcgtcaaatactatccttaagtgttctgataaaccataaattatttgactatagattttctacaggtttaatctttcactcttgcgaagcctgatacatcttactgttttaaaaatgtagtgtcacttggcacaagacttgttttatagctgtgttttaaaaaatactctcaataaagaaagtgtygtgaggaagctgatgaattgctctttaggataattgagtgcgaaggcctgaacattgtctttttctgttacagctcacaaggagatacattcccagcaagtgaaggagcacaggaccgctgttttggatttcattgaagattacttgaaaagtatttcattttcttttaaaggtcaaatgtaacatttcacaatagatgtgatgcagaatttagctttgctagctgaagactgtagtatctcattayatttaatgrtggctttgcctgagaagctgttttaagcagtctctcttctggtattttcttctgcaacaggagtatgtaaactttactcagaacagagagccatccgagttaaaagagtggtggataagaaaagattgtaagtattgctttcattggtgtttcttaattaataatagtactactaataatakcagttaaagtttgtagagcacttaccctatgcaatgtaccgtgtttgaacttcttcgcaaaatgccatagctggcgctaccgggcactcactgtgtgccaggcagcatgccagccactttattggcccacaacaaacccccatgaggcaggtactgtttcctccctcattttacaaatgaggaagttgaggctcaggaggcttggccactcaccctagatcccacagtcccacaggtagcatagctggggtttgagcctaggctgttggtccaaaatctgtgctcttgcccattttgtctcttaacccgatgaggctggcacatcttgagccattttacctcaatctctttgacccccataccccttcttgtcgtccctgaaagtgtattcctgagagaagagcgagggcacaacaagcaggccaccacaaggctgtcctcaggtcacctgtgacagacttgctcgatgccacatgctctgagtgcacacctccctccaaccccactacctgtcccatgcaggcactattaggagccctgtcagcaggtaaggacgctgacgctccagcagggtaaatgactcatccaaggccacaggaagcaggagggccaggctcctgtatttcccatggcgcctgcctggtttcccctctgggctcacatgagcatctggaatgcaagagctgtgtcctcacagtcgttcccgctgcaactcagccagtcttggagatggaatacatcagtgagcaagtatccaaacctggaccatttctagactagctttagaaaggttttaggatgttctttcagaagataacatcacataactgtttggggacacattttcttttttgtttttttttgttttttttgtttttgagacagggtctcaccctgtctcccaggatggagtgcagtggcacgacctcctgggctcaaacaatcctcccactttagccttccgagtagctgggattacaggcatgtgctaccatgtctgcctattttttaattttattttataagggtgggatgtcactatgttgcccaggctgctgtcaaactcctgggctcaggcaatccccctgcctcccaaagtgctggactacaggcgtgagccaccatgtctggcccacattttttaaattcttactgtgtcaggggtccccagcactactctctggttctaggattcactaagaggtctcatgggactcaacatacagtcctgctcctggctatgatttgtcacactgaaaggatacgaagcaaaacagcaaaggaaaaggcatgtgggacaaaagtccagaggaaaccaggcatgagcttctaagagtactctcccagtggagtcacacagcatgtgacctatgacaacacgtgaagtgttgtctaccagggaagctcattagtaactcattgcccaaggattctgttaggggctggtcacataggcacctcacacctggcatctaccgaaactctagactcccaggaggaaagcaggtgctcagcactgaactgcattcaaaccgcatgttttgcaaaacagttcaggcacggcgagctgtttttatcaattaggatggcatgaactctgccaaagtccaacttctcagatgccaggcaagggttaaccttgcaagcaggcctttctaaggatagcagcctcaggcctactacatgaacccttttctgcacatttgtgaaacagatgtgaaattgttaatgccaacaaatagaagcatttgtggaagatagtaagcagatcagtcaagttatctgtcagcaacagctactattatataatgcactgagagggtagcttgagagaagccatagattaagtctttgtgcttagagagcttagaagcaggctgggttgctattaaacatgaaaaattagtcagcttaatcaggatatgtcataattagtgaaatcggtagtaagctcagagggggaaatggtacgatcaagtggcatagtataatgcctaagagccagactctgcaaccagacagcctgtgtttgaatcctggctctgccactttcaaactgtgtgactttgagcaggttgcttaacttttctgggcttttgtttccttacctataaaatgggaaaactcatagtacctaacttgtagtgctgttgtgagaacaaaatgaagatacagataaaacacttacagtgagttaataaatgttaatttgtactattatctaccactaagcatttaccatgtgccaggcagtatattattttatttcattaatcctcaaaaagccaccatatctttaaatattagtatttcattttctaaattaggatattggggctcagcaaatttgggttagctgtccagcatcacagctgaatcaagatttgaatctcagggtaattggagcagatttctcaagcaatggggtttgtgttggctgtcaaaagaaaaatatctgggtgtgtgaattagagagatagaaagcagtccagacttggggaagagtttgaactgaagatctgggacacgatgagaccagttagctccaagacattacggagaaggaggtaggcctctgatgatgcgtgatttgtcatcaagatggtgtggtggtcactgggtctcacactcaccagggagaggaatgcggatttctccttcactatcccaagtggacttcacaggtacccaagtaaagtaagaagagatttttgctgctaccttagttcttgtttctcagcagaggccttgactaaaatacaaattaatatcagtcagatgggaattgttctcatttagacagcgaagtatagccttgtctcctgccacatagttagctgccctgtgccaattactttgcacaaaagaccttgagggaaataatgatgtgacccttcacaatgtagttcagcaccctccttcttgtcctttcctcatctttaggcagaaggcatctgcctaaaacgtacatgtgattttatcactcccttgcttccatgtcttacaaaggctagacagcatggcatgtgcctggacaacagccacagtaactcaccacagtagtgtgacaactcctgagcttgtctatactctgtccagcgaaatgagaccactgattaaatggcagtgtcatttatgctatgtttctagatgcttactcttcatttttgtacttatcttgtagcagaccagtaacaaacagtccatggtctggttctgttccatggaccacacttggagtagcactgggttagaaagtcacctagtatgtagtgtatgcccagtaaatatctgttcagtgagtgagtagtggtgaaggtggcttcattgaggtagtgtgaagcatctcctgctttgggggtccacggtacctgtgcctgagtggacacatttgtctgaaagctagttttaaaattatagtactatgatattatatatcaaaaatatcttctttctacccagagcctttgctggaggcataaaagaaggacaggcgtacctcggagatatcacaggtgtggttccagacagcaacaaagtgaatatcacaataaagcaagtcacaaagacattttggtttcccagtgcatataaaagctatgtttatactataaagtgtgcaataacattatgtctaaaaaaaatcatgtgcataccttaatcagaacatactttattgctgaaagtgctaatgtttgtctgagccttaggtgagttgtaatctttttgttggtagagggccttgcctcagtgttgatggctactgactgattgagggtgggggttgctgaaggttggggtggttgtggcagtttttaaaataagacaacaatgaagtttgctgcatcaactgagtcttcctttcacaaaagrtttctctattgtgtgcagtgctgtttgatagcattttacccatagcagaacttctttcaaaatttgagtcagtcctctcaaaccctgttgctgctttgtcaaccaagtttatgcaatattctaagcccttccttgttatttcaacaatgttcacagtctcttcaccaagagcagattccatctcaagaaaccgctttcttggttcatccataataagcagcttctatccattcaagtgtgatcgtgagattgcagcagctcagccgcatcttcagtctccacttccaatcttagttctctggctgtttccaccacatctccagtgacttcctccactgaagtcttgaacccctcaaagttattcaggaaggttggaatccacttcttccaaactcctgttaaagttgatattttgacctcctcccatgaatcacgaatgttcttaatggcgtctaagatggtgaaaccttttcagaaggttttcaatttactttacccagatctgccagaggaatcactatctatagcagctatagcctatgaaatgtgaggttttttggtttgttttgagttggggtctcactctgccacccgggctggagtgcagtggcagtcatggcttactgcagccttgaactcctgggctcaagcagtcctcccaccttagcctctcgagtagctgggactacaggcatgtgccaccatgcscaagatttttggaatggtaaatgagcatcggcttcagcttaaaatcatctgctgcattagcccttaacaagaaagtcaccctatcctttgaagcattgaagtcagccattgacttctcctctgtagctatggaagtcctaaatggcatctacctccaattccaatagaaggctgttttatgtaaattgaaaatctgttgtttagtatagccactttgatcaattatctgagttagatcttctggataacttattgcggcttctgtgtcagcacttgctaattcaccttgtacttttacattatggaatcgacttctttttttaaatgtcatgaaccaacctctgctgccttccaacttttcttttgcagcttcctcacctttcttagccttcacagaatcgaagagagttagggccttgcgctgaattaggctttggcttaagggaatgttgtgactgatttgatctctccagaccactcacactttctcccatcggcaataaggctgttttgctttcttatcatttggatattcactggagtagcactttaatttcctttagtaacttttcctttgcattcacaacttggctaactcttcggcacaagaggtctaacttttagcctgtctcagcttttgacctgccttctaactaagattcataatttctagcttttgacttcaagtgagtgatacgcaactcttctttcacttgaacacttagaggccgctgctgggttattcattggcctgtgttatgtctctaggaataggacggcccgaggagagggagagagaggagaaaatgggaacaactgggccggggagcagtcagagcacacacaacacttatgaagtacgctgtcttatgtgaacgtgctttgtggcactccaaaacagttacaaaagtcacatcagagattactgatcacagatcagaaatataataataatgaaaaagtttgaagtattttgagaattaccaaaatgtgacagagacacaaagtgagaacatgctgttggaaacatggcatcaatagatttactccatgcagtgttgccacataccctccatttgtaaaaacaaacaaaaaatgcaatatctgcagagtgcaataaagcaaggcatactgaaacaaggtacggctgtataagagccacgctgaaatctgaaacaattacttttgtctaataattatagcaggctgtatttaaggtttgcaaaaacttcccacatattttcttgtttcaaaactgaaaaaatctgtctctcttctgtctctttatgttctctttaaattttaaataaaatcctgagggttttcaagcaagggacctggaagcagatgctggccaggtagaaactgttgattgcatttctgaaatgttcagccttcagtcagagaaatcagtttaaataaatcatggggcataaactgatctttctgatggctttttaaaaattgctttctttcccccaaattggcttcaactagttaatttgtaatttccctggggactttagtagacattctgtatatagttagaatctgtttttatcacttaagaaaagaaaggcactcaactttgtctaagtctgctgcactgtagtctttaattccttttaaattggaaacttgtacattagcatcctctggacacaaaggatgacagacattaaaggagtcctttattttaaaagtcagtgaagccctttgacttcctgaagaagtcagtcctgaagccatgcagtgaggcaggggtaaggtgggcgtctgcagtcgtggggagcagcagttttccagggcagggaggagagggtggcttagcatgggcagtcatagcctaagccaggagagggactgatccgtgctggagagggatggagaggggtggtagaggcgggtggttacatttaggagaatagatcaaataataaatacagaaggaggctggatgtagtggctcacgcctgtaatcctagcactttaggaggccaaggtgggtggattgcttgaggccgggagttcgggaccagcctgggcaatatggcaaaaccccgtctctactaaaacaaaaattagcatgacctatagtcctagccatgtgggaggctgaggcaccagaatcacttgactcgggaggtgcaggttgcagtgagctgatattgagccactgcactccagcctgagcaacagagcgagacactgtctctaaataaataaaggaggatattgaaagctaggtttctcactataggagaagtgaaaggggaaaagccctgtctgtggtcttgggtggaaatgaaagattggcacgaattcacggttttcaatttccaaagatcaatacagaagtaactatggttgtaaatgtgtacgtrtgtacacatttatacgcgtgtatgaaaatgcatgcatatattttcttgctctggccactgaggaggcctggaaacagtgacactgtaatagcaataagcgtagttagcactcagatcttgtcttctaaataccaacttcaccttcagggagccaggcctcttagggaaatggctgattcttaaactggagcagggaacatataaacctggaacaaggaagggctcagaatgttaggacgtgtctaaaggacacagccatcaatttgaagcggtgtctactggccaaattagagataacttaagcataaaaataaatggcagtagcacattataacacattcaatgagataggacattatgaatccatctaaataggaataaataaatgaataaattgaaagattgaaattgatacatagtgtcaaagcactgctccccctggtacttactaattacaaaggggaagagaataacttgacagtggggaagcctagcagtcaccaccttcatcaagtgggcaaagggaaatcacacacaacctaataggatgcagcaagaagaaagcatcacttttgtgatttctgccaaagaagcatgacttgaatccaaccgcgaggaaacatcaaactcaaattcagagatctcttacagaataagtgacacattattgtgtgttgaggccgtgaaactcaaggagagactgaagagctgttccaaacaaggagactgaagagaagtactagttaggagcagtgtgtgatgctgttgttataaaggatattactgagataactggtcaaaatagagtggggtgggggggtgccgtgcacagtggctcacacctataatcccagcactttgggaggccgaggtgggagggaggattgcttgaggccaggagtttaagaccaacccgggcaatatagtgagatcccatctctacaaaaaatttaaaaattagctgggtgtggtgacatgcacctgtagtcccagcttctcaggaggcagaggtgggaggatcgcttaagcccaggagttcaaggctgcagtgagctatgatcacaacactacactctagcctggacaacagagtgagaccttatctcaaaaaaaaaaaaaaaaaaaaaagaatggggtccaagggagaaatggaagtaatgtaataatatttttcataactttttttttggtctactacttttttagtgtttgcaacaactctagtagtagatattgttggaaggatattggaagccaggtttctcactcagaaaaatgaaagggataaagccagaatgaaccctgtggtgttgggttggaatgaaagatactgaaagccattttacagttaagaaaaccaaggcctagaggttaggtggtaaaccaggggagcacctactgtgtgccaggcttcatgccaggcactttctcatgggtgatctcatttaatctttgaaagaactctttgagaaagatagtattttctccatgttgcagatgaagaaaacttagacaaagaggataaaattggctgggcgcggtggctcatgcctgtaatcccagcactttgggaggccgaggcaggtggatcacttgagatcaggagtttgagaccagcctggtcaacatggcaaaaccccacctccactaaaaatacaaaaattagctgggtgtagtggtgcactcctgtaattccagctactcgggaggctgaggcacaagaatcgtttgagcctggaaggtagaggttgtggtgagttgagatcgtgccactgcactccaacctgggtgatggagtgagactctgtcaaaaaaaaaaagcataaaataaaacccatccaaggccacactaaaaataagtggcattctagaatttaagccctttgttggctccaaatcccattgtaaatgtgtctttttcaaggcagtcagtaaaccagtggtttaaggagtctcatctccagactgccatgggatttacagaattgctggagtaacctgacagccaagacagcgtgggagggcatcaggtcagtctgstgtgcagtgtggccaaggagaaagccccctaccactcgagtagcctttggccaccaccctaggccactgccctgctactctgtcaaggctccttcagtccttcccccttcacagtgacattcagaagatcagcagctagttgggccagcactgaagaccctgctaagtcccttgtacagattgtacaagtgtactcttttctctgaattatttgcattatttatgggttagttcagcagttttcttctgttcctccatcggtctgcatcttgtcagaggaaaaaaatgtatattgctttaagacttcacaaaaaaaattgtcttattaaccattctgccttttgttatttcacagtaataatagcagcagcagcagtagtgtaatcgttgtagtaatagctaattttttgagctcttactatgtgatgtagactgtgctgagttagcacttacatataaagcagtaactctaacaagaaagatagtcagagccccatttttttttttttttttttttttttttgtgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttttagtagagacggggtttcaccgtgttagccaggatggtctcgatctcctgacctcgtgatccgcccgcctcggcctcgcaaagtgctgggattacaggcgtgagccaccgcgcccggcccagagccccattttataggtgggaaaacaggctaagaaattttgctatttgtcatttagtaactggaaaaaaaaatctgaaaattctggcagatgagtatcttgtcaagctagtttgaaaatttgctaatgtgtcaggttgctcaattcctacatcccaaaactaatatttgaggtaaaatattaagtcatagatgctaaatttaataatcatatgtgtatacctagtgtcaaacatggagcagatcctcagtttatctttaaataggtttctcttttaggtttttaactggcttttcctttgcttaacacatttatttttgagacttacccttgctatgttcttcttcattgctgaatggtattgcattgcatgaaagtaaccccactggcttatccatcctgttggtggacatttaggtgttcccatttttttggctatgatggataaggctgctgtaaacattcttttataggcctttgtgtggatctatcttttcatttcttttgggtaaacaactaaaagtgggttgtcatagtagagatgtttcttagacttagtaagaaactgtcttaagttttccagagtgataacaccatttgacacactgtccagcaatgtatgaaagttacagttcctccacatggcaggatttggcattggccattttttctagccattctactggatgtggagtggtatttcattgtgggtttagtttgcatttcctcactgactaatattgttaatcaccttttcatgtgttgattgactattcattttcttcctgtgaagtatctgttcaagtcttttactcatttctgtattagaggattgtttggctgttgatttgtataggagttctttgtatattctgcatacatatccttatatacatgctgcaaatattttttcctattctgtggtttatttattttcttaatggtgtctcttggtgagcagaaatgcttaattttgaggaagttgaattttattaatttttactttgtctacccyaaggtcactaagatattattttatgttttcttctagaagctttatgattctgggtggtatgtttaggtctatcatctgtctcagaccaactttttgataggatgaaatggggttgaggtttattttattctatataataactggggttgaggtttattttattgtatataaatatctatttattatatcaatgtttgtttaaaacactttctttttctcattgaattgacctggcatcgtcatcaaaagtcagttgacccaaacatgtatatgtctgtttctggactctattcagtatcattggtctgattgtccttatgctactgccacactgtcttgattactgtggttttatcataagtcttggaatcagctagttgtaaatccttcaaatttctaaattttcagtattgtttttgctattttagattttttgtatatttccatatcaattttagaatcagcttttcggtttcttcagaaaatctgctagaatgtttatagggattatgttgaatttatagatcaatttggggagaatggacatcttaacatctatccacaaacatagtatatctttgcatttatttctgtcttccactttatttttaaatttctttttctcagcaatattttgttattttcagtgtagacatcttgctcatcttttgttagatttattcctggattttttttttattctattgtaaacgataccattttgttaatgttattttccagtttctcgttgctagtatatagaaatacaattaatttttgtatattgacctgtctacaactttgattaattcacatgtagttctagtagctttttttgtaaattcttttctttttttttgttttttgtttttgttgttgttgttgagacgtagtttcgttcttgttgcccaggctagagtgcagtcgctcgatcttggctcactgcaacctccgcctcccgagttcaagcaattctcctgcctcagcctcctgagtagctgggattacaggcgcccaccaccatgcccggctratttttgtattttagtagagataaggtttcacctcgttggccaggctgttcttgaactcctgacctcacctcaggtgatccacctgcctcrgcctcctaaagtgctgggattacaggcatgagccactgcacgtgacytttttattgtaaattctatcaattttctacatacataatcataccatatgtgaataacagtagttttgctttttaatctttatgccttttatttcttgttcctttcttgttttattgcactggctagggcctggacctctggtaccatgttgaatagaagtggttaggatggacatcttttccttgctcttgattaagggacaaggatttaatacttcaccattaagtatgaagtgttgggattataggcatgagccactgcacccagcgcacccatgtttgtttrtttgtttgttagtttgttttcatatttgtggttcatttttttatgtgtatatcacagaagtaggtattatgtagctgttctttatcaggttaaggamatttcctttcttattgagggatttgctagaagaactsayggaactcagaaacactattatactcatagttacagtatattatagtgaaagaatacagattaaaatcaccaaagctaaaaggcacatagggcaaactccaggagagatcaggtacaagcttctagctgtcctctcccagtggaatagtgtagacagcacttaattctyccaatatgtgtctcccaatacctgtgtcaccatgtattgtcaatcagggaagctcacctgagccttggtgttcagggttttcattgggggtcagtgatgtagatgtgaagtgctagcatagcaggccgtagttaactcagtctccagcccctccagaggtcaaactgatggtcatgccagacccctgttaacttcagtagggatggcacttggttcaaagaggctgaagaagagaccccgagccaacaaacaaaacagagtttatttgggggaacttatttatagagcagtccagtggcagtgggctggacaggagaaccactactgcttgtaaaaagaatgtagtttgtatacaccttcacttagccaccctcccgccaarcaacctccacatggcagccctcattacttaaattgccatcaagtgtgtctgccatgcactgatacagtggcccaaggcccccagtcataaatcactctgttagcataaactatctggaatgcccccaggtatacaaagatactctcatcagacaagasgtactaggagcttagaggttatctcccaggagccaagcaagggccagttttttccttggaatgtgcagaatttgaacaccacaaacctgctgagtcatccctttactgcataccttattttcctagtttgctgaaagtttttatcatcagaggatcttgactttttcaaatgctttttctacatctaatgcaatgatcatataggcttttttctttttttgttaagggggtgtattacattgatcgattttcaaatgttaaaccaactttgtattcctgggttaaacctcatttggtcatgatacattattgtctttacatattgctaaaatcagtttgtttgtattaaggatgcttttatgttcatgaagatatgtgtctaattttctcttcttgtaataycttcataggtttctgaatctgggtaatactggcctcataaaatgattttgtaattgttttctcttcctctgttgttcagatctactgggtccttacgttgttcctcatcctagggaaaacacttaggctttcatcataaagtatgatgctaactgtagattttgtacgtgtttatcagattaaggaatatcccttctatacatgcttttccccatcttgtttgattgctctagagcagtgtataaaggtatacattctattttacagctccatagtactgcagagtgtcttccaccagttccatgttgatggacatgtggattttttcctaggcctttgccatattaaaattgaattacgaaattgctataatyaataactttttcatattattgttatatctttgggatagagtcccataagtgggattgctggattagagattaaatacatgttaatttgcaggatattaccaaggtcccctccataggagtcacactgtttggtactctcaccatcaatatacggaagtgcctacttcacagcctgacctacccagtatgtcttcacatttgggtattttcaccagtcccagtaggcaagaaataatgacgcagtgtagttgttaatatgcatcatcttcttatgaggaagattgagcatttttcatgtgtttaaaagccatttgcatttgtgtgaactttcttgcctagtttactgtagggctgttggtctttttctctgtctgctttacctatggtggggcttttttttttttttttttaataaacttgttattttaagagcagttttaygttcatagcaaaattgagcagaaagtaccaagagttcccatatacctctttcactgtcctccccacccgccaatacactaatagccttcaccaccaatagccatcaacatgccccaccactcatggtgctttgtttcgtttgttttgttttgttttgatacggactctcgttctttcgcccaggctggagtgcagtgggtgatctcggctcactgcaaacctccacctcccaggcgtaagcaattctcccacctcagcctcctgagtagctgggactacaggtgcgtgccaccacrcccggctaatttttgtatttttagtagagacaggctttcaccatgttggccaggctgggcttagacctcaagtgattcgccctcctcggcctcccaaagtgctgggattacaggagtgagccaccgcacccagttcacccatgttttttttttcatatgtgtggttcatttttttatgtgtatatctctgatgcatttggaatttaccttggtgtacagtgtagggagagggaaaacatttattctttcatataactaccgattatcccagtgcaacttattaaaccatatcatatattaaatacatatatgcagttgagtctggttttgaattttatatcctattcattggtctgtcaatcttttcatgctctaataccacacttggttttttagggttatcttggctattattgcctccccttcctaatctccatgatattttcactataaaccttttcaaacatatggcagaattgaattttacagtgaacacccatatacctataccctagattcgagcatttacattttaccatacttgcttcttttacctgcctatcattccatatgcatttagtctctttttaaaatagatttcagagtaaactgcaaacagtgcccttccccttcaatactttagtatgcatatcattaactagagttcaatatttatttacagtttttctgaccattctttgcttatttnnnnnnnnnnnnnnnnnnnnnnnnnnnnnnnnnnnttttttacgtatgggctttgggcttaagtttattctaaagtttttgttgatattgttagttttttatcttttgttttgttttggctattgcaagtagaatcttctctttcattatatcttccaactgtaaatgaggtacattatcatgaacatttaagtcattttgttgttgttataagcagttttgtggtgaatatccttataactttacctttgtgcatatttgtgatacttagaatagcagattatattttccaaagaaagctgcccccaaatagatcccataccacatgctcttcttaaaaagtgatgttactgctccattgagaaagcaaattggagtctgtgtttcttccccttgaactccagtggaccatcgtgaatgtgttgggcagtagaatatggccagaattatgatttctgacttctaaggctaggtcatgaaaggcactgaagcttccaccaaagtctttaagactgccagccctgcaggcagccagctgccatgcaccagtaacacactcatgcagctccatgaagaagaaatgaggctcccagcaagcaccaacttgctagccatgtgtgtggcctccttggaagtgaaccctccagccctggtcagcccttcagatgactgcagccctagttgccttctaactgcaccctcctgagacacacagagccagaaccacccagccaaggtgttcccaaattcctgaccccagaagcagtgatcagtaataaatctcactgtttcaaggcactaagttttatgactcagctgtagtaaccagaacaattaaaaagattgataacagtgacttttgaaaaaattttttgttaaattttgtagaggaccatttcctaaatagtctttttgagaaaactgctctcaaaaaactctgtgaagagagtgtctgcaatcaggttatttgcaaataccatcctttttggaaattcaaaatgtatttgagcatattaaaggctctgaaaacttatatagtgaaacacctttctagctttgactcagctttctcagactgattcgaccacagaagtcctttcccacagcccaggatgggtagaatataccccacatggagcagttgttacgagcatgggcttcagagctaggttccctgaggtcatgtcccagcccagccatttgctgactgtgacctgggcaagtttcctaacttctctacacctcagtttcctcctttgttaaaaggttgttaatactagtacctacctgatggggatattcgaaattaaataaatttatccatacaaattgcttagaaaaaatgtccactatatgagccattaacaaatgttagctggcattagtaatatcaccctaatatgcatttacattgttcctttaattacagtctctctgcctaacaatatggaatttatcctagatagcactctgcctataattttatagcatttatgtagattctagtaaagctattacaaagcctgttattgcataacctaaacgttttcttattaaccagttacttgtatttataatgcactcattcattcaacatatatttatgcaatggaataccaggcactaatccagaatctgggatctaggagcaaggctgacaaccaacagataaataaacagggggattatagactgtgataactgctatggagaaaacagatgcagaggagtgggaggcggcctttccttcacagaagagtcagaggtggcctctctgagtaggtgaaattgagctgagccctgtagatgggaaggaagacgatgccctgggaagagcccgtggggaagaaacaggggaatgccaagtgcagaggactcagtcctgaaacaagtctgtgccttcaagtgggtatttaaggacttgtgctttcagagctaacttatattaagatgtgacttagaacatatacgtgtgtgggtataggtatatatatgtgtgtgtatgagtatatatgttggggggtatgtgtgtgggggtgtgtgtgtgtatatatatgggtagggggtatatatgtgtgtgtttctgtgtgtgtatgtgggagtatatgtgtatgtatatgtgggggtatatatgagtgtgtgtgtgtatgtatatatgtgtatgtagatatatgtgtgtgggggagggtatatgtggggggtatatatacatatctgcacatatatggtgtgtgtgtgtatgtcttgggggtatatatgtgwgtgggggtatatatatgtagtatatgtattatatgaatatatgtataatatgtattatatattattattaataacatactcagcaatctttttgcattagtgtcaactactgggtaagcatcaatccagcttcctgggtttgttgagtgcrgtgtgtcagtctatggagtgtattcagcacataccgactgcagcctccccctgcatgctggtcactgtgccgtggctgcaaatgcagagggcatgcacartctctaccctgcaggcaataatgccagtgttaagtgccccagtggaggtgtgtccggatggccactgggcccagaggcagtgactgctccccagtacagggacacagagcaaaagcgcagggtcacatgtgactccttctgttttcaaaaaggaatcctgttatggaaataaaatacctgcctgctaattatttatttttagatctaagctggaaccagaaccaaatacaaagacaagagaatccacatcttctgmgaaagtttcacagagtccttcaaaagactctgaagaaaaccctgccactgaagaacgtccaggtacgaattgagatgaaaatctcaccttgcatttcttccttgtgacatgttggcaagagtacagcacaggaacgaagtagcacagtctcagacatgttttggtgtttgtatttgcataaagcaaaggaagcaggaggcggcagcctttgtgtctgtcacagttgatcttcgtgagtgccacagaggcagggggtgcattcacccagtcacctgggagctggcggggtccgggagaaagggcctgctggaggggtgaggccgggagctgtctgcctcaggagccctgtgtgccggcctcaggagaggcagcattgcctccctggcagccatgccctgcatgtcagctctgagctgccaggcctgcatccgggtagagtgtataacctcagcagccttgcacagccagtcaaaccaacaggacaaaatgcaaatctgaattgacgtgctgcctatcaccacagatactagagggcccatggcttagaatagttcctgatgcacaggagatgcagaagaaatacagggtctccatgaagtccgaaaatgtagggggacatacacagtgtggtcatggatgtctgcgatctgtgtgtctggctggtacccctgcgtagggatgcctgcatagtttgccatatctcaaaggcagagtggagcagggttctttgtgtgaatcacagggtgatggcrtgctggagccaggagagacctgggagtcccctttagcatccttctccgtagtctcatggcagttcttattaactcttgtcttccagatgctaggcatggtcctggacatgtcacagaaattacaggttgagtatctcttatctgaaatgcttgggaccagaagtgttttggatttagggttttttcaaatttttgcatatttgcattgtccttaccagttgagcatctctaatctgaaaactaaaatctggaaagctccaatgagtatttcctttgggtgtcacattggagctcaataagtttcagggatgtgattcctgccctcagggagctcacagttgatgggaaagataaggctctagcccctgggagaaagtaagtagtacctcaagagagagcagagggccagggagacttcaagaggaggtggcactaagaagtgagtctgggccaggcgcagtggttcacacctgtaatcccagcactttgggagkccaaggcgggttggatcacctgaggtcaggacatcaagaccagcctaacatggaaaaaccccatctctactaaaaatacaaaattagccaggtgtggtggcacacgcctgtaatcccagctactggggaggctgaggcaggagaatcacttgaacctgggaggcggaagttgcagtgagccaagatcgtgccattgcactccagcctgggcaacaagagcgaaattccgtctcaaaaaaaaaaaaaaaaaaaaaaaaaagtgagtctggacctgaaaaaataaaaaatgaaagcttagaaagttctagacagaggcagcagcatgagcaaatgctcagaggccagaaagcctggagattgggtgggatatagtcagtaaagaagacccgtggggatcagtgaagcccatcagtgggaggagaggtgggagtaagcttggaagggtgggtagggccttgaatgccagagtagggagtctggacttgcctctgtggcaccagggtgcacgggtggcctgggcagaggmctggcatggtgggtgctgtgcttcaggctgatccttagggcagcctatcaagaaggcttctgatggccacaaatgagcatgttgtagagtgtgagttctgctaagaaaactttcccattctagctcagagttaatttatgcttggttcagatatgaacaaggtttctgtttctaattttgatgtttttttccttaaaaaagaaatcaacaacagtaaaagcttgaaatggataccataatgaggacaagtaggagacagctcataaggtgggggtggggggtagatgaaagtacaaatgttcctacccaaagaatgtcatctcaggaaaatatcagatcatttctaaagatacttttagccaaccttttacaaacacatgtttttctataatgacacttctggtaaaaacagccatttttctaaaagcctgcatgcactaagttgtggatgacatgcagttttttttgtaaagatatatttctaataaataaccataactttcaggcatggcctgcctagtgagctttctctacattgttgctatcattacgttctcttcccctatttaaagatctggacttgttgccatctcatggggctgagactgactacaggaaatttactgagattgaggaaaaaaggaaaaagaagcagtatttgcctttgagtacttggaagctcactgataagccctgagacacagacacaaagtgacttcattacagtctcccccgaggatccatccctgccatccctctcccctccgctcccaaccctaccccggtgatgaactgcacagacctcttaccrtcatcctgggcggcagcagtcctttctaggggcctgtggtattgacatgcttcaatggaggatgcatcacctttccttgatcataatgaaaaagttctccagattaaaatgttcctacgctccctttcagcagttgcatgcccaggtatctgtcctagagagtcactccagcatgtgcacatagcacagaccgggacacagtaccatgacaccagtgaacagtctgaaaccactgaggtctgtcagcgtagttatggctaaagaccagtgtatcctcacgatggaatatcatgcagcaatttaaaagaacaaggtagatctacttggaccatctccaagatgtatcaataaatcatacaaagcaagttttagaacagcatgttactattgatatctgtgtgaaaagcaagccgccatacacacaaaactgtgtattacttgaatttcatgggtagacagggactcatatatctttgtatgtgaatatctttagataaaatctatgaagctacatcaaagcagtaacwtctgggagaggaataggattggagaacagtatatcacttcctgtatatatatatatatgtatgtatatatgcatatgtattttttacaataaaaatatgtcttacagtctttaaaagtagacaggggtgtatgtgtcttgaagtaaaacatactttaagactcattctgaagaattctgaagacattctgaataatgtccatttagtttgcagccattgctgacatcagtgcgatactgaaaccgtgcataggtccccctccccatcacacacacacatgcacgtgcctgcacaaagacaatttaaagcctaaatgttgtgaaagaatcatgtctgcagtgcctgaatattagcccaaagatcatgaaatatatagacaaagctgtaagattctgtttaatctcttgtttgtgttatgactacatcctaagccagcctattctaaaacacatatttggtcttctattttcaattttttttttaacagaaaaaattttggctgaaacacaacctgaattgggaacgtggggagatggcaaaggcgaagatgagttawccccagaagaaatacaaatggtaatgctattctctgcctaattatttatttttaactggttttcataagactgtttcactraggagaaactcatcctcaatgcccttgcccttatttttatactgagttttaaaaattataaatgtgtattttatatacactttcccatttgatttcctaattcttacggtgcttttcatatgctttaaatttgcagtagcataattaaagaagacattttgccttggaagaattttactaataatagatgtcttttcaacaacagtaaaatagtcttctagactaaatgggtcttttataaatgccactatgatgctttttaattgtttgaattgctagtgctatggtaatgtgaaaaaagtaagataatgactgaaaagtgaaaagagtaacaccttaactactgatagcacctccttttagttacctgccttctggtttccagctgctmtagcttaccatctatgggtgggtttcaaaaggaactgataggtctgccaagcccctgccagctcacgtccagcaatgtctgtgtgcagctcatctggacactggtgtgacagaagccagatggaatatgctatctgtgtgtgggaatagatgtcacctagagctgctaggatgtgacactgtcctctaagacgtggggaatgtgactaccacacggcaygcctccagtgactgtgcctggcaagtgatagcattttaagtgtgcagcagtttgcagtagacaaaactttttgattctcattttwtccatgatacttttaataattgcacaaagaggtggtggaacattagcatctcattttaacattggcaaaaggcagcaaagggtcttgcccagagtcccctagttaatcagggaagagctggatttccagccctcaagaagataaggagtggagcatgaagacagctctgttgaggaagaatgggatccagtctttccccagccttgagcttctcagactgaggcgtttgtgttgctgcttaagccacctgaaatttcaagctctctctatccactcctggcatgtcttacaggtctcaggtattttttcctcagacagacccggcaaccccacctacagcagctcccagatactgtgtcccatgaccctacttgatttcccgcatagagcacaagctctgtgagagcagaatcttgtcttgttttcctcacccagagcccagaacagtgtttgggaattctttttttttttttttttttaatttattttttttattgatcattcttgggtgtttctcgcagaggggtatttggcagggtcataggacaatagtggagggaaggtcagcagataaacaagtgaacagaggtctctggttttcctaggcagaggaccctgcggccttccgcaggggaattctttgttgaatgcatgagtgactttgatgagtataacataaaagctataggttgttttcaatggtaaaatgggatcatcagtaataactattagaatgttctagtgttcagttattactagtattatggatacttatgaatgccttctctatcccaagccttttacatatgttgtcctgttgaatcttcatgacaatccagtcaagtaggaattatcactattacacagttgaagaaaatgacgcacaaaaactaaagccctacccaacgtcacagaaccagtagagcagcagagccaacctttggctccaacctgtgctttttttccagttggttctggtggtctaggcaagtgttgctgcacaggagcagcgtggcacactgacacaggccagccaggcagagaagtcagaacagccgcgccggcccaccgaagtgtcattgtaagcatagttgtgcaggctggggacctccagggatggccaggtccacatgtctgctctcgtgagcattggccgccaagggcagaggactggctcagcatcctcttgctctttggacttcctgtttcttctccatgcctgaaataaaagacggaaaccaaatctctttcctaaaaatggcatggacaagtgaagacaaaaaagccaaaaggtagcacagcctagtgggaacagtgtactgtctgactggagtccacacgcagcctcatcattgcagccctgggccctctcactgctctggacctctgttccctcatctgtgagatgggcaaaaaatggccaccccacaggtggggctaaagtttgagtgagctggcccatgaggtgcatgcaacaaagagccagacacatggggtgcttgaaaaattctgtttccccttcctttacccttgagagtggcaggttgtacaaagaggcagaagagcctctccctgcacaggatggaagagattgggcatagctgcccgtgtgccatgagcagggaaggactgtggcatgcatgccatcatggcagggtcagggcatgcaggatggcagctggagctcagaccattttcatatgcctttcatatacaattcagtttcacacagatttatccacccagatgagtggtttcccctttaaaatcatcgccttgaaagcttsaaactgattccagtgatggtaccattagccctgactttcctgagacttgctttgggggttctccttcagagcctgtgatattttctttggaatactaagcagagctgtctttgtcctttacagacaaaaataattctgaactaagaaaatgactcaaacaccttaaagtgccctgcaaggtccttgccttcctttccagcttctttcatgttccagaattcaccttatgacttgaaataagtgctcaccaaatccagcaaatgtgggacctaggccctcgaggtgcacattgtatagtcrgtggttagaggaagacagccgcagggattccaagcagtcattgctgtcagtcaggttgagagatgaggagggccttgagccgggagtggcagtgaaggtagtgttgagagctgtggtgtaggaaatggcctgcactgaagtgtgagatgaggaaggaaccttgagctttctgacgtgggtcatcaggaggagggagggtgcacagaaggtgggcaggctggggctgagcaggagatgatgaatttcatgtagacaggtgtgagtttgaggcgcctgtgggacattcatgagaggtgtctatgggctccagggctcgggctagagaaacgcatgtgggagacatcttacagctgatgtttgaaggatgggcttgcgtgaggctctctagaaacatgatgaacagcgagaaaggagaaggggtcatggacaccaccctggggtacactccactggagggaggctggggcggagaagccaacaaaggaatgtaaagagggattggatcatattcccgtcctacagccaaataatggcagaagtttcttaaaaatctcttaggttttcaccggtttatatgaaatccttgtattagtggaaatgagtcgtttccccaaatattataccattgccccatttctttgctagacaaaaaatgtgtacagctctgtctcttcattaagaaagaatacgtttgtatttaagaagagtttaccttctgtgttgggctttttttttctttctttcttttttaatgcactccaccactcttcataaaggaaatagctagaataacaatagtgtgggttgtttgtctgaggatttttgcctttctctggcaggcaatggtgagctaagcatgttaacctttacagctgcgtgacttagcagcctgtaggtgtgagagttggaccagaggaaggctagcagtgaggatattcgtaatcacctgatgctctcatcctgtggagggatgatgaaagaacataggctttgggactagacagagttggctatgaatttataccacttactatctttgtaagctgaggcaagaaatcactgccatcagtgatctcttcagaatcaataccccacagaattgtctcaagcgctggatgcagtagcacctgtaagagcacccagcagagggcagggcagagcaaatggtgactccctcccaccagaaggatactgccatgtctgtgcattgtggcatgscctgcacgtgttttagcaactgatatgtcagagtacggctcctctccccacattgaggttgatgcagcatgcttctgtttcattccactgtcccgagtcattgtctaaagacaccagcggccactcccagtaacactggtagctctagcatggtagtatcaatgactaaagcaatcagaatcagcaggacttcctaatttttattgtgttactgcaagaggatcgggcagaaggctgtaatgttcagtacttttatgacaggctatttaatgtccagttaacttctttcttaattgggaataatagctaagtaccatatcttatagtctgactaactcaaatcttatttaaaaggcttaactttgaaaataaagagaaagaaatacaacactgttggttttaaattggaaaatattgtagcaaatcgtggtcataattcataatcactgtttcggaatttttcctcagggtaaaataatgaattaagcccaataatagcaatataattcattgtttcacccaaaggaacagttattacatatttcaaaatggttgcagggtattatatgatttgcacaataaatttccctatataactcatgatacaggtatattaatgcctttgagtttgcaggtgtttgtggtcaggctgagtggaaccaaattgttttccaaagttacatcaagaaaatttctccctttctaaacacacattcactttacttgcctcaggtaaaaccacctgcatttattgatgtactccttgggataatttttttaaaacatgaatgtggcttctgtttcttaaatccacatgaaaggcgtcttccaaggccctgtcccctgaggtaggcctgtagaaactcccagtggctggctggcagggctcgccagttttcagctcatgcatctagaacaaggattggtggaatctgaataccacatagtgagagctggacagaccctggggaggttccaggtttacaggggcacagcaaatgctggcttccaccagaaggatacggcagagtccgtctactgtcacattatggggatcataggggatcgaggtgagggtcacacagccagaagtgtgaaggggtttggtacagagaaagcacgtctggaagagtccagaaagggctgggcaggggactcctgagctatgagggccagagggctttctgggatggtccccctgtgctcctcagcttttcttggctctttgtgacacaaatacttctcttggcgtcattttatactgaaaggcctttgtaggagtgattttcttttgaaaattatagtaaagaggattagattagaaaaggatttctataacaatatattcacaatgtggatttgtatcctttaaaccagattagaaaccttttagcagggcttgattggaaagtctaactgacttctaaatgggataaagcagttgaataatgatattgtctaatgygcatgtgacacataccatgtgccaagtactgctctgagcccttcagcatatgttcatttatgcaacccatatggagagagtattgctggccccgttttacagagagcttaagtcaccagccctaggtcacataggtcccaagtcctaggcygttcaacatgatgctgtgctgccatggttggagggtgggggagagtgctggtctagctgaaggaaagcattgtgttttggtaggagaccgtaacagcgtagagcagatgggccaatgcagggagcccagagcagcggctggcaaccaccatgcatggagggcccaacctgcccaccrtacccaccatctaggcctctcaccttcctttgcaattccataggaaaataagaatttccttgattgtgttcaggtttgtcttcacaaagcatctagatacccatctgtcgtgctgaccttggagaccaggtctttcattcagcaccgcaccttgcaaagtgtggccacaaagagacagatactagctagtgaggctcagcgagctctggaagaagatgctatgggtgcatttcccagtgcctgggagagtgaaatggctgagagccacagcaggcctctaggactttgagactagagggtagaaggggtcccacagcatctgaccgctcattttgcatatccagaaactgacacccaagagattaaatcatgatagacagccttcaccgagagcttactatatgccatgcactttggtagacaactcacatgtattcactcatgtattccttctaacaaccccactacttaagtactgttactatccccattttagtgrcaaagacagagacgcccagagattgtgacctccaaaacagcttactgcttagaaggtgaggggctggaagtccagccgtgactttgcatcctcagggtcaggcagaaaaggataagaatcaccacatctgtccccaaagaaactgacaggcccaccagaagccagtgactggcccagcattgccccagggttcctataaggcccccagaactggctcccatatccacgtggtacatccaccactatgcctgccacctggcaacagacgaagggaggcacacaggtttgccatttagacagcgttggaagccatactgaaacctggtacaagtcagtgttgtcagcagccttgccatgatctaattgtcctgggccctgccagcctccttaagtaatagtgaccttgtagttgtctgggaaataggccttttgttttttaaacacagaggcggctctccattaaaactcctggccgttggcaaacctctctcctcagcccttagcacctttgatccttgaggcacctgcttctcttcctctagggactaggtatttttcaggtggggtggaaggaaattagagccagcatctgatcccactcctgagtgcagtggagggcggacatggagctatcagaagttaacaattacgaagaggcctaagaggaggtgccgcacctaagtgccttataccacaggccctcaaattggggaggaaacaagaaaagctttgttcccaaggaacagtccaggaatgaatcaccccaaaccactagttaattttgtttaggaacagtttcaaagcataaaagggactgtggatttaaaaggtcagggccagggccatattttgtcattagaaaaattcaagaaaatgccgccacccagggaaagctgagtagtacctgaattagccaaagtgaattggcgcctgcatgttttagtaattacatgttttccttaaatactgtcctcttaagtaactgttgaagttaacagagcggatactttcaaactcaaaagtgaaagttttactctcttaaatagcctttgtcttgcctaattaaaggggccataagcaattctgtgtcagcagccagcacggccccctgctgtggatgagttggtcctgcagggagctttcctggcacttccgcccttcccagagctttgccccttccccgttttctggcccggtgggtctggagtgcagcagatgcctccttgtgttttgagtagccggggccgagaactggtgttctgtcatgtgtgaggccctgggctgggctcagtgtccaaaggaggacagctgccttccacagagagaagacaagccccctgaacaagtgtgagaaatgtccttgaagagccaagtacaggggaacttggtaacaagagtgagaaagtaagagaaggtgattcagtctgccctgaggtatcagatcgctaggaagatgcctggggttttgagggaccacgtggagttctgcagccaggcaggaaactagcctgtcagagcagagctgagatgggagatgtcacgtggccagggcatggataacagtgtgccctagacctgatctgtagggtcagcgggcaaggccaccatgaggcattctggcatgaccagcacttgagatcactttgaccaaggattggataacaggttggaggcaagtgagaaacggtgagggtggaatgtggacggtaggggaagggctgaatacagcaagtgcatgtgcgggggcgaaactggtggacttaggaaggggcgtgtgtgtgaagagcgcctgcatagagcacagctggggtacttggaggggaggggtcctgggtgggaaggaggctgctggggagaccctgcaactcatttccgccctaggacaatggcaacaaggtcaggctgttgaatgaagtgccagcatagcccgtggtggtcagctgcctcccataaccattgtttcccttgtatttttggtttactaagcaagtgataagccagatcttccatcgattcggagcctccagaggcttgcttgtatgtatccctcccactcctgcttacagaatgcctcagaaaatatttgtggatttgatggcagctttaatctataagaaagaaagaacaactggaatgcctttgcaaagttatgttccacccagttcccgccctcaggaagctcagggtgacacgggaagtttgggatgggcacagtttattacaaggcagaaagggaccgttgggcgctactatcctaagatattttcagaaaatggtaggccaaggataggaatatgagaaataagtttgagcttaggggccagggtaggtgtcctggagaagtggggcctgcgggatgcatcggggaggaaatgcaggacgcccctgactccctgcacattgcgggagttgagtggacacacgaggacagggctgtgggggcctgcagtgagggcaaggagctgttcctgtccattctctgtgctgagtttcaggagcttccatccttttctttggcccatatcaaactggcaagaatggctgggagagcaactgtctgtgccaagctcactcagctccaagaagctcccatgtatccctggtgtcagggcacccgtcctcacccagcctgagcactgggaaacacgctcctctggctctgggcctctgtccctgttgagcagtggagtggccaggctctgaagtcagaggggcccagaggcagctcggccaagctgcccacctccccttcctctccagaccctccccacaccagatccttctccatattaaaaaatatrtatagtccttcagtatagttcatgagagaaaacaacaacaaaagaattttcttaataatggtactagagtcaggaagcaggccgtgggatcccaggggagagcgggtaggtagatacagctacagccatagcagtcagcttgtacccctggagtgcagtggttgagatggagaagtcaattaccaggcagcacagctgttttttaaaactttctcctgaaagcagggacgttgttcacactaatgctaacggtcgtccagcaccggctgccacgttgccgcagctggaaatgggggcttcggcagtgattcctggagcgtaggtccgctttcttgctagactcttgcctaagttcagtatgatgtcatcctgagtgtgtctgtttcctcacagtttgaacaggaaaatcagcgactaattggtgaaatgaacagcttgtttgatgaagtgaggtatgtttgtagctcctctgtgagctgatagcctgctttacaacttttccaggaactaggaactttatttaccttggtgcccaggcatccccatggggcccttgggctggtgcagcccccctcagccattttgactgggctggggtgggcatgtggcctgaatccacaactccctcagcttgtgggcctgtgggttacctcctgcctgctgccactgctgcggggggcccaggtgcttcccaccccgagagatacaggagtgactacagattacctgcgtataatttccaccaccattcgggctgtttccacgcagcgactctgaaatgaaatggggcccttatgaagggcagctaaccaagggaagccctcttctgcaaatggttccactggggtctgcctgctcctgtacccaccagggagtcaggaatgcagaaggcaaggccttggtcactcacacatgcacccrttagcctctagtttctgtgggaaggcttggagcatgctgaaagtaaggcccaggactttgcagagcctgttgtattgtggacatgtcccccaaataaaatcaatcctgatgctgcactcacacagcctgaggactttctcagtgtaggtgtcagcctccaaggggctcttcgccttctgccctcagagatggacctcctagtcctcctctgacagcctagctttcactgtctgccccactaccgcccccaccccgctactcccccatgcccagatactcactggcttttcttcccacatctcctcccctgccccctgccactgtgatactgttgggattcatcactgcttccacctggccaggagctcagctcccaccactttttgcctcctgtcacttcctgtcgctgctttgtgctggaacagcagttgacttcagcttgggccagcttctgtttctaaatagatgtgcccccacccgccccccagggtagcccatgctgcccctgacaccaggaagatggctagcccaagtgtttcagatccgacagaacactccgttgccaaaccaagacatggcattttctaaatgaatcagaggagcttttttcttggaacagggagttggtttgaaggtaaatacacttttttctttaacctgctgagcattaacaaagctggatcatcagcatattctgaccttctgaatccccaccatgtgttaccatggtgatgaggctaggcagagaacttactggagactgctttctgtaactggggcayaaccaggccctccccattcyccgagcagtgacacagaatgcaaagggcactgcacacacccacctcttgggactgagggtcagttggcatggtagagtggacttccaaaaagaccagtgtgctaggctatgccagaagacagggaaggtgacccagtaaggagagttcgccttcctctcccatctcctcttcccccagccgacacagtgtgccccctctgtctctcccaccttcacgtagaagataggatttctttagaagtgtgtaacagtcctgttagattaccaagtgctaatagttaatatgtaatctgttctttttatgaaggcaaatcgaagggagagtggttgagatttccagactccaagagatattcacggaaaaggttttgcaacaggtaaaaaaacaaaaacaaaggagctgtaygttttcactcaaaggggaatgtacttgagagcacgagacatttttcccaaaggctgctgctctacacagccaggagcagagccatgtgttgctagcaggtgtgtgtgcgcagagctcctcagggaaaagctctcactacccagagctgcctctgcacacgtgtgatggaggaggagctccccacaggggacccactgaccaccccatgtggtagcacatgcggtggcacgtgggaggagagtccaggcctggcagtcagggttctggatgtgctgggtaagctaggtagcccccacaagctacagtttcccatctataggagggagggactcctgcagggttattctctgtttgagagataactgcagaagcatccagcacgatgctgacgggcagttgcttttcagtcagtaggttacaggagctcagacccaggcctctcacaacgcgcrgtccatgccacctcagggatggtgtctgcgtgggaaataggattgttcttttcaagtgaattttctgaaattcttccagccaataactggcaaaacttttcaagacctgataaatttgcccttttatttttagcatccaaagactatgggaacgtttgaaagacaaaattttctccagtattttaaactggactacttgacttaagatacttcactcacaaaatgactttccataaaccacacagccagagtgaaatcattgtaaatgaggtacattaagtctaacagtggtttgcaagttcgggttcataggagtcgccctttttaataacactaccctgcttcaaacctcccagcggctccagggggcctgggaggggcgtgcagagcataggcagagccttgccttggctcaccgggagtttctttttcttttctttttttttctttttcttttttttttttttggagacagagtcttgctgtgtcgcccaggctggagtgcaatgttgctatcttggctcactgcaacctcatcctcccaggttcaagcgattctcctgcctcagtcagcctcttgagtagctgggattacaggcatgccaccacgcctggctaattttggtatttttagtaaagacggggtttcaccatcttggccaggctggtcccgaactcctgacttcaggtgatccacctgccttggcctcccaaagtgctgggattacagacgagagccactgcgcccggcccactgggagttcctaagtcctgaggaacaatgtgtctttcttgttttttccatcagtgttgcattgtagttcatattgattctctcattggaaccttggcagtggtcacttagttcacactttgagactctctaaaaaggggtgatgatgaggcaaagccatcccagtaatattcattgctgggaatcagaggccacatgctgccttcctccctacaatgtgtcagtcaggtttctctaaaaacccacrctagcattcattctgccctgaccctgttaggaagcagcttcaccaccaccgaaaggaggagagaagcaggcactcctgcttgtaaggacgtctagcaccgtctctgctcctgtggggccagacgccccctgtgttatcccacgcttctcaagcttttcaaggcttygtttggagtaaacgttttctgtaagcatcctgcatcctattttgatttttaaattttagcctgttttttaagagatatgatgatagtaaaacacaaagcactatttttgaagctagcatatgtatttcgaagcacatacattttaaagcttacttctgtggacttcagaaagaaatgagagactagaagggaagcccctggcatatggtggctgctccacaaacaatagctcttaggtttttgtccgtcaccggcgagtggcgcaggagggatggtaagtgtggcggaaggagcactgcaacaagatggggtctcagccctgcgcggtggctcatgcctgtaatcccagcactctgggaggccgaggcgggagcatggtgtgagctcaagagttcragaccagcctgggcaacatagggagaccccccatctctacaaaaaattttaaaaatttagccaggcgtggtggcacatgcctatactcccagctacttgggaggctgaagtgggaggatcgtttaagccctgtctcaaaaaaaaaaaagtctcagtcctgccacttggttgctgtgtgatgtgactttgggcaagttagtaaacttctctgagccgtgagtttccgtttcataaaatagaggtaatacctacttcttggggtgctgtgaggatttgtggctatgcaagtaaagccgttagcccttggtgacggctmctgttcttgtcatgatatacgcttcagggaggaggaagtggctgtatatgtcaagcatccctaaacttcaaaatgtgaagtcctaagtgctccaaaatctgaaactttctgagcgctgacatgacactcaaaggaaatgctcgttggagcattttgggtttcaggtttttggataaaggatactcaacttgtatttatcttttcttccacaggaagctgagattgacagcattcaccagttagttgtgggggcaactgaaaatatcaaggaaggcaacgaagacataagagaggtaggcactgtttaggttccccaggtgcgacgkggcgcagcactgagtcccagcagcgggtgttagtctcgccggcacagctgcccaggagccttgctgggcagagctcacggggctgatcacaaaattgtgtgaccgcggagctgcgtgtgttcatgagacccaccacctgtcgcccacctccagctgctttcgagaggcagtggctcaccagcctccaaaggagcaatccagggtgggtgggggtactcctggcagggtcaggccagctcttcatgtccagggatgtacatgggtagctcgttggcccccaccgaggggtcagagcctggcccctgcttacagaggacactacagccatcctgttgaggggactgtttcccaagctcagtcctcagggttgggtcaccacggacatcatgttactgggaaacacaaagcttgcggtcacactctgctcggggcccttaaccctgggacagaagggagtgattccgagagttgtgttgagggagaattgtgcaggacccaaatgatggccaaacagagggaaatataacccatttgtcttctggtggatctcaaaagccatctattcaaggtaagcacagatrgaacgacacccatagttacagccaggatcaggagagcacgtgggaagaggggggcatttcagggctgctcaaaccaaaatcctgtgtgataaaaacacctgtgctcccgtccctgcccaggccattaaaaacaacgctggcttccgcgtgtggatcctcttcttcctcgtgatgtgctccttctccttgctcttcctcgactggtacgacagctagccagggccacgggggcccagcacgagagtcctcatgggcactcacagactgcgtgctttcatgtacttccagtgctggagcatggtatgaccagattttatcacagtgccatttgaagggaaaggagttcagacagacagaygtattccccaaaaagggataccccaggccgatggtgttcagccatttagcagctgaaaaaggaaacagtgcacaccaatgggaggcagcctgcgtagccctcatcaggcaagacagactgaatgcaggagtgggtgattagctgctccttgaacttgaggctgccttggcagcaggggcacagcaggcckcaagagcccctaattgtctcagggttcaaaggaagacactgacctttcccatcccggtagcttcagggaagatcatagttaataacgtctctcaacaaatgattacttctttgtttccttgtggcttcttgtctgtctgagtcaacgaatacacagacttactggattatagaagagaaaattcacatctgccttgttaatctaataaatataattacagccccttaatgtgttgtcaatgagtctaagttgacaaattcagtggcagcccagccacctcctatcaatcaatcagggaagaaatgcaggggagactggggccctcagtgaggggctgcctggcattattactcctccaaagactgctgcccccagarcaggcagggggtgtgggagggccagtttcccgccactgggtccaaggagcctttgttcaaaggaagaagtgggccacggaagaacgggcctgcttctctcgtgcctgtgcttctgacctccaggaactgtaaacaggaacacctatgtgtaactgaaggcatgagacatctgtacaggaagcatcccagcgcccacatgggcatgagacagtctgcactgcgcctggtgaaatgcgtgtgtgtacagacagtccactgggcagcacaggtatcctcatgttctttatttgcacagagtgaaatgtcagaagttacatgtaaatgaattcacagtcaatwaagtccacgtctacctggaaatacaggctcggcctctgcactgtgcgcacacgggcttcacttgtgtctattcagatgcgcagggaagctttggcactgatttattgctcttgagtcattttccacagcttaacaccacccttctcagcacacgcctctgatgcacaccgctgcgccaaggtcacggtctgtgtctccagacacccttgatgagaaaatacattttctgtcttagaagcacatttcaggaaacaagagtggcgctgaccacggtcaccatgcctgttcacaacacatctcacactatttgtcgtttatttctgatctaaaaaactgaaacttttgacacgtacaccagaaacaacacattcaataacatagaagaaatgtctgcgaatgtcttttctatttgttttacacacttagttcatctaactggcagttttgtaaacataaactttaatatcaagattcaaactggaacaattttcttacaaagattgtgagttgaaatttgtcattttgtttgcacggtgccacaccagtcccccacccccaccccacagcctttcctgcctgtttcccacatcaagggatatcagtttcatagaataaaaattaaagtagctcaagcttaccagaaattacatttccacttttcccacccagctcatttctttaaaaactaatggggctattggtgcaaatttattcataatagaagtgaaccagagggccagtgggggctctttcctatcagcacatcacagagcagacagactacctgcagggagagttctgcacctcacgggcccagggccgtctcttcccagccctctccctcacatgctctgccagtctacacacactggagcaaaccccagctgtctccacccagatgggtggtgcccctccctccttaccaagatgccagagtcagaggggagggagtagtcaatccacaccgagcctgccacattgcagggccgtcccaccccgactcaggagtcagcacagggaggggtgggggggtctttttcctcgttctctatgccacttacttactacagtgcaccttggcagcagtcagcactgttacccgctgatggccgaggaagaaatgcgaagtaggcttgctcttagcacagcgagagatcactctagatatggctatggaggaaggtttgcagacagcagggtcggttcagaaaatcaattccacaaaatgcatttatctgagatccaaacccttcrcatatccagtgtaaatttatttttttacagcatccaataaatcccagtaaaggagctaaatgaagatcttaacatgaaaagtggtgtcagagctctttaggcaatgctgaaatgcacttgattttatgcccgtgggtggtcggcagcaagttttatttgcaaagcagcattagcaaacagaagcaattgcaccgtaaatgagtaacctctaaagtatcagtaattatatttaatgaaatgtccctcaaagtccctttgttatttgcaagtgacacattgtaaggaacttgcccatcccgctaagctgacttctcagccgcttcagtctcctgctcggacagcttctcttctgacagaactgacatccagggcgatacggagcgcgtgatgctctgcttggccaggttgtagtggtttatgactgtgtaaaatttctcccgggcactggagtcttgctccgcgtagtagctctccaagccttctgggatgcactgggtgttctgaaagacaagaggccactgagagcacgcgtcggtgcaagagggggtgccagtgtgtctccagttggcagccaacagttactgagcaccttccctgagcttggaggaatagatacagtgatgagcaaaaacgggcatggatcttgccctgagagagcacagcacaggggaagcctggccttgattattcttaatagactggctggtgagtgccatggcagatgggcacttgggctccaagggtgccagtgtaatgggacagcaggccttacttcactgaagatcttgcactagttgtcatttttaatcaattggaaaacaacaacttatgaaatatcccaaaacaaccaattcaaatgaggacggaagggaagtgagaagagcttcccttgagctaggttctcagcagaccttagctaggtgagatgagggaggggcagcactcaaggcaaaggaaaccagagcagagaggggccttggggcgggagtcagaagaggcacacagagccactaggtggtcatgactaggggctgggaagatggcgagggggtagggaggggccgtgggttgggggagtgcgagacagcacttgggtcttacagaggtttatcaggaagcggattctggcagcaaatccacacccccattccctgcaggccaggccctgtggttcaggcagggccgggggcgttttccctgttttggcagctgtggctgcagcctgtccttgaggtgagtggctcacctccacgggcttaaggcaggtgtacagggatcagctcctgatgccacccagcccccatggggaatccattctctgttaccagctcattgaaccctgaagtctaaagatgagaatactttatacctgcaaggcccttgtgaacaaagagctattttcaaaagagaaatgacaaatggaatgtgcttctcaccaacactgccccgcatccagtgttcaggggctgccactggcaggagggcggcgctacaggagaagggaagctttggagccaggcccaccgtaccagctgagttcacgtgcggagtgttttctctctcaatctcaggtccctcacctataaaatgcggccaatgagtcacaccaccgtgttgctgaggactcaagtcaatgcacagtggctcaagtaaagaagccaggatgtgccccaggtcacagtgtggacagaaaagaaagccaaaagacaccactgaagtacagcccttttatcaacagcgtcttgatctcagtcccaccaggacgtcgggaagcacctgacacgctacagaacaaacagcccattcagaccagcagcgcgtgcatcaggaaggaggctctgcaggccagacaaactcccctccagcctcaccgccacgccccttcacgctgtcctctccatctgctgctcgtcatccctcagggaaacggaccaagggttcccctcttccctcccacctcggcacccagcagagtcctgcaagacctgatgcggccaacacctgtggagtggcggccccgctcagggctggcatacgagatggctcagaaacggccctgccctacaggtgccccgcccagggagaaggacagatggagtccccagatgcctcccagacaacgtggctgcccaaaggcaaggctggggaggcaccttggtgcccatggtggcgagcaccccagggggtgaagggcttcccaacggaagcagaatgcagaggccttgccgtgagcccacatgggccagggaaggctttctgagaggctcctgccgccccccatacccatctcatacagagccaccctcacctgtggggtgtgtgccttgaggggagcgtgactcagctgggcctgcacttggaggagcttggggaggttccccaacttctctgggcctcattccctcacctgtgaagtgaagctgatgacggacctgtcttgtggggcacgggaggactgaggtagctacgtaagtgtgttcccagcacccagcactcagtcagcactggaaaagagtagccactaaggtccgggtgcgatggctcatgcctataatcccagcactttgggaggctgagggtggatcacttgagcaaacccaagagttcgagaccagcctgggcaacatagcaagaacgtgtaacctgtctacatgaaaaaaaagaatggccaatataaagggaaaagccagtataaaaatgtgggatttggggcactttccccattatgtttaaaacttttttataaaacatgtagtaatttcatgttgttgttgtttttttttaaaggcagaggtagaaacctagtgtcctctcgggccacgtctgcctttttcaccctcctcacgatatgcctcagcttggggccactgggagtggctgtccagaaaaagcctgtcccctccccactgcctggggctctgaggtccctgccctcaaggtgtcgagtccagtgtgcacatagtaggaggtacttagtacatgctgactgtaccaagtgaactgaagggcgtgaccttgggctccacgaagagcctctgtacaccctctaaccactggtaaaatggggatataacagcatccacctcaaagggcttctggatgcattctgtgagcaacaggtgtaaaagtcccacacaagctgcctagcgttggtgtgtgacaaacacacgcacaaatatggagggaagaggtcaaggggacttcatgagctcatgcctctcctttctccagcttcggccaagggcagctggatacagaccagcagctccctggccttcctaggtgccttctccggaaaggacaccccctcattagatgctagtggaaaatgccaaagtcccacaggacatcactccagaacaacttatcaggggactctcaattcccaaggctggctgtggatgggaatcacctggagcgccttttaaacaaaaggtgccaggccccttccattgtggccgccagtctcatctgcagccggacacaggactggggcttcatctcctgggtcatctcccacccaggccaggtatccagcgggacttgggcttgcaggatagggaaggcagttttagccaccccctcctccctgtggggaacctgctccaggcccagagaggatgagccaggaaggaagctccagggcagctggtgaagccactggcctcagttatttgtaagtagccagtttcggtggggacttccggcccccaggaagctgtcctctgctgtcctctctccggctcagggccagctcctgggcctgcccgtgctccctctccatgacatcggcctccctcagtaactagctctgcaccaggccctttccttttacccctctgcctcccagattaaatcagttctccagtctgcagtctcccctccatccccagcgccccagtcttctcttccctcagccactgcagcagtctccttggtcatctcactgccccgtctctcccttccaatctccagcctccccaggtgacccaagaggtcaccctatcacttccccctcctccaggggcctgtgcctggcactcaggatgcacccgctctggccgtaagctggttcatcctctgccgcctccctgtgcctgtggctagccccccaccagcacacccccaccagcacgtccccactgcccgctgctccctctgtgctcctctaccatcacaaaccccttcccactgggtcagggccagcactgccctcgttccctgaagcccgcaccctccgcttctgcttgttgtaaagccctggtgtcctctcagcctccaaaacagactcaaactctcccagccccagcctagggcgtggacggggcttgctgaataaaacatgagtgaaagggtgggggctttccttggctgggcacactcccccaagacccgcaagctccctggctcacctcctggagacccgctcctccaatgtggaccatccttctagaaactaccgcccacatgcccatgcccaacccctgggccctctttcctgtctgtctatagccttcacattcagtgtacgactgacttcctcaccgttcatttgagaatgtaagagcctcgtgaaggcagggggctgtacctgactggctctcggct

SEQ ID NO: 10744 - DNA, 41665 bp, Homo sapiens
aaggtagactgtgttctatgggttgttgttgcctgtgagcatgttcccattatagccctggagccacagctcagccttggtgtctgtacataactgacttcctttctaattaccacaggcagattggctaaagaagaacaactttggaggtgccatggtctgggccattgacctggatgatttcacaggcactttctgcaaccaaggaaaattccctctgatcaccaccctgaaggatgctctgggcctgcagagtacaagtgagttagggagtgagaagggacactaagcctcagacttaagagaaattccaaaggttccttggaagtcatggagctgttgcacaagtaattgtctgacattgtccattcctatctggtaacaattgattaatggtgggaagaacaaacagggctcttcaccatttcttccttccttcattcatttcacaagaaatttattgaacatctattacatatacagtgctctgtaggtaccacaggtgatctaaatgcataaatatccatatctactctatggaaatttacaatctagtgagagaaattggatttacaaaaactgcaaagctagacaacaatacagaagatattatgtgatactgtgccccctaaaagaataagtaaccttcttgtgagttcatgataatgaaaaatttcaatcagtaagatgtaaggaggaaaaaatgcactgtgacttgaaggatgaggaaggagttggtaagcaaaggggtgagtggagcaggaaggatatatcagatcagaagactgaaatatgtggagacatagaaggaggagccaagaacaaaatccaggtactagctctcacacatcaggtatcactggctaaaagcaaggaggttcaggatttgttttcttttttcttctcaggttgcaaagctccagcccaacccattgctcccattgccgaggcaaacatcacatgcggtgtcagccacagtggtagctctgggggccgctctggcaggagctctgggggcagccccagaggtagtggattctgtgctgacagggccagtggcctgtaccctgaccccactgacaagaatgcctcctacagttgtgtgaatggaaagactttcactcagcactgccagcctggtggtgtctttgataccttctgctcctgctgcagctggtgataacatttttcagatatcacctcacccagcctcagaagttgttgtgcaataaaaggttgagcattactgtacaatcgcttctgcttctttactgtaggatcttagatgtaattgatccctatttcccaatgatatacagttgctccaccagcmcccaagcctgcagcatgcactgctagtcctggatgttgggtagcggaagcagggggattaaaggaaaatacatggtcccttcattctcaaaacatgtattcagatgaaggctggggagcccaagaatgtaagactcagataacaatgacccataagcaaatgtcattttaaagtgattgatttgcccttttggctgagaatgcacaattaggaggctattgcagtgattcaggggagaggtgcaggctcagaacaaagtagtagcagtagaagtggtcagaggtgattgaatttcagctgtattcttaagatttgttaagccagcaggtttctttatgggttgcatgtagaacgtgggagacaaaaaggggagccaaggataatttcaacattttggcttaagaaattgcaaatatgaaattatcatcaactgaaatggagaaagctaaaagtagagtagattatgaaggaagagcagaagttcaactttggacatgttgaatttaagattgttattgggtttctaattggagatgtggagtagatagttggacataacatttttagaggtagttggtatttatagttggacataacatttttagaggtagttggtatttaaagtcaatagattagatgagatcattaagggagacagagaaaggaaagcattcaaggactaagccctgagcatttcagcattcagagggaggctggagagaagagtaggaacaagtaatgaagaccaaaaaaggagggctaagtgaggtagaaggaaaaccaagtgtcaagtatcctgaaagccaaggaaagaaccatattaaggaggagaaagtgatcaagtttgtcaaatactacttaggtcaggtcagatgaagtctgagaattgaccattatgtttaacaacctgtagatcattgacaaacttgacagaagtggggttggtaaacatcttggtggcaaatgcctgagtgcagtaagtttcagagagaatggaaaggtaagaattgaagacagtaaggatacaaaaacctgtcttatatgtgttaaagggaagcaaaaaatgggattaagaataaaagattatggaaaacagaagctgaatttatgttttcaaacccacatttacttatttagagatatgggagataaaaatctaacattctttccatacctctcactttcttatttttattattattttcacagagtcaaaaatttttttaacttaaaaattttttttttttgagacaaggtctcattctgttccccacgctgcagtacaaaggcacgaacatggctcagtgcaccctcgacctcctggactcaagcaattctctagcctcagcctcctaaagtgctgggattacaggcatgagccaccacatccagccccaaatttttaatatcactttgttttataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaactttttggacatagatattggctcactcttttactcaaaattttgtaaatattactgctttttattctggcattgaatattgagctagtgtttttcctatggctctttcatttactttttcaggtttggatgttttgtagttgaacagttttttcaagtagttctgtggctgccacaggccttaagttcttttatatgtgagaatatctgcctgtctccttggttcttgaaaagtatacttcaagaatattatacttggtagagtataatacgataggcttgtactttcttttcctcagaactcttcagatgtagacaaaacttcttaacattatttcaaatcatctctgccttaccttttaattccagttgaagctacagccaccaattctgcataagccttaatggtcttcatggcgttatggaatcttacctcagatctgtgttgtgtacttcttgctacccttcctagggcttctgagatacaggtttccactcaagcaggtacaatctagacacgcagaggggttactgtcacttacaaacatcagggaaacgtaatgtttccacctttcctcccctgatgttctagaagcacattttgtaagacttttaacaccgttccaaagggatagagcatttagttgtttctaccagtggctaatatgataaaagcatgattttattggccctcccttcttccctgtttcactcccctgtctcttacttattctttgcattccactcccaaattactctcacatgagctacttccaggtgaacttagccttagatagtaggcattgctccactgtgtcctggcattgaatattgttgtagggatgtttgaagacagtggataatcactaccctttctttaatccacacttttaaagttatttgatttttttcctgtgagtgcctgaagaattcatgatttattcttgaagttcaataacttaacaaggttataccttgattatgatggtttttgtcaatttctcctataaaacagttgagaggtaagatttaacttgcctgagttaacagacctgcaggcggcctcctggaaaagaaagttggcctgttgcctctggaaaccagctataatctatagcctaggtcctaatgcaatccatcctggcagagagctgaccatggtgaatgagaacttcagccaagtttacaccaagcagttgtgcataatcacggggttggattacaccagaagaaagccaagtgttctcccaacagatgaatgctaaggtagtagataagactgaaagccaaggttctgctatatcatactgctattagatcccatatcctaatctcactaaagaagagttttgttaagaagcttaaaagtcccaacatccaaagcccagagcctctttctcagagctagatatgtgctatgttagattgttgtatgctgcctgagaataaaataaacaccagaggatcactcatctgccatcgcttctgtctctgactttttacccagaagtactattccagaaagcccagtgtgcatgctgcttggctactcaccctgaatcacttgacaactggtgtagagagctggatgtcagactaggggcacctaccatggccttctagaagtgaaccaagggacttgggatttaaaaagtgtttctcagatgatcccatcgctttcaaagattggtatggcagtcatggggactagtccactaaattcctgaagatacagagtgataaaagtgatactgcgtagttaagatcatcgagcctagcattccatgattgttattattggccttggaagaattagctctaaggaggcagaccgaggggaacttgactcagcatcttgaatgaaattacaatttgaaaactttggtgaatgtgaaatgatttatatatggtcttatccaagcaggatcaaacaaattccatcctctgaccctcttcctatgactgataggatcagttcaagatggcacaggttgtcatgttattagggtgttatgagctccagttaaatgggtgcaaagggaaggaaagacaaagtatgtgacttatgaggttagttccctcataacaagtgaagaagataatctgaaataggctgattgaactaaccgaacttctgggtagactcccactatagctccgtcttagaaagtctatgtgattactgcttctatataaagggttaaacatgataaaattgatgatggtccctatctttgtctatggaaaaaaatatccagtgagttttgggggaactcatgacccaagtcataataggaatttcaggcttcataaagacatcatggttgaagcagaggtgctctgtttccagcaaagcccaacaggaagctaacttttgctttttgaaaggaggattccccaccagactgggaagcaacagcctaggctccagagtcggacactggacttaagttgttatcagatgaatttgctcagctgcgtactgttgtgttacaaaatcaaatggcattagatacgcttacctcagcccaaggagggttttgcaccttactgcatactgaatgttctgtgtatagccctaacaattctcacaatattactcacaaagccatgttgggtgtggtttttattaattgtgcttttaattctgctgtacttaacctgtatctgtaaactatatcaaatatcccttccccatgtatctgtaagggtattttcctgcaattgagtatcagattgaggccaaatgtggaggaaaagttaaacattaaatttgaactcaactgaacatggacacaaacaatggtcaccaagtcccgcaacaggttgtgtgagtcccttgaggcgttcatccagcactgttttggaaaaatctctatttcaatctagtcctatatgttagttattgaaaaaaatagacagtctcaaaaaacaagctgacctttttatgttccttgaacctagttgtgaagggcccttgttactgggcctcatgccaaacaactcrttacaaaaacagctagagtcccagacggtgccaaagcttcatgaaacctctcctcgtctgtgcacgaacaggtggccaactctggagcccaggctgttgctttccagtctggtggtgaatcctccatagtctggtgagtgtaaatatatatatatcttttcccttctccctttcccattgcaatttgattgttatatcaatttgcttattatatcaagttgyttattatatcgtttgcttattacatctgcattgccatttatgtgagataaaggttgtttacccttaaaggtattgtgtgtgtgtcttttctcctcccctcacacatctctcacacagatcattttatacccaaagggatataaatcattctactataaagacacatgcacaygtatggttattgcagcactatttacaatagcaaagacatggaaccaactcaaatgcccatcaatgatagactggataaagaaaatgtggtacatatacatcacrgaatactatgcagccataaacaggaatgagatcatgtctttgcagggacatggatgaagctggaagctatcatcctcagcaaactaacacagaaacagaaaactaaacactgcatgttctcactcataagatggagttggaacaatgagaacacatggacaccgggaagggaacaagaaacactggagccagctgrggggttgggrgcaagssggggagagcattaggacaaatacctaatgcatgtggggattaaaacctagatgacgggttgataggtgcagcaaaccatcatggcacacgtatacctatgtaacaaacctacacattctgcacttgtatcctggaacttaaagtaaaattttttttaaaaaggggggaaaaatatatagcaaaatgcaactggaatttccaaatgaattagtattttatttaaacatctatattttaaaaataattgtaataatgagaatacatagacacagggaggggagcaacacacactggggcctgtcggggggsggtgggggtagggaaagcatcaggataaagagctaaagcatgtggggcttcatacctaggtgatgggttgataggtgcagcaagccaccatggcacatgtttacctatgtaagaaacctgcacgtcctgcacatgtatcacggaacttaaaataaaatagaattaaattaaatcttaaaaatagtaattgtaataaatttatatttgaaacatgtaaggtatttaattcacacacaatgttttgtgtgcaaactcccctttcccctataattaytcctcagctatccaaggacttgaggtcttcagattgggaaaaataacattaactaaaatttattaaataactaacatgtgctaggcccagtgctaggtaggttatctcatttaattctcacaacaaccctataagacaacaactagtattatccatatgtaatacatgaggaaattgaggttcacaggtgaaataacttgtctaatgtcacatatctagaaagaaggagaacaaaaattgaaatataagtyagcgattctagagaccatgctgatattctgttctgtcatatggcaacctttgtgctggacagrtgtgggagaatgctctctgcaattgactggcattggttattctaacagtcttaccctctttgtatgtgaataaactggcattctcacttacattgactgcatgggccagtctccgttatctttttttccatgttttaaaaatgtttttcttgtggtaaaatagaccaaaacaaattaccaacttaaatattttaagtgtacagttcggtggtactaaatacattcataatgttcttgagccatctctcctttccatctccataattcttttcatcatgtaaaactccagctctatactcattaacctgtaagtccccatttccccctcccccagctccaggaaaccactattctactttctgtctccatgattttgactattctaagtatctcacataaacagaaaaatcatatattatctgtctttttggactggcttttttcattgagwataatgtctcaagattcatccatgttgtagcaagtcagaatttccttttaaaggctgaataatactttattgtatgtatatataacagttttgttatccattcattcactgaaggacacttgagttgcttgcatgttttagctatggtgagtaatgttactgtgaacatggaagtacaaatatttctttgacaccaagctttaagttattttgggtatacctagaagcggaattgctggatcatatggtaattctatgtatgatttttttaggaacttccatactgttttccatagcagctgtaccgttttacattcccaccaacagggcacaactgctccaatttttccacatccttgttaacacttattattttctgttttttgatagtagccatcctagtggatatgaggtgatgtctcattgtagatttgataggcatttccttaatgattaatggcattaagcatctttttatgtgtttattggccatttcaatatcttctttgaagaaatagatattcwagtcctttgtccattttgaatcaagttgtttggttgtgtgtgtgtgtgtcattgaattttagaagttctctctatattctgaatatctcttatcagataaactctttgcaaatattttctaccattccgtgagttgcacttttaytctgtttgcattgtcttttgatatacaaacatttaaaatattcatgaagtccaatttgtgcattgtattcttttgttgtctgtgatttaggtgtcatatccaacaaatcattggaagtccaatgttatgaactgtttgccctatgttttcttctaagaattttatacttttacatcttacatttaggccattgatctattttgagttaattttgcctatgatgttagaaaatggcccaaaaacatcaatggggccagatgtggtggctcatgcttrtaactccagtgctttgagaggccaaggtgggcagatttcttgagctcaggagtttgagaccagcttgggcaacatggcaaaaccctgttcctataaaaaatacaaaaaaattagccaggcatggtggcacatgactgtggtcccagstaatcaggaggctgaggtgggaggattgctcgagcccaggaagtcaaggatgcagtgagctatgatcatgccactgcactcgagcctgggtgacagagtgagaccctgtctcaaaaaacaatgacaacaaagaaaacatcactgggatttcgatagggatwgcattgaatctgtacatcatttgggtagtatagacattttaacaatattgagtcttccaactcatgaacatggggcatgtttccatttattcatattttctttatttgaacagcakgctatagttttcattgtacaagtctttcacttcattaagttaatttctaagtattttattctttttgatgctattgtaaatgaaattatttttataatttttctttttttattctctttgttagtttataaaaatgcaattgatttttgtgttgactttgtaacctgttattttgctgaattcattttttagctctgacaaaatttttggtgtggaatctttagggtttttcctatataagaccacatctgcagggacaattttacyacttccttcccaaattggatgccttttatgtcttatttttgcccaaatgttctggttaagactatgttgaatagaagtggcaaaagaagcattcttatcttgttgctgatcttagaagaaaagctttcagtctttcaccattgagtatgatatttgctgtgggtttttcaaacatagcttttattatattgaggtagtttgcttctatttctagtttgtttttattatgasagggtattaacttttrgcaaatactttttctgcatcaattgagatgattatgccatttttttcttcattcttttaatgtggtgtattacattcattggttttcataagttaaatcatttcttgcattcaatgaataaatccctcgtgaacacagtatataatcccttaacatcctgttaaattcagtttaatagtattttgttgaggatttttgcatcagtgtttataagggattttggtctgtagtttacctgtatgtttatctggctttgatattacagtaatgctggacatatagaatgagtcagaaagtgttttctcctcttcatttttttggaaaagtttgaaaagaattggtgttcatttgtcactaatgtttggtggattaacctctcaagtcatctggtctacagcttttctttgttggaaacttattgcattttatgatttttctgagacaggatctcactctgtcacccaggctggaatgcagtggcacaatcacagctcactgcagcctcaacttcccaggctcaagtgattctcctacctgggcctcccaaagtgctgggattacaggcatgagccatcatgcccagtgtaagatttttggttactaattaaatctccttagtggttataagtctattctaattttctatcttttcatgatttagctttgttaggtttcttgtttctagaaatttgttcatttcatttggattatctaatttattggcatacaattgttcataaaagcctcataatccaaccactgagaattaggcaagatggccaaagaggaacagctcccgtctgcagctcccagtgtgatcaacgcagaagacaggtgatttctgcattttcagctgaggtaccgggttcatctcattgggactggttagaagacaggtgatttctgcattttcagctgaggtaccgggttcatctcattgggactggttggacagtgggtgcagcccacggagggtgagccaaagcagggtggggcatcacctcacccaggaagtgcaaggcactggaggatttccctttcctagccaagggaagccatggcagactgtacctggaaaatcgggacactcccacccaaatactgtgcttttccaaaggtattagcaaatggtagaccaggagattatatcccgcacctggctcagtgggtcccatgctcatggagccttgctcactgctagcgcagcagtctgagattgacctgtgaggcagcagcctggcaggaggaggggcatccaccattgctgaggcttcagtaggtatacaaagaggctgggaagctcaaacatgacggagcccatcacagctcagcaaggctggctgcctctatagactccacctctgggggcagggcatagctgaacaaaaggcagcagaaacttccgcagacttaaacattcctgtctgacagctctgaagagagcagtggatctcccagcacagtgtttgagcactgagaatgaacagactgcctcctcaagtgggtccctgacccctgtgtagcctaactcggagacacatcccagtaggggctgactgacacctcatacaggtgggacgaagcttccagaggaaggatcaggcagcaatatttgctgttctataatatttgctgttccgcagcctccactggtgatacccaggcaaacagggtctggagtggacctccagcaaactccaacagacctgcagctgagggacctgactgttagaaggaaaactaacaaacaaaaggaatagcttccacatcaacaaaaagggaatccacaccaaaaccccatctgtaggtcaccaacatcaaagaccaaaggtagataaaaccacaaagatggggataaaacagagcagaaaagctgaaaattctaaaatccagagcacctcttatcctccaaaggatcgcatctacttgccagcaacggaacaaagctggacggagaatatgtttgatgagttgacagaagtaggcttcagaaggtcgataataacaaacttatccaagctaaatgagcatgtttgaacccatcacaaggaagctaacaattttgaaaaaaggttagacgaatggctaaccagaataaacagtgtagagaagaacttaaatgaactgacagarcggaaaaccatggcacgagaacttcgtgatgcatgcacaagcttcagtagctgatttgatcaaatggaagaaagggtatccgtgattgaagatcaaattaatgaaataaacctagaagagaagtttacagaaaaaagagtaaaatgaaacaaacaaagcctccaagaaatatgggaccatgtgaaaagaccaaatctacatttgattggtgtacctgaaagtgacagggagaatggaaccatgttggaaaacactctgcaggatattatccaggagaacttccgcaacctagcaaggtaggccaacattcaaattcaggaaatacagagaacaccacaaagatcctcctagagaagagcaatcccaagacgcataatagtcagattcaccaaggttgaaatgaaggaaaaaatgttaagggcagccagagagaaaggtcgggttacccacaaaggaaaacccattggactaacagcggatctctctgcagaaactctacaagccagaagagagtgagggctaatattcaacattcttaaataaaagaattttcaacccagaatttcatatccagtcaaactaagcttcataagtgaaggagaaataaaatccttyacagacaagcaaatgctgagagattttgtcaccaccaggcctgccttacaagagctcctgaaggaagcactaaacatagaaaggaacaactggtaccagccactacaaaaacatgcccaattgtaaagaccattgatgctatgaagaaactgcatcaattaacggacaaaataaccagctaacatcgtaatgacagcatcaaattcacacataacatactaacattaaatgtaaatgggctaactgccccaattaaaagacacagactggcaaattggataaagagtcaaggtccatcagtgtgctgtaatcaggagacccatctcatgtacaaagacayacataggctcaaaataaagagatggaggaagatctaccaagcaaatggaaagcaaaaaaaaaaaaaaaaaaaaacaagcaggggttgtaatcctagtctctgatgaaacagactttaaaccagcaaaaatcraaagagacaaagaaggccattacataatggtaaagggatcaattcaacaggaagagctaactatcctaaatatatatgcacccaatacagaagcactcagattcataaagcaagtccttagagacctacaaggagacttagactcccacacaataataatgggagactttaacaacccactgccaatattagacatatcaatgagacagaaggttaacaaggatatccaggacttgaactcagctctgcrctaagcagacctaatagacatctgcagaactctccaccccaaatcaacagaatatacattcttctcagcaccacatcacacttattccaaaattgaccacatagttggaagaaaagcactcctcagcaaatgtaaaagaacagaaatcacaacaaactgtctctaagaccacagcgcaatcaaattagaactcaggattaagaaactcactcaaaaccgcaccactacatggaragtgaacaacctgctcctgaatgactactgggtaaataacgagatgaaggcagatataaagatgttctttgaaaccagtaagaacagagacacaacgtgccagaatctccagttaaagcagtgtgtagagggaaatttatagcactaaatgcccacaagagaaagcaggaaagatctaaaatcaacaccctaacatcacaattaaaagaactagagaagcaagagaaaacgcattcaaaagctagcagaaggtgagaaataactaagatcagagcagmactgaaagagacagagacacaaaaaacccctcaaaaaatcartgaatccargagatgcttttttgaaaagatcaacaaaattgatagactgctagcaagacttacaaagaagaaaagaaagaagaatcaaatagatgcaataaaaaatgataaaggggatatcaccaccgatcccacagaaatacaaactaccatcagagaatattataaacacctctacacaaataaactagaaaatctagaataaatggataaattcctggacacatacatcctcccaagactaaaccaggaagaagtggaatctctgaatagatcaataacaggctctgaagttgaggcaataattaagagcctaccaaccagaaaaaggccaagaccagatggattcacagccgaattctaccagatgtacaaagagtagctggtaccattccttctgaaaccattccaatcaatagaaaaagagggaatcctccctaactcattttatggggccaacatcatcctgataccaaagcctggcagacacaccacaaaaaaagagaattttagaccaatatccctgatgaccatygatgcaaaaatcctcaataaaatactggcaaaccaaatctggcagcatatcaaaaagcttatccaccacgatcaagttggcttcatccctgggatgcaaggctggttaaacatatgcaaatcagtaaacataatccatcccataaacagaaccaatgacaaaaaccatatgattatctcaatagatgcagaaaaggccttccacaaaattcaacagcccttcatgctaaaaactctcaataaactaggtattgatggaatgtatctcaaaataataagaactatttatgacaaacccacagccaatatcacactgaatgggcaaaaactggaagcattccctttgaaaactggcataagacagggatgccctctctcactactcctattcaacatagtgtttgaagttctggccagggcaatcaggcaagagaaagaaataaagggtattcaattaggaagtcaaattgtccctgtttgcaaatgacatgattgtatatttagaaaaccccgtcatctcagcccaaaatctccttaagctgacgatcaacttcaacaaagtctcaggatacaaaatcaatgtgcaaaaatcacaagcattcctatacaccaataacagacaaacagagagccaaatcatgagtgaactcctatgtacaatcactacaaagagaataaaatacctaggaactcaacttacaagagatgtgaaggacctcttcaaggagaactacaaaccactgctcaacaaaattaaagaggacacaaacaaatggaagaacattccatgctcatggataggaagaattaatatcgtgaaaatggccatactacccaaggtaatttatagattcaatgccatccccatcaagctaccaatgactttctttacagaattggaaaaaactactttaaagttcatatggaaccaaaaaagagcccacattgccaagacaatcctaaggaaaaagaagaaagctggaggcatcatgctacttgacttmaaactatactacaaggctacagtaaccaaaacagcatsgtactgttaccaaaacagatatatagaccaatggaacagaatagaggcctcagaaataacaccacacatctacaaccatctgatctttgacaaacckgacaaaaacaagaaatggtgaaaggattccctatttaaaaaatggtgctgggataactggctagccatatgtaggaagctgaacctggatcccttccttacaccttacacaaaaatttattcaagacagatkaaagacgtaaatattagacttaaaaccataaaaaccctagaggaaaacctaggcaataccattcaggacataggcatgggcaaggacttcatgactaaaacaccaaaggaatgccaacaaaagccaaaatagaccaatgggatctaattaaactaaagagcttctgcacggcaaaagaaactactatcagagtgaaagggcaacctacagaatgggaggaaatttttgcaatctacccatctgacaaagggctaataccagaatctacaaagaacttaaacaaatttacaagaaaaaaacaaacaaccccatcaaaaagtgggcaaaggatatgaacagacacttctcaaaagaagacatttatgcagccaacagacatgtgaaaaaatgctcatcatcactagtcatcagagaaatgcaaaccaaaacacactgagatactatctcatgccagttagaatggagatcattaaaaagtcaggaaacaacagatgctggagaggacatggagaagtaggaacacttttacactgttggtggaagtgtaaattagttcaaccattgtggaagacagtatggtaattcctcaaggatctagaactagaaataccatttgacccagcgatcccattactgggtatatacccaaaggattataaatcatgctagtataaagatacatgcacacatatgtttattgcggcactattcacaatagcaaagacttggaatcaacccaaatgtccatcaatgatagactgaataaagaaaatatggcacatatacaccatgaaatgctatgcagccataaaaaaggatgagttgggccgggtgcggtggctcacacctgtaatcacagcactttgggaggccgaggtgggcagatcacgaggtcaggagatcaagaccatcctggctaacacagtgaaaccccgtctctacttaaaatacaaaaaaaaattagccaggcgtggtggcaggcacctatagtcccagctactcgggaggctgaggccagggaatggcatgaacctgggaggcagagcttgcagtgagccgagatagtgccactgcactccagcagcctgggcaacaaagcaagactctctctccaaaaaaaaaaaaaaaaaaaaagatgagttcctgtcctttgcagggacatggatgaagctgaagctggaaaccatcattctcagcaaactatcacaaggacagaaaaccatataccgcatgttcttactcataggtgtaaattgaacaatgaaaacacttggacgtagggcagggaatatcacacaccagggcctgttgcggggtgggggattgggggagggatagcatcaggagaaatacctaatgtaaatgacaagttattgggtgcagcmaaccaacatggcatatgtatasctatgtaacaaacctgcacgttgtgcacatgtaccctagaacttaaagtaaaatttaaaaaaaagcctcataatcctttttattttttatagtcagtagtaatgtccccatttttatttctgattttagtaatttgagtctcctctcttttttcttagtttatctagctaaaagtttgttgaaatgttttatcttctcaaagaactttttattttattgattttctctattgttttactattctctatttcatttatctgagcgccagtctttattatttccttctttctgctacctttgggtttaatttgtgtttctttttctagctccttaggtgtaattagattgtcaatttgacatttttcttgtttttcagtgtgaatatttagagttataaagttctcacttagtagtgccttcacagtatcccataagttttgctatgttatgtttttattttyattcatttctaagtatttttaaatttcccttatgactacttctttaatctattattaagagtgtgttgtttagtttccacaaattggtggcttctacagtttcacttctattatcaatttctaacttcacgtcctttgtggttggagaagatactttgyatgatctctatatttttaaatctgttgagacttaatttgtgacctaatatatagtctatactgaaaaatgtcccgtgtgcgcttgggaagaatgtaaatgctgtttttgttaggtagagtattctgtatatatctcttacatctagttggtttattatgttgtttaggtcctctatttcctcacttatcttccgtgtggttgttgtattcattactgagaacgggctattgaagtttccaactatcatttattgtcgaactatctatttcttcctttaattctgtcagtttttgcttcatatatttttatagtgtgtcattaggtacataaatgtttgtaattgttcgattcttgctgtattaaaccttgtattaatatataatgtcctgctttgtctcttgtacattttttaatttataatctattttgtctgttactaatatagcaactcctgctctcgtttggttactatttgcatggaatacctgtctccatcctttctctttcaaactatttatgtctttaaatctaaaatgagtctcttgtagacagcgtatggttggatcatgtgttttaattgattctgccaatctcagtattttgattgaagcattaatatatttatatttagagtaattactgataaagagggaattatttmtgtcattttaattatttgtttcctatatgccttttagcttttttgtcactcatttctggcattattgtctttctttgtggttagttgattgttcgtagtgaaatgtttacatttctttctcgtttccttatacacacacacacatatacatctatacacatgtatacacacatatacatatatacatacacacatatatatacacacacatatgaatacacacacatatatagctattttcttccccattggttacaatggggattacatttaatatcctaaggttataacattctaatttgaatttacacaggtttaactgcaataacttaaaaaaactctgctcttttacagccccattccctacccctttcagttgttgatggcataaaataccatctttatacattgtgtgttccaaaatgtagactaatgattctttgaaatgcatttgtctcttaaattatgtggagaacaaaaagtggagttacaagccattgttacaataatacgagcttttataattgcccatgtgtttacttttactgagaactttgtttattcatatggcagcaagttgctgtctagtgtctgtttatttcatcctataggactcccttgagtatttcctgcaggacaggtctattggtaacaaactacatcagcttttgtttatctagaaatgtctcatgttatcccytgttttgaaggatagttttgccagaaaaaagatttttggttgacactttttttcttttagaactttgaatctatctgccaactgccttctggcctctaaagtttctgatgagagatctgctgataattttattgaagatcccttgtatgtggccagttgcttctcttttgatgatttcaagactctctttgcctttgtcytttaaaatttgattatattgtgtcttgcgtggatttctttgagttcatcttacttggagttcgctgagttcttggatgtctatatacatgtctttcatcaaatttgggaagtgttaggccattatcttttaaaatattctgtctgctcctttctttctcttttatttttcttgaattcccacaatgtatatgttggtccacttgatggcttttcacatgtcctttaggctctcttcagtgttcttcaatttgttttctttctgttcctcaaacttaataattttcactctcctatcttcatgtttaccaattctttctcctgtcagtgcaaatctgcccttgaacctttctagtaagttttccatttcagttatattactttttagctccagaatttattttctgtttttgtccaaatttttwaaaatcttattattgaaatttacattttgttcatacatcattttcttcattctctacatcctttttttagagcatattcaagacagttgttctaaagtctttgcctagcatatttgccatcaggtctttttcagagacatttctgttgatttatttttttcgtttgaatgagctatactttcttgttcctttgtatgccttgtgatttttggttaaaaactggacatttgaatctaataatgtggtatctctgaaaagcagattctcccctttccccagaatttgctgggggttttttgttactgttttggtttcttgtcttttttgtattttttattttttagagatgtgatctttctgtgttgctcaggctggcctcaaactactgagttcaaatctcctcccagctcagcctccacagtagctgggattacaggtcactgcacttggctttggtttggggttttgttttgttgtttttgttgtaaggtatctctgtgctgagaataagcctgaaatataaacttaagatcttcacaggtcttttctgagcctttccttgggcatatgcagtgactttctaattctcccagtatatacagttgttttttaatgtcctagtgtttgatgtctggcttccaaatgttggaaagagaaaaataaaggaaagataagaatggtgccaaccctttacatcgcccaaatgttacttcatccagaggggaagtagcttgcaacaatggggggaggtgcaagaacaatgactgcctacctctttgtctgcacctttgtaatcagaagcagcaatcagtgataagagcacagatctctgatagttgaaggacatagtccttttttgcccaccctggctcccacaagctctgtataagctgctcctggaacacatgcacagctgcctgccttggggcttagtggtgggggaagaatatctgctactgtgctaagaactgaaattgactaaaattaacttcaatttacctacgaagctttcttctgaagttgcaagcctttaatagactctagagttccaaagtagttgcatcagacaaattctgccagtaaaatttttgtctaggaagggagacagattcctggtgctttctactttgccatcttctcagaattcgttcctcattttccttttatgtgattctcctttaagctaagcatattggaaaagaagaaagaaagctgccattattctcagatgacatagaaaccaaaaaatgcgtagaaaagtatttaagctaataatcatgtttagtgatattgctggaattaaagtttttatataaagattaattgcatttatagaaacaagtaataaatagaagatgcagtttaaaatggtaccatctataacagagacaaaatatataaaagatctgtaatttcttaagatgtgaaagactactatggagaaagttatgaaactttattaacagacactttcaaagatgtaaataacttgacaggcaacccattttcatggaaaaccttaaaatcatgaagattttcattttttccaatgttattccatgtaattccaatcaaaattccaatggggtttcttatgggatttttatgataaaactaaaatgaaagcgtaaaaggccaagaaaactaaggcattcctgaagatgataaacagtgtgtgtgagttggagggtgggataccattasctatgacaggtctgaggagtggtagaaatggcatttcaaattagcgtggaaaagatgggttattaaaattatgctggggcaagtagttacccacatggaaaaaatgaaattggatcaagtctatgcactacacacaaaagataaatttgataaattaagagctcaaatttaaaggtgacatttaaaattttagaagaaaatataaaggatatttacattctcagagtagggagaaatttttcaaataagattccaaaaaatcaaactataaagaacaagtggtgtgcatttgactttattaaaattaagaatttattttcattataaggcaccataaagagagtgaaaaaataacccataaagttggaaaagatatgttcaatgcacgtaactgaaaaataattacaatccagaatatrtaaagcatggctataaaaattaataaacttgtgggcagcacaatagaaaaatgggcaaaagatacaagcaggcatttcacagaaaaggaaacaaaaacagccaataaatgtcaaaaatgctcaaccacatcagtaatttgatagatataaactaaaactactcaccttaatgacacaaattttagtctgatgattaagttttggcaattttagtctgatgattcagttttggcaaagatgtggagtgataggaattctcatacgttgctgttggtagtgtaaattgatataactactttggaagaaactttctagctaaatagtaaattttaatatgcatgtgttatttcactgggcaattccattcctaggtgtaaacactggaaaaactgttgtaaatgagtaccaagagacatgtgtacaggaacgcttatatagcagcatgtagaagaaaaatactgaaaataaagcatatgttgttacacataaaaaggataagtaaatcacagcatatttgtataatggaataccatagagctatgaaaataagtgaacagctgctacttgtaccaagtggataaatctcaaaaacaatgctgagctaaaaatgcaagaaatagaagaatgcatatggtattatttcatttctataaagtcaagactaatgaatatgttgaaactaatataataaagtgattataataagtgaatataaaactaatgaatgtatcatttggggaaacagacatatgtgataatactataaatgaagtaagaaaatagttcaaaactcagaatagtggttactccaggggaatgaggagcatttaactggggagaagtatgtagggtaatagtcaaagttaatgttattttttaagttaggtgatggagaaaaggttttcatttttactttttttttttttttcttgagatggattctcgctgtcgtcacctgagctggagtgcaatggcactatctcagctcactgcaacctccgcctcccgggttccagcaattctcctgccttagcctcccaagtagctgagattacaggcacctgccaccacacccagctaatttttgtatttttagtagagayggggtttcaccatgttgacccagctggtctcaaactcctgacctcaggtgatccacccgccttggcctcccaaagtgctgggattacaggtgtgagccaccaggcttggccatatttttcttaaaatgtatacctaaactcatgtgtatggtagattttacaattaaagaaactaaaaataatacaaggttattgaaaacaataatgtaaaaggatacacatggtcacagtttaaaactattcattctatgactcataaacrcagtaattctttccaataaccaagtgctcagatgggatgcaagtttgctggggctcttaaggagctattaaaaagaaatgtttaatctgtaggtcatgtcatttatttagaactggggatgccaaattcaatagaaaatacctcactagctataaatggtagctacaccctatagtcctgaatacgataaacctggagctactggctttgctgtttgtttttgcaaatccttgactttgatttgacattctctttggctcaactgtattctcttgactaccttgggaaaatgcctcactcagtttaacttgggccaaaagcttgcgtacttaacacagggatctggatctggtgtttaatagctgattaattttctcatcagcaaaattggtgtgatagtaataatcctctttatagggtaaaagaaacaataaagtcaagccctctgatgatagtyattttttttagtcactcagctttactttttattcttttagaatttcattttgtgaccagtccttgtgaaaatgtaaatccaagtgccctgccctttccctaattgagggtctggtgtcatacaacaatatgctttttccccaggatttaattcttgtcattcatagatggaaaataaaattggagtttatttctcctaagccttcctcccacacccctccccatagaaagacttggtttctattgtattagaggcaggttctgtattctttttgattctgtgagtttcttcatgtctttcaaatatattgatttgtgcttcttagagttggttttgattgcttacaaaattaaagcctaagtgatataagcaccaaatacagtctctggcacatagtaggcacttgtagtgtttgttgatatgattattttcacaattgaaatgttccctgaacaacacacactagggcctgtcagtgggggtggcacgagggaaagcatcaggaaaaatagctaacgcatgctgggcttaatatttaggtgatgggttaatagggacagcaaaccaccatggcacatgtttacctatgtaacaaacctgcacaccttgcacatgcaccctggaactaaaataaaataaaaatttttcctggcagcacttctattagactttctctggttctgagagtagaacaaaacacttaacctaccaatcacaggaagaatggatacaatttagtttccaaatgtgataaatggataaacctgtctggactcacaagaactctgctaaggtgctgaaatcccataatgatcacccatattcccgccaactgcattcctggtattgtcacaagacagcatcatataagcaatacagaaaatatgtgctagagtacataaagtaaatcaaaagaaggagagagcattaagatagaaaagatctgagttggactttgaagaactgctaagattgggataggcagtgaggataaggagacactgcaggcaagacattacaggcaaggagtggagggataccttgagcaaagacatgcaaggcatgtttgagggcaaagaatagtcctttggccaaaagagaaatgtattatagaacaatggtagtgaattatgtttggaaggggtagattggagttaatttaaatacaaagttccagaaacggtcaagttgcaaatatttctatgaagagactcatttcaatatcatctatattatttctatccattagcaacgcagtttttaggggatgtaatttgaaactacagaacactagagagttcttggtgacctttagaggggacattttgagatccaaacattcttagataaaattatcatttagtcatgacttgaagccattccaaagaacatgtgtgagtagaatattgagagagtagcacctaaagarggaagatttcttaggcactgattgtacaaattacatatgaataattccatgaggaaaaaaaggtttaagaacagctaataacttccaaagtttctttttatttatttttccataaagacttgctttgatgccagacacaaaatgtccacaatagaaaatctgaccacagtatctaaacagttgcttatcagyccttggaactgccaaaaaagctattaaactgrtgttttccatggtgatggtctccaccaccctgttagragccatgacattgttctgtccttgttgggcagagaaggtggtgatgctggtggtgggagggtgtaggttgaaggtcttgggagggtgtttgtagaagagaaggtccgttgatttactgattaactacatacacatctgggtcaaattgttctctatttagaagcctttgtgataaccacagaatcagaacatataaaaagctctgcgggactggtgctgactgcaaccatgacaaagcttattctcctcacaggtgggtttgtaatcagagattgacccttcatcttatctagtttctttttctctcacaggctctgaaaatcatgaagtggtcttcatactacatccctatacttttccattcttctttcatcatttcaaatttcaaatgaatcttgttatatacaaatcagtctgcctcttgttctcttaacttcaactgactctggtaacatttctgcttttgttaatcccatggacctggtcctaaaggaaaagcatactttctcctagtgctagtcttactctttcatcttttgttcagccattcatttttctttactcttcttcctacgccatctcattttaattggaataatgtttatttatttgcttgtgtccttggactagcttttctggggaagaaaatcagtaggaactgagatagagttatgcaagttgtctttgttctgctgttttcagaattatttctctatttaytcccctattatcctactgagttgatgatgtaccataaacatgttagaaattaaattattcaaagaggttgattcagtaagttgtttagagacaagtcataccaagaatttattagttgctctagagctgggatttgcaaactgtttaagcttcagaaccttttccaaatgaaacctcaagctcaatttataaaacaatcagagtagaagaattgctttgtagaagtcagggaaaggtatctggagtctcacccmatagttcctagctcttctctcctcatataaggcctcctgaaagtcattccaaaaaaccactaaaggccagaagatactgaattctctgatttagcagatgccttatctgttggaaggctgtgttctatcactcaggtaggggaagaacgaatggatgtgtcatcattgagtacagtgatcagttggtgatttcagtaagtacatcttccatagatagtaaacttcggactcagcattcaggaacatttatttgtgacaaggaaggtgtgagacgaaggtaccacggtcatttttgataaaggtggggaaaggtagatctactgttgtattcactgaaaagcctttggaatcaccaccaaatctcactgaggytgtaacaatttatggyaaattggaaggcaatcaatccttcagaattagattctacggggtacagacaatcggttcaaagtacatgctttttctttctatccaggtcttgtccttatactgaatttgcagctcggtaagtcatggactccatgttttatcattgaatgtatatatacgagataaaccatactatggaaagagagccgctgtttgcttcacagacagatgggtttgatttgggagtaatctagtgttttggattggctgtcactgctatcctcttcagcatgaccatctgaattataaactggtactcactgggcttcataggactatgggcatcttttcttagaaggctgctagctaggcttatccaaaatcccaaaatgagtctgtgaaagttaaaaataaacaactccaagttagtgaccagttctgagttagaatcttaggatgcatttgcaagagtgttcatactaattacctccacacagagatcaggcatctgaggcacagggagggaaacagaggcarggccaaaactcacmgcacacttcagtggatcctaaaccaggccattgtccctcctgctgactacacacaggctctgcctaccagctgacatgctacttcaccaactgggcccagtacyggccaggcctggggcgcttcatgcctgacracatcracccctgcctctgtacccacctsatctacgcctttgctgggakgcagaacaacgagatcaccaccatcgaatggaatgatgtgactctctaccaagctttcaatggcctgaaaaataagtaggatgagggagatatttaatttggcatcccctttttcagtacttcccaaacattaatgcttcttaaaatgtagttcagatccatggatctgagatggggaccaagactctgcatttcatttttcttttataactgacaaaaattgtatgtgtttactatggacaatgtaatgttttgaaatatgtatacggtgcggaatggctcaatcgaactatcaacatatgcatttccacaaatacttaatgttttttgtggtgagaacacttaaaatgtactgtttgcaattttcaaaatacaatatattgttactaacaatagtaaccatgttgtacaatagacctctgcaacttattcctcatttctaactgaaattttgtatcctttgaccaacatgccccccaacccccatccccacaccacccccagcctctgctaacgaccattctactatatacttctatgagttcaacttcttttagattccacttataagtgagatcatgtggtatatgtctttctgtgcctggtttatctcacttaacataatatcctccaggtttatccatattgctgcaaatgacaggatttctgcctcttttttaagacttaatagtattcattgtatataaagaccacattttctttgtccattcatccattgaggggcacttagattgattccacatcttagctactgtgaatagtgctgcaatgaacatggaaattcagatatctcttcaacacactgatttcatttcctttggatgtaaacccagtagtgtaactgctggatcatatggtagttatttctttgattttttgaggaacatctatactattttccataatgggtatactaatgttcattcccaccaacagtgggcaagagttccttttttttccatgtcttttccaacacttacctttcatctttttgataacagccattctaagcggattgagtggtatctcatttgattttgatatgtatttctctgatgattagtgatgttgagcattttttatacacttgttgaccattggtatgtcttcttttgagaaatgtcttttsaagtccttggcccattttttaatcaggttatttggtttcttactactgagttgtataaatttcctatatatttttgatactaactaactccttacttgacatatggtttccaactattttctcccattccataggtagtctcttcactctgtttcctttgtcatgcaaaagctttttagcctgatgtaatcccatttgtctatttttgcttttgttgctgcactttccagtcatatccaaaaaattcttgctgtagctcttggagcttttttttaaggttttctttcagtagttttacaatttgaggtcataaatttagatctttaatccattctgagttgactttgttcagtttagtcatatttaagagaaggaaagctacaggtgattgctactatcagtaatggyattatcgtgaatacagctactagaatttaagttacaatgactaagagtaaataaactcctttacggcagtgtttcttgaagtgtgstccattgactacttgcctcaaaatcatgtgaggtacctgagtaagtgttagtccctactgcaatccaaccgaattggaatctcaggggaaggggcgataaacccagatttttmatgttgtcctcccacaacccttgcacttaattattatgtatgttaatgtttgggaatctctattcaagagaatgtgtataatttcaagccaattaatttattttaacattacagaggctaaaaatgtaattaagctcaagcaacatttaccattttatctgatagaatagaatattatattagctattcatgytttttaaacttacacaatcaaagatactgccaacacacaatattttttaaagcccagtttcaaaatttagatttccctagggaaccctgagtgcattcatgacaggaacaacacaaagaatttttataaaggaagttttcagtaggggaggaaaattgttctacaaaaggcaaaacaaaaatatctgaccagatccaayactaaagcaatgtattttaratggagggagtcmtgacttttgaagtttatctgtttctatcctttgytttacaggaacagccagctgaaaactctcctggccattggaggctggaacttcrggactgccccrtaagtcttctatggagagcatgttgttcgtttgctatggaaaacaagttagccccaygtgatcactgtccctttagacttcacaatctaagacagggtattgaggatgtacataaacaaatatatgaattaaatatattgctacaccagaacctcattattaagtggaacacaatttatttcatacatttaatttggtggacatttgggggccctatccacagaggtttacttactgaggttcccaaacaacctcttcttaaagtatttcaagagtacaaaccctgaggacagtgttataatgcttccctctatttatcttctggtggggggaggaatgagaaaatcacacaaataaacaagaggacttcttggagggtacatgtttggggagggaacacagtgtgctgggtttgccaggtatccaaagaaacaagggcaacttgggagaaagagcagagttggggggataacagaataaagggaatgttaagataccatggctgggaagagtagtgattacaaaggaaggagaggagaaaaccaagaacatgctttactctgggctgtgggtcctgatgaagggctctgaggcaggaattgagagcttgattttactccaaggtgttgggaccaccaaggtctcaccctgccttctttgggtctccctcagtttcactgccatggtttctactcctgagaaccgccagactttcatcacctcagtcatcarattcctgcgccagtatgagtttgacgggctggactttgactgggagtaccctggctctcgtgggagccctcctcaggacaagcatctcttcactgtcctggtgcaggtggggaaggaagtcccagtctttagcccaaaaagattcaaagtctttctttccgaggagaattgggtggctctagggtaaaacaaaacttgaatttaaactgatagaatattagcattgcaaagagtcttatatatcgtgcgttcattaaacaaacatttaatggcaacaacaaagcaacatgtgagctctgtgccaggcactgctctacatgttgttttaagaaccataacccatttcatcttcatatttactctatggcatacatactataagtgttataatctttattttacagatgaggaaactaaagtacagagaggatttaagcaacttgcccaagatcacacaactagtaggaatcataacttcctctgcagtttggctacagagtccattgcttctaagcattacactaggctgcccgttattactgagtacgtattctgtggcagacattgtcaggctctgaagaacttcttctgaggtggaagactgaaakaatatgaacaatgtcaatgcattgtgataaatgccatgttagaggtctgcagagtacaaaagtaacaaggaaagagggtaactaattctgctctgggkcaggatcagaaagtgtttcctagagaaagtgatgcttgggctcagtcttgaaagaaactggtgttaaccaattaagtgaggatgggaatggcacaaatgatatacagataagtgtgagcaagtgggtgataatggctgtgaagttgcatgaagaaccagataatgtgagaacttttatattatgttcaggaatttgcactttacctttgacacaatgggactgttttgaagaattttaaatagtagagagctggcttttaccatagaggataaattagaaggagatgagaagtcatggatagaattaggaggttattgcagtaaatcaagcaagaaatgatcagggccccaacaaaggctctaacactgagggaagaagaggatgtatataagagatatcaagaggatagaatcaataggatttggagatcaactggaaataggaaatggagaggacctccaattttctgactttgaggatgggtttgattttaatgctattaactaagatggtaaatacaggaagaagtgtagatttgaaagaagaagaattgaccttgaacttgatgagtatgaggtatctgtagagcatcctaacrgagtgcccagtagscatcagataaatatcaatctggagttcaggacaaaaaagcttgatatacttggtttttagacttactgtctcccaagacagattgtttgctattccattctatgtaacagatcgtcacycagcctctgaatagtttcaatgttaagtaataggtgaaaagtcaatttacttacttgttgaattgccctaatgatcataaaggaatatctctttcttggctggaacatgcctctagtcataatttataacttctggtcattgtttctagttcttcctgctgaagcaacagagaataagactgcatcttttgcaatatatgggcttaatgtcttaagacagctgtaaataccttgcctataatttctcttattccagttaaatatcttaatgccttcaatcaataaccgcatgacaattttcagagccagccttcactggaacatactctggcgcaccctaatagtgcaattataagaactaaacccagtactccaaatgagattacagtcgcacagatacaggtggattaatctctagkattgaatgggaacctatcatctagctgttaccaccttccttattggccaatacaccattttatttgatgggatktcagtcctataaagtagttcatctactttatgaaacaaatttctatactgctggatgtagggtatcactgcaactagagcttcaaagtatagagatacaatggagccctgatggtcatctgggacctgggttttggtcatgacctacctactaactcagtgtgggactttggtgaagtgtcctaactcttatgcatattagatagccagaaaattcaataatattatctatccgatctactttatttggttgttgagagactaaagtaaaataaaatatgtgaaagcaatttaagagagagaagcattatacagacatatgtttattagtattatttaaggagctaaaatcagcatcatagatgtcctattatgccttattattctgtaggaaatgcgtgaagcttttgagcaggaggccaagcagatcaacaagcccaggctgatggtcactgctgcagtagctgctggcatctccaatatccagtctggctatgagatcccccaactgtcacagtgagtgatgtgccttatcttcaaactcctggaggtgtcactcgggcacactagacttgtccttggtctggcttgctattcagggaccttgtttaggagactttagaagtggtgtcctgtgcctgcataggtgtgggaaatgaccatcagaatgattttaaatcctccaccccacctcaggtacctggactacatccatgtcatgacctacgacctccatggctcctgggagggctacactggagagaacagccccctctacaaatacccgactgacaccggcagcaacgcctacctcaatgtggtgagtccctgtacagatgcaagagcagaccagagatgatgatgaaaatcacatagagattcaggcacaaaaggcatcataagtttagtggttttctcaaatgggaaattaggctgccataattaattaaatattctcatttaatttcacacagagactgggacacaaagtaaacataaattctgcaagtgtctcacttaaacaactgtcctcaagttgatcgtatttcattaactacaacttcaccaaaatgttttgaaaaaaatactaatccatctggaattaacagcatagagttttacctgtcggaataggggactaatataactaagtactgggtcctcagctggttgggccatgtaactaacccactgacattgcaggattatgtcatgaactactggaaggacaatggagcaccagctgagaagctcatcgttggattccctacctatggacacaacttcatcctgagcaacccctccaacactggaattggtgcccccacctctggtgytggtcctgckgggccctatgccaaggagtctgggatctgggcttactacgaggtatgtagattggactgaaaagtgctctgtgaattccgtgcactgtgccttagggctagaatctgctgaaatcttgaatgttcattctgtctcctacctaaatgctttaaacacagctgcttaaagtgtttaaatagcattcatttacataatccaaatgaatagcatttaacaatgcataatatcccttcacacaacagactacctyttaaatgtaatttatattagcacacaggtaataaaataaatatacctctcatattactgtgggttcccaaaatcatttgacaagcaacttgatcctctttactacaaataaaaacctgtaactagaaattgagcaaaaccccaactggagacatgaaagaagaaaaatttgaaacatgtttttctttaatgggagtaacatttaawagatttgaatctcttgacttttgaaagatctgtaccttcctgaaaaatggagccactcagggatgggatgcccctcaggaagtgccttatgcctatcagggcaatgtrtgggttggctatgacaacrtcaagagcttcgatattaaggtaagatcagtcccttaaatgtgctgaggtcccagccctgagtcccaggaaagcaagtgattcctgttatcctctttctttaaacaggctcaatggcttaagcacaacaaatytggaggcgccatggtctgggccattgatctggatgacttcactggcactttctgcaaccagggcaagyttcccctaatctccaccctgaagaaggccctyggcytgcagagtgcaagtaagtgactgagggggaatgcccaggtgtataaataycccttctccaactcaaaaagcaaccctgatgtcttcccacctcccccttgcccagggatcctctttccacttcacctcaccgctcttgcccagatgagagacaggttttacccttgaacggccatgtcaggaacattgtgcacttatgggaagccaggcctaactgggtgggtgttctaagtctgctaagtcttaagggtgtggaagagcctcaagaaattatactaacatcaatataagtatctgcttctctatgaatcccttattcaaaatctttctcagcccacctggggagatttaagaaaccctcaccaatgctcacatatctctaatcagtgattcaggggatgtatcaattctctaaattttttccrgatttttcctagaatttatttgttcaccatttatgcccagattctagaaaagtgttttgcatacatttggtggttagtaaatttttttttgaatgatttagatgttataaggaaagagcaacctttttttacaattaaaagccaggctggcttgacacaatagctttatttatctcctgaatatggagctactttctcttctcagttgcagggatccagagccaactgcaccccacctccacacttccactcccacagttctcttcacctctaggtgaagcttagagcctctcccaagcccactagtctgctcttactgctgtatgtttcaggttgcacggctccagctcagcccattgagccaataactgctgctcccagtggcagcgggaacgggagcgggagtagcagctctggaggcagctcrggaggcagtggattctgtgctgkcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaacatgactgtccttgcttttaagtgatttgggtggaaacctcttccagatatgaaaataggggctatgcatgggggtggagtggtggagtagagtgtgagaggaagtggtggagctaacagcgccacagtcttctatctgcctgtgttcatctgcatgaaggttggaagctgtaaggaggaaatgtctgaatgtttggtgcatgggagggatgaggatatgaagaggataggtctgtcaccaggcaattttcctcaggaaggagctgaagtgcttctgtaagactgggggacataagcagtgctgcctggcttgctcaaggagtggaagactgggacatcctctccacttctactgaagtggactggcagcttcgggaagatatgtgcagtagactccatttagggtttctgcctagcccatgggccagccaggctccctttctcaggagatgacacctaccattggaatcgtagtggtggccaccagctgctgtgcttgtatgcataccccctcccatggcttggctgatagactgggatagacatcaggctcaagagggccaataagattatcacacctcagaatttgcagctcggaacaaggaattgcctgtcatcactcgtgtgggtgggtctgcaatatgtaagctcaggagctgtagcgagggactagggggaaggaaaagttgtcctacatgcagagctgagctacagacaaaagccaggatgtgagatgagagagaacatttactgatagacggctttcttcttcttcttcttcttcttcttttttttttttttttattgagatgaagtctcgctctatcagcaggctgcagtgcagtggcatgatctcggctcactgcaacctcggcctcccgggttcaagtgattctcctgcctcagccttccaagtatctgggattacaggcacgtgccaccatgtccagctaatttttgtatttttagtagagacgaggtttcaccatgttggtcaggctggtctcaaactcctgacctcaagtgatccacccaccttggcctcccaaagtgctggggttataggcatgagacaccacgcctggccagataaatagctttctagctcttgattatagttccttcctgaggcccagatgcacttttgcctatggattttgtgaaatatccctataattacataataaattcctctttgctgcttaagctgactaaagtttgcttcttttacatgcaaatgaaagaaacctaaataatgtaatgagaatataagggctcatttctttttttctggcattcttactatgtgtcaaactgttctaagtgttttacatgtattttcctatttagttttcctagcaactttatgaggtggataacgttaactccaggaaactgaagtagagatgaattaattaacctgccccaaatcacacagctaggtagttgcagagccagatacatagccaggtggactggccccagagctcacagtcttatctactatgttttacttgcctcccttgacacacaccacattgttctcatgggagatgacaacactggtggcagtgatgaggtgcacaccactctctgggcaacatcattcattcataaactcacaccatttattgattattatgtgtcaggtgatattctaggtactgaagacatagtggtaaataagacatactctactctcatggggattatattttgctagtggaagtgttagatgataaataagcaaatgaacaaatgagaaaaataaaacagtgatagaaagtgaccaaaagaggagactactttatttggagcaatcccagaaggcttctctgaggaggtcctatacaagatggccttgacagtcaaaaagagttgtctgttttgggatctgggaaaagtgtgttttgggcagagggactaagtacaaagtccttgaggtggaaatgaacatggagtgttagatacaagaagcccagtatggccatgagatggtgggcacagggaagaaataggcaggggtcagatcattcaagggcttgaaacatggttagaagtttgtattttattgtaagtgggctgtgaagccattggaaagtgataatagggatggggttgatgacaggatctaaattcaacattgatgagatgaggctggaataggattaaagaatataggaaaatggcactcatggcgatggtagccaatggattgactgagcacctttgtgacatgccttgaagattgaagacagaagtgggggacttgtgtcttcaatgagcagaggaaggcaagagacagtaaaagtgggtatcactagtaatgtcgttatatttctagtcaaagaatgatgaaatctggagtaaaatagagcatagaaattttgggggtggcttttgaaaggagtttcctatttaggtcactactaaagtaaatagcactgaggggggacatggggatgtggggctctggagttaatgaaaaaatgacatgacatcagctgttggctttgaggaagagcatctttgaacaacttagtgtccagtggctaaatcaaagtggttttcaaaactagcacctttttcaatgccactattttcccacaaagatgaattctgccaccatttctagaacagggaaattattgcagccaaaacaagtagtgtcccctccatttttcttcctatttttacatattaattggtcattcaaatgcatgtttactgtgcacctactatgtgcaaaaagacggtgagcatgagctagctcccctgaccactctgacctcacctccaacaattctcactcactccattccaactatgtcatcttcttgctgtttctcaagtattccaggcatgtgttgcctcagggccttcatacaagctagaacacactttccatagatttccatttgactctttccctcactttcttcaggcttttcctggaagtcaccttctcagtgaggtctttcctggccactcaacctgattttgaaaccccctttctctgcctctgcctgctgtgcttcttttgccctttcttgacacttgtcactacctgacctaccattcatttaacgtatttaccttttttatcgtctacctccctcactagtattaacctccatgaggaaaggcatttctgttcactgcaacattctcactgcctagaacaaggcctggcatattataagagaataaatacttggtgaattaataaatgaatgtggtaaaggaagtgagataggaattaacaagctgacccctcacgtcaggtggtgtgtggtccatggcagacttctctcagcagacacaaagggttgggtaggcctgcagtttcatgcaggtcagtcctgggtgcctaccactcacaggaggatgaattctctcttcttgttacctgcctgcaatttcccatccccaggcatagaagataacatgttatgccccgactgtgctaagaggaataagaagatgataaaaagattaataacaatagagaagtagcagcaacccgtttgaatacaatgtaagagaccagaatatgccacctcaaaataagtattattttgatttgaaggcaactgaaaagagtcacatgcaagagaaattctctgccttcccactatagtctaaaaaacaggacataaatttataaaagtctcttgtccattctctaccaggaaggacaaatggtggtgagcctgtagatgacttgcatcccaatcattgctgtgcggtgtcctgaccatatttggtgtctcctgatgccttctgtactgatttattaaacatttagctgtacgggaaaagaaaaacaagctgaatatttcaagcatcaggcaatgtactttatataggttatctcctacttagtgagtattgtccccaggtttcagggtgaggaaatcaagaccttgtgaggataagcaacttgccaaggatcacagagctggtaattagtggacctcattctcaaaaattaggcctctctggctctctttaaaccacaatgctgccttgcacaaatcaatgtcacaatgacttgaagagggacttccagagtggggctgttgcttagcagccagtcttagttacacccttcattttcttggttaaagtccccatgtgagagtggcaactcatggaaataatacatgagagatccaggcttactggaagttcccctgasgacctgttcttgcccagaacgactgaggaatccagaaggtccatgctatcttctctacctgggagcttgagaggcaacaaaaccatatcatggatcagacagccatacatctggaactttggtaatggtaatcatgttcttggactctagtagatgtatgaaaactcatccttttagcattggagtctaactggaaagaagtagaatattcacaaggtctctgattacacaagttctctgattctggatggaggcagagagagtgttccactcaccaaattatttgtttcagcaagggccagctcccatcttaataaacctgcactgtttcttcatttgcacaaagataccattggagccagctgcagccctgggcatggaggtggtaaagtggaagtgccttaatatttgttaaataccaaatataggttagtccctcactgtatacgatttgtccttgtgttagctctgaaattcttatggcatccttaggaggaaagaaatgattcatgccattttatagataaaccaaggcttaggaagtttaagtaacttccacaaggtcacatagttagtcaatgacagactaatacttattgaaagccagtgctgagaaatttcaaagcctttattcattcctctaccatcagatggtagatgtaggttttaagaaagtctggaagatagtatgtagaaattatattttcctcctctctttctctcttctccagaatagagatctctattctcttggacagggattctcaatcctgctttgagtggtagattattttataacactctatttattatcctaaaattagaattaattcatggataacataacctactacatataatttcacaaacaacttggtataatgccctaactataaagtaaaggagaaaaaataatttctaacaaaataatatggatttcagtacataaatgtttagatgtaactactttagagacaaagaagtagtcagattcttgcaccatatgttgtataatgaattagtccagaattaagagatcagaagtcctttcatacaagcagtttaggaaaataaaagaatagagttataagtggacaccagaacaaaaaccagtattaggagaactaataacactccagatttaccaatttctgatagcagaaaaaggtaaatagctttagttgaaataggaataatacctagacaaattacaagccattgaaatgaaaagaggaagagagtgtaaacatgctgtttttttactgatgcattatattttacctatttatggggtacatgtgatattgttacttgcatagaatgtgtaatgaccaagtcagggtatttgaggtgtccagtactttgagtatttgtcacttctatatattaggaacaattcaagtcctctcttccagttactttgaaatatacaatttgctatcaataaccatagtcactctgctgttgaatgacagaacttacaccttgtatctaagtgtatgtttgtacccgttaacctatctctcttcatcccccaccacccactcactctttccagcctctagtatctaccattctactctctattctctacctttatgagatcgacttttttagctcctacatataagtgacattgtctttctgtgtctgggttatttcacttaacataatgacctcgggttctatccatgttgctacaagtgacgtgatttcactctttttttataaccaaatagtatttcattgggtatatatactacattttctctatccattcatctgtttgttttata

SEQ ID NO: 10745 - DNA, 215281 bp, Homo sapiens
  misc_feature (1)...(215281): n = A,T,C or G, or insertion/deletion polymorphism (see Tables 1-2)
ggttgcttataatagtgttggtaatgttagaagtagggtaaaattagctaactgccttgtcactggggcaagcgttcattttacgggcgtcaagcagcctgtgaaaccactgggtttcaaaaacccaccctccttgctgggtgcagcatctgttctgctgtgtaagacaccagaatcaacagaggccatcacatgtgctagagagaccgattcatggtggggctccgggagggaaagtgcacccacagccgaacatcaccattgcacatcaccattcccatcgccagacaattgctcttgacacatgaaaatacgtcctctgacatactttatttatttatttttattttattttattttgagacggagtctcgatctgtcaccaggctggagtgcagtggcgcgatctcggctcactgcagtcttcgcctcccaggttcaagtgattcccctgcctcagcctcccgaggctggctaatttttcttttttttttagtagagacggggtttcaccacgttgcccaggatcgtctcgatctcctgacctcgtgatccgcccgcctcggcctcccgaagtgctgggattacaggcatgagccaccgcacccggcctattttttactaattattttaactttagtaacgattgcagccaggaaaaataccttagcaatttcttagtccagactctcagcacaagtgtaaacaggcagcaaacaaatttaacactgattgatgatgacatgacaatatgaaagggcaaagagacaaattattgagaagtggtggtagttagaaatcatagtatttgacaatttttcgtatattttgcaaaggaagtttaaatgtcattaaaatagtctttagtgcacaaaagtaataggaaacacaattctgaaactttgtaaaatcttaggaaacatcaagatgactaataaaagtgatcgctttaaactgtatggactgcaactaaatttttataatctcgttgaaggtgaaaaatgtgttatatgctaaagttatccccaaatagggtatctagccttgcaaggtgataaaagaaagcagaagactgtaaatggatgcggtggtcttttgtgtaaactagagtgtatattcaaagaccctatgccaaaagcaatcattgttatttgtaaaatcattaaattggccatcgggaacagatgggtacagtaccataaaggtacacctcattcctgcctgaaaccatattgcgaaagatgaaaatctgacatttatccattcagttattaattgtatcctgtgctgtgcagaagagaaattaagtctggaggagaaggaaagcggttaaagaagagctttagcggaactgagctagcaaagcctgagaacattgcctgagagggtggaagtatgggtcatggccagtgagcttgcagggcacactccttcatcttgccactgttgcttttcctgaagtgaactgcagtttctaagggaagatgcacactcttgcatcatcaaatggaggcaactagaaaggaaactagacctcatctgtgactttcttcccctcactttactttcccctgagaaccaaaaccagggacgatgtcgttttgttcatgactcctaaatgctgtcatatttaagtatttgttctccaagttttgagtgagttctcattttgcttttccaagagaggcatgtcagataaagattatatttgctaccttcaaactttatccttatccagtgtagctgaaagccctttaaaaaggcaagttgctttctgaaaaaaacaatgagtctaagagagtcttagctaaatgtactggaaaaatatgtccatttgattgttaagaaatagactagtatgtccaatccatataaacacacatctaaaaaaagatactttaaacaacagtaaatcatagatgctatttaaataaaattttttgtaccatttttaatggttatgtacttttttttatttgtttgttttgttttttgttttgagacagggtctggccctgtcactgaggctggaactcaacggcatgatctgggtgcactgcagcctcgacctcctgggctcaagcagtcctcccacctaggtttcctgagtagctgggaccacagatgtttaccacctaccaccattcctggctaatttttgtactttttgtagagatggggtttcaccgtgttgcccgggctggtctcaaactcctgagctcaagtgatcctcctgccttggcctcccaaagtgctgggatcataggcatgagccaccgagtcgggcttcagatgtacttttaaaatcaattatccctcaaagtgtagtccctggttgaatttgtatagaatcacttggggtattatttaaaagctgacatttcaaccctccaccccggatatactgactcagaatctctcaatttagggccctggagtctatgtttagtaaagatttcaggtgtttctcattctctgcagaaaaacaggaaaaaaaaaaagaaagaaaagaaaaaccaataattaaaatacaaggaaaataataatttttggaaactgtgaaagagggctttattttgtgtgatttctccagaacctgaccaagacaaccacacattttggtctatctttgttcatgtagatataaataagagataattaaggtgcttttctactctctttgttaaatgtgtgtttgtctatttaagtcaaaccaaagtcaatgtgaagttaaattcttctctagacaaattcggatcatgggggtcaaggagatttggagaaagacatactaagtaccgtcttactagctgcaccygagggtcctacccctttatccatcatttcctcagcatactcttagggttctcctcccctgtggttggctttcatgaacttagattgtggcttacctggtaatgtcaaaagtcagagaacttccatgtttcagtttgcaaggtgagctgcataataagttgggcatacatgggcagaatgaaaacaaaacaaaacaaaaaaacaccgaaatttgactgttattctgactttactagaatgctttccttttaaaagttactttaagctgcaattaaagtaaataatatgagaaaggcctgcgtaatcacagaggatgtctgtgattattctaaaggaagaaagcaatataactgcaaatattattttaacatatttataataaggtggctctatatgtttaaaaccaagttttctgttaaactgactgttctcctttgtggtttattacaaaacgcatttattcatagaaatgaatatgctatggaacccatataagtagcacacacactgctttttaaaaaaaaaaaaaaacggcaacccctgtgaacatccaaaggctgtttttaaaagctcagcatgcttgtccttgtgatttcactttctggaatatgcatttcatgatatgacatgcaaaattataaatcaaagttacctaagaaaatgtcggtgtacataatatctttgccttcaccaagaccacatatttgcttaactttaaaattccaaacaggccaggcacggtggcccacgcctgtaatcccagcactttgggaggctgaggcaggcagatcacgaggtcaggagatcgagaccatcctggctaacacggtgaaaccccgtctccactaaaaatacaaaaaattagttgggcgtggtggcgggcgcctgtagtcccagcaactcgggaggctgaggcaggagaatggcgtgaacccgggaggcggaggttgcagtgagccgagattgcaccactgcactccagtctgggtgacagtgagactccgtctcaaaacaaaacaaaacaactccaaacaaacactaggaaaggatcccctacagcttttggaaatgtttttagtaattcacaaatgaaagtgacaacatttagaagacaatctcggtattcagacatcattatttattgacacttggctttatacacatgcctgcttggggtcattatagttagcttctttactcttcgttaatattatgtttaacatacttaaaaaatatttccatttgcaattctgagcaattttaaaacaaatcattgaagtcgtgtaagcttatgccaaaattactaggtttccagcccaagtaaagagtggccccaacctttttggcaccagggactggtttcatggaagacaatttttccatggacctgggggtagcaagtgatggcttggggatgaaactgctccatctcagatcgacattagattctcataaggagtgcgctacctagacatctcgcatgcatagttcactataggactgaagctcctatcagaatctaatgctgccactgatttctcacctgaggcacagctcaggcagtaatgttccctggcctgccgcggcccagttcctaacaggccactgtcattgtgaagagtttcaggatggtgatggcagaacaggccttctaagagtgcgactgtaccattgtacagcttgcatgtccatgaaactggctttgcctatagaaccttttgaacaagatgaccctgattttctaattcgctgagaaacacaccaaggccaattaatttgactggcctttctgatttaagctatgtgaagaaatacacatgtaagatgatgtatttgaaaagcactcataataggatagctgcagatggctgtcattgcaatttgttaacaggcagatctcaaaattgcagagtggaacctgtgtataagaatagggaaaagggtgggaaattgcaaaacaactatataggctttgtgcaaagaggattccagccttctgatgtagctttgagtagagcgagtgcatctagataccctgactgtgcttagctgggtgcttatagagatcccgttttcgaaggtgaaagtgcaattgggtaggagagggtggagatgtcagagcaaaggaacagcagtcagttgttgtccattcgaataggagtgtgcctgggtcttttttctctgggctctcctacctgcaaggggactgtcacttcctgatggggctcaggggagtgtagagctttgttacaagttgtgtcttatcaatgcctcctgtctttctgtggcaggatcctggctggggagggagaatttgtgtgctgagagaacactagacaaaaacgacaggagaggacggagcagccattccaaagctaaaaagcctgagtcaagaggctcgggcaaatcgtggggaaagaaagagattaagacgcaagtctatttagaataaatcactcactttggggcgtgcaaggcttactagaaaaacagacacctgaggaaacaaggcgtgtggacctaaaggtggttagctatgcactgagactgtctccagggaaaacagtgcgggagggagggagggagggatgcgggaaggacggaagaaatgcaagagggagagaaggaggaatttgtctccgggacactgtagggcaaatgtccacgctcccctccccgtctgtcttactgccatttgttttcttcacttctttccactacctgggcaaaggaaattcgaatatgtgaaagcgtgggaaaagcctggacccaggggaggtcggggagaaagcaagccacttaggggcgcggggtcaatccccaggcaggtgggacgcccctgggggtcctgaggcctcttccctcctgctgaagggagcacccctcctggcaggcctggacctgctcacaccgacgtttacctggacggagggggaaggtgggaggggcaggaagcggttggtgcgaacgggagaggcgcctgcgtgggagctgggcccctcgagacctgcgcggcgtggaaagccgctcggcgtcgccctcccccggagcgcccgggctcgcagctgacgagaccggcccatgggccctgcgcccggcccccctgtcactcacacgccttccagccaatggtgcggcctcctgtccccctcaccccacccctcgagggcgagctgggagggaggtcggcgaggagggtccggccggagttgaaggattgaactttccggctcagtcgcggcgtctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggctgcctggcggccggccccggcgcggctgctgcgcggcggctggacgagtcgctgtctgccgggagcgtccagcgcgctcgctgcgcctccaggtgcctgagcctgcagatcactcgcatctccgccttcttccagcacttccaggtacggggaggcccccgcccgggttctttctggggctgcggccgcggcgtgggcgcaccggggcgcgcgcctcccagcctgggctcgcaaagttctcggccagcgccgccggctgatcctggcttcccctgggcgtggatcttacagtcggggtgctggaactctcctttccagcctcttcccggctcctgaaaagaaaaagaagcccgagacatcttgccccaactccctccttcccagcaggaaaccaaaggcgatttccctggggagggagagtcgtggatgctgggagtgggtgtgtggatgtggcggtttcccgggaattggagtgcgcgagactccgggcgggcggcgactcccgcaaagtcccaggcgctccggggcactgggagggagtctgggaggcgcgtccggctgcgcctggggacctcacctcgagccccagccccgcaggtgcccgcgggccgacactttgtctcttttgaaagatggttttcactctctgagggctcagagctcgctgcccacccttggagccccagccagggtacttgtgccaagtcgtgttccagggtgcgtgtatgcgcgtgttgggggtgcgagtggctgtgcgcgcctcaattcggaaccccaaagattcaaggtcttgccctggactagcgtagagcgtcagggaagaagtgccggggacaggggatttggcggggccgtattcggatactcctcaacgagtcccgggggaaccgtcccccaaaccccgaacgtaggttctttcagcctgagggtggggagtatgtgtgtgtgcgcgcgcgcttgtgtgggaggctccgggagccgcgcgcttggctccagcgggttgccgggactctgccctgtggcgcggacccccgcgggacttgcgcgaggctccgggtgcgggtgggcgcacgagagcaggttccggactcagcgcgagcgagtgcagctgctgcctgtaccagccctgtcgagcgtgcgagctctgaaatcctccgcttatttttctcttctctcatccttctctccttcttcttctcgcctctatccctaggtgcccacctgttccaagttcccaatttctcgcttcagggaaactctggagggaccaaaaggagaaatgggggctggggggagggggtcccctggctgggcgggaactggaagccaaacccttggctcttaaactgggcgcccctcctgccagagctgggtcaaggggtgggggggggggtccccctagaggccctgggaattaagctgccagaggaggccatattaataagggtggaatgtggaagtgattccccttaccctcggggatgatcttgaaccggctggtgaagctggcgcgttcgcgagtgtgcagttgagtttgttctaagtcgtagaagcagcgtctcgtgggtgtcagagaaatgggcacgctctgtagtccttctgcgtcttcagggaatggaagacccagtgctcacctcctgtggtgaaattacccagacatcctggacagagccaggagagggccgatccccaggcacctggtttccagccctccgagtcctaccctgaaagtcactctcctaagatgccacactattgtttgaaacaacagaaaacaaaacaaaacggagcagcctattcccagggagaaagagtaccttttttttttctttttcttgaattgtcagtgctgtaatttatttgttttacagtttcagtggctaaagcaccagcttagatgaagccagttcccgtgaaaggcttttcttgtggtctccttggcatgatttctctttggaagaaaaactgctgacagaatgcacattgctagacaatcctgattacattttaattagctgggggtgaaataagctgcaaattactcagttaagacttaataagtgctgtgtttgtaatcaattgcaaagccattctgggagccttaaccctaacctggtaatgcctatctgatttatctaaattgcagggattaagtgtttttaagatctgaaaagccagcaacacattctccttataaaaccccaagcttccctgttccccaccgcttgccttcctttttttttttttttttttttttttttaataattagaaggaagatgggccgggcgcagtggctcatgcctctaatccctgcactttgggaggccaaggcgggcagatcatttgaggtcaggagttygagaccagcctggccaacttgaaatcccgtctctacaaaaaatacaaaaattagcctggtgtagtggtgcatgctgtagtcccagctactcaggaggctgagggaggagaatccttgaacccgggaggcagcggttgcagtgagccgagatcacaccactgcactccagcctgggtgacagagcaagactgtctcaaaaaaaaaaaaaaaaaaaaaaaaaaaggaaggaaggtggagcaatcagtctgcagacaactcatgactgggctacgggaagtcttaagaagattgctttcctacagggtcacccccgcccccaactcctgcaaatgagcccacccataaagctgtctctggagcaggtgcctgtttccatcttctcttgcacggtttcaggccatgtttaaggatgggagaagcttgcctggcctccagcctggatgcccgccaggtatgtggactctcaattatgaaagctgtcaggccttgcctcaggagagcgcaacctatgcactcatggtgtaggcagtgacacagattccctggggcagtgacctgctgtcgtcggcctgcagaggaagctgtcgtctcatagtctgtgccccagttgtccccactgtcctccactgcccagcccttcagcaacaagacagaaaagcagtgggtagatgtgcacacctgacacctccaggtctgcaggctgtttctgccccacctgcacaaagtggctgtcaaccacgcccaaaaacacaagggactcagtactgaggcatgggggtgggaatgcagaccagggatacctgagtaatccaacactgctctgacctggaaaggaagaaaggaagatgggatggaaaccccatcatttcactactgaatgctgcccttcattcacgaaaagaaacagtgcatgttagcacctcctgaaatattagtatctggctccaggatgctttgtccaggtcatttggcatggagctatttcaggctcacaagtagaatacatatgtgcggttagcagagtgaagaggagctgtgggtctgtgaggtatggaacagggaagtgggctttggggctgtgcagacctgctctacacccaggctctgtagcgtcgcgaatgggtagcttgggtgcatcacatcaccttcctgaatgttaacccttcatatgcccagtgggggagagaagcacctgccctgcaagatgcaatcaggatgcaaaacatgttggggtgatgcaggtgatggtaatacagcagctagcactacccrgaagattactaaggagcagccactcttctgggtattttacaagtactactcttttaatccccacaacactcctaggaggcagctactaaattagggaagaactcagaggtcttgaaaagttggctcatcacacagttcattgacgatttagccgggttaatagtgaggatggcttctagcttttggttttgtttctatttttaagattttgttggttagctggataatttacttcaggactgactacctaattttcaggccctggtgcaaaataaaaacgtggggcctcttagcaagaaaaaaagtgtttgttaaaggaaataagatataaaacgttttcctttcttctgccacttgcttctgttaacttgtcatggtgttttaaatttcctatccatgttgttctcagtgaagaaaattttaaagtttaattttagcatgacgctaactcttcttctttatattgtgcaatgccagctttacatgtaaatatcagagcacttaattcctggagggagccctgaaatggccagagggtccaacaggccagactcgggaatggtggaaggaggaagagaaggctcccccaaggctttggggtgtgcccagggaacactcatgtctcacaggcacctagggccttgggctcagacacatgtgctcaggcatgatgctggccaggtcccctcttttgcctgctgctgcacccggggattgtactcttgcctggcacaggtcctctggaaattgagccaggtgcctccccttcataggccagctgctcctgcccccagcagatgggcagctcccaggtttattgcatcctyctcagtggatgtgccattccagtgtctcagaatcgtgctggccacccaccaaacacaccatcatgctactagcatggaatggggacagacacaaccataccatgggacactgtatgacatgcatatggccaaccctgatcttccctacacccatgcccggtccctgcagggaccatagtgggcagggatcatgtgatgggaggtggggagcagaaggccagtggggcctgaggtgccaggtgatgggggaatgggcggtgagaacctgtcctggagaggtgagggtgcggtgggagtcaggattggttctgagctgacatgtccactctccagtgagtactgcagtgtgctattgactcttacatacaaaactcaaactcaaagaatttcagcatggccattgcagagcataccccaagcctaggtcctcttgtgagcatatagtggactgcactgttcatacgtctgtgaaactgacctaatttgctttgtttgtatgtcaaagattcagccatctgggaaagtttaaacctactttggagtggcggttcctcatagggtcacctgtaatgttaaagggtacgatgctgacatatgctcacttagggagaaacatctctcctcttatgttctcaacttctctagaagattaaagaagaaggaaaggagggaggtggtgcctgagataagccctgtctctttataggtgactcttgntgcatttgagagtgacttcatgccctatgcttcatcttggacactcctgctcctctgacctcctctgggtctgcccatgatggcacaggtgtagctgagtcttaagctctaaacataatcagttccctaagcatgggcaggcttgggacctgccattggcaatctcagcattggcaggcctgggacctgctctttgtctgcctgtgttttctcaatggaggctcaaaacagtagggtttgaggaaaagtagtagtccgtgggcaagtgaggcgggatgtgtgtgtatgtgtgtctgtgtctttgccagatttcagaatgcccagggagaaagtggatgggatcctgctggaagactaatagcaggttgctggcagcttggccctagggttccagaattgtactgatgttaagagattcttccttaatgggacgttattcgccctataaagtaccaccgataggctccctttggtagctgattagagatcagaggctcttcctagcagtaattggaagctgtttgttttggcaaaaaggagaatgaagctggtgatgagatcattccacttagagggccagcctctcctccaaggcaaagtaaacaaacaattagcgcatcaaaaccccagcagctacaaatcagccccaggctcacagatttcagaggaatggattttgtggtgctcatacccagcctacgatgtgtccctttgctctgtgctgagttttcagttatattgcaggatggccaggcatttagagagccgctgggagaaccacgactcgatgcagtttggtcttggtgtttcctggtctgagttattggctctctggctgcgtttctaacacgttctgaatttgacccaaaagaaaccttatactattcattgcaattttttgtgtttttaatatggtatttctctttgaacatgatttaaaactctaccttattgtgactgtaatagaacatttaaaaaacaatagaaaatacacttactaacttgtttatttctttatgcagtatatcaaatatatatatctgtatatatatatctgtatatatatatctgtatatatatatatctgtatatatatctgtatatatgtatatctgtatatatatatctgtatatatatatctgtatatatatatctgtatatatatatatatctgtatataatattatttatccacatgtgtgtatttggacacctaaattaaaaaggtaatattgttggtgcaagtgttcccacttttaaaaatgtaatcataaatttggaggttatcatatttattcaaaataaattcaccacctttcatgttctcacctaccaggtatgtttcagtgaatgagtataaaatgttggggttaaggtagagagacttatgaaagtgttagggggtactgcttgtattaagtcagaaatggagaagttccaatggattacttggtattgctgtccagaaacctgactctcataccattttggggggaagngaggtttgggacagcaattaatgaagcatatccatattatcaaaaggcatttttatttatgaaataggaatagaaataactgaaaatgtctctttgcagtgccttgtgtaaagtatagaataacataatttctgggcatcatctaagctcacagagccttagggttctgaagtcagctacctttcaacttttccatttaacttaccctggcctccatattttgaaagcaggttgtctatcaacatatggcgtttattaagtatgacctagtttttcctctttacattaatcaaagatagccataactctttcaagctttagattagcattaggttgcccccatgaccagagctgattgataaaatgaatagttatgacattttagttctctttgcaccatcatcttaggaaaatgtgtcattttggggagttttctgaaatattttaaaagaggtgatatacaccaattccttctccagtcgatgcagttgttgacctcttgcctcttaccccaccatcccccggctcctgtatcagctgctaatagcttacagctgcttccttttaagggaataacctttggccgatgggcaccatcttgcttgcaaggtcatgcatcctcctcccttgatgtgcgcagaccatggcgattggctctctgctcaggggatataggaggtcagccccctgctggaatcagctctgtaatgcaattcatgcccaaaagcatcgcatgggatcaggcttatgcagggctctggctgagagcccatccccacacaggtcttatctctgccttctcctgcttcctctcttccctcttctactgagagcttttctctccgccccaatattacctcatgtccgagaaaccccatttcaacctctgcttctaggaaacccagtctaagacacctcccttcagaaacacgtggttccattcaacacttttgttttttctgatcagacaactcggttcttatagaaatgacctgttcaagctagtaggtagaataagtaaaaatataasttagcttttacactctcagctaagacttcatttactatccttcaaaaaattgagagggtatacaaagtttaaacatcattttaaataaagaaacagattcagaagattttctgttacttgaatttagtttctagctcctgatgacttcagtaaaaagatttcaattcttggacctagtaggtaagcacatcatgctccctcattgttgagaattcaatgaaatgtgaaaatatgcactgttcaggcaagcttgaaatagctgtagggtaagtgggcagtagctggagtgagaggacatcattaacgacagtactacatggcaggtctaggaagaaggcaagggagccccaatagttcaggtatcagccaacattggatttactcagcatgcaacyagtggagctacaccccaaaaaagctacatcctccaggacctgcaatcctttgtatattttaaaaatgtaatttgtgtatggtttcaaagaggtgaggggagacattttccctgatggtaaagagggttggataaaaatagttatacttattagccaatatgtaaaaaatgcccagaaaggaacaaatgtagcatttgtagattgttttcatgtaaatcactgtctgcataggtgctgaatctgtttctttctttaaaaagtactgatttatttgcatttccctgatcactagtgatgttgagcatktttttcatacgtttgttggccagttgtatatcttcttttgagaattgtttatttatgtccttagcctactttttgatgggattgcttgttttttcttcttgctgatttgtttgagttccttgtagattctggatattagttatttgtcagatgtataggttgtgaagattttctcccactttgtgggttgtctgtttactctgctgactgttctttttgccgcgcaaaagctcttcagtttaattaagtcccacctatttatctttgtttttgttgtgtttggttttgggtatttggtcatgaaatctttgcctaagccagtgtctcaaagggttattccaatgttatcttctagaatttttatagtttcaggtcttagatttaagtccttgatccatcttgagttgatttttatataaatgagagacgaggatccagtttcattctcctacatgtggcttgccaattatcccagcaccgtttgttgaatagggtgtcctttccacactttatgtttttgcttgctttgtcgaaccacgatgtggtaccaccttactcccgcaagaatggccattatcaaaaaatcaaaaaataatagatgttgacatggatgcagtgaaaagggaacacttctacaccactggtgggaatgtaaactagtaaaacagtgtggaggttccttaaagaactaaaagtagaactaccatttgatccagcaatcccactactggatatctacccagagaaaaataagtcattatatgaaaaaagatacttgcacacgcaattgcaaaaatgtggaaccagcccaaattcccatcaatcaatgagtggataaagaaactgtggtgtgtatgtgtgtgtgtgtgtgtgtgtgtgtgtgtgtacacacataatggagtaccactcagacataaaaaggaatgaactgatggtattcgcagcaacctggatgggattggagaccattattgtaagtgaagtaactcaggaatggaaaaccaaacattgtatgttctcacttgtaagtgggaactaagctatgaggatgcaaagtcctaagagtgatacaatggactttggggactccgggggaaagggtgggaagggggtgagtgataaaagactacacactgggttcagtgtatactgcttgggtgatgggtgcaccaaaatctcacaagtcaccactaaagaacttacttgtgtaaccaaataccacctgctccccaaaaacctatagaaatgtatttttttaaaaagtactgatttaataagttgcatttatttcagctaatatcagtggattgttacaattccaaagatgagctaaaacctctgtacatgaggaacttagggtctattctaggctaagacttgtttgtaaacagacaagttcagcccaatagatggagttttttgtatgagatctcagaggagggagggtgtttatctttttagggaaagtctcataactgctagctgagttattccagcttggaacagcatgtgtataaatacagagtcttgcaacagtgtggtctgttgttggggaccataacctaaatggccatgatatagcatcagcctcccagctagcagccagactttgggaacttgttagagaaggaataaatagccacaaagctcaagtgctttgttctgcaaggcaggttaagagcatgcccattgtaacatgatgccacattcaagccacaacacttagggatgtgtgtcttgctggttcttgctaatctggttgaatttcaactcttaatgcttttcagttgatctctatggagatccttggccacacctctaagaaagagcctaagaaagaagaagggaggaaaaggaggctatctcttggcttgcggttggacacagcttctgaattagtggaaattagaagctctccggaattcctgagccacaggacagaaggcatttagcattgcattttacagtgttttggagctgacacagttgtttcacataaaatatctatttgaccatcacaactactctgtgaggtcaggaatgttatttttctttacagataagaaaactgaaggcctgaaaatgagataaccaaggatccatagcagaaactcaagccctcattgtcacattcctagatatttgtactgaatgactccacttcttagtatgttaacagcgagagaagacagaggggaaacagcacctatattatgatccagagacactcagttgtaagggaactaggacgggatttctcactggcttctggaggcagttttgcaccacagttgcacagatgaggacaattgaaaggttgctggtgtgatagaaaatggcttgaaaaatatcagtccatcaacaccatcccgactggtggtgcacgtacccacccaattcattcttctaaccaataagaatctgcaaaacacaaccgtctttcaggtatcttagattgtgaggccccagcatatgtgagatgtgcttcttgcctccaaaacaattactttctttacaaattttttgtttgttgtttacacaaggtctccctctgtcacctagactagagtgtagtgccatgatcatatctcactgtagctttgcactcctaggctcaagaaatcctccctcaacctcctgagtaactgggactacaggtgtgttacacccccgtacctggctactttttttttaagttttttgtttttgtttttgtttttccccagagatggggtcttgctatgttgatcaggctagtttcaaactcctggcctccagtgattctgttgcatcagcctcccaaagtactgagatcacaggtgtgagccaccatacctggccaagagaattattttctactggagagaaggacaaacatttaataaaattgctgcaagttgttgacgtgaagaaagaaactattaaaaccatgaatcgtcttttaaatccttacatatagtaatttaactcatgatcatggatattgatatttttcagatgaagaatgtctttttttgtttttgtcaattgcttttttttaggcctatccaattttccatgcatgtaatgaaatagcagagttttatcgagattcttggggaagcgttccaagcagctggagtcctcgacatcacaggggatgtttgctgcctgcaacaaaagttgcggtgtcctcattcttggctgtgttgctgttgtgtatgttggtgggacatgtgtggagtcattgtgcatggtaattgtagcttgcatgtatgtgacagccatttccacgagctcagtgtgcctgacatgcttgcttcattgccttttgtttgggttttggttatgtgtgtgtgtgtttacactttataattctttccggcatctctgcaaaatataaaagttaggcaatgaggaaatctttcaaaaaaagaattttgaaaattctcaaggctgcacatgagaacaagatggtaaagatgtgaagttttggggttctttaatccccgaagctttaaaacctctcctcaggggagtctgagaaacaatacccatcaaaaggcttgaaaagaatccggcaactaatcaaggctcttaattcacattctgtttacccttttgttttgaattataacttttttattttcataaggttttttttttgcttttcaagttgttaatacttcagaaaatattttcttagtgagctcaaaaatatataattttgtgtttcacattaccctgattcttataaagataacgcagatatgttgttaccatttaaaaagtcacataatgggccaggtgcggtggctctcgcttgtaatcccagcattttgggaggccaaggtgggcagatcgcctgagtttaggagtttgagaccagcctggccaacatggcaaaaccccatctctactaaaaatacaaaaattagccaggcatggtggtgcgcacctgtagtcccagctactagggaggctgaggcagaagaatccctggaacttgggaggtggaggttgcagtaagccgagattgtgccactgtactccagcctgggtgacaaagaacctgttgagttctttgaagggttcattcaaggaaagttgattaactcttgtttaaatctctaatagggcattattgcaagagacagtccatctagacttacacaaatatcccagtccttgtctttaaatgcctacactgttggaagtaatgacactcttctgaaatgtagactccttgttatactgtgtataccagaaagaaagttgaccaaaacctgtaagcctaaaatacgggagagagatttttaacagaatacacagcttatattgacatgtgtcaccccatcaactggacaggtccagagtgttgttataacaaatccagtatgccaaggaggattgcatttcagggtcattagtttgctttccaactgataggactcccgcagaatgcaaattgcaagatcctttacaatcataacgaatagtgataatagaatcatccccacaattggaagtatacgaatattttctgagaactctgcaccaacaatttctgatgcagcgctgagatttccactttttcttcttcatggccagatacttttgtctctgccaactgctgttttatccctcgcttgatggtcatttctgcccagtggacagagttctgctcacctagaggcgtaattgtgcctaaaacaaggagcagagaaccacgtagctgtaaggagatgctatggcaaccagacatcagaggttacctattcctgcccaacagtcctgccatatgaatgacccacataaaggcagaattacaaaccacaccacagcattggcgcctggcccctagagttgaaaccaatcctgttgatgccatgaatgccaagttcatgcagaagttactgactcctttcagatagaatgagaagaaaatgggaggccagttgttgtgaacatgttttgacaactgtgcttcttttaaatttcatctgtggcaagaagggacaaagacgtcacctagggtggtgtccaccattaattgtttgaaggtgggcactttgttccccattttcttttccatgttttgggctactaaagctatttggggccaggcatggtagctcacgcctgtattcccagtgctttgggaggctgaggtgggagaatcgcttgagtccaggagttcaaggctgcaatgagctccagtggcaccactgcactccagttgggtgacaagagtgagactgtgtcctcaaaacagaaaagtcatttggaactagaactttgcctttaaaatctaaaatatgtgtcccatatatccttgatggatagtgccatcatatcttttgcttaatcatttattttttaaattttgaatttttatttattttatttatttacgttttgagacagggtctcactctgtcacccaggctggagtgcagtggtgcaatcatggctcactgcagcctcaaactccctggctcaaggatccctccacctcagcctttcaagtagctggtatacaggcctgtaccaccacgcttggctaattttttaacagtttgtagagacaagttctcactatattgcctaggcttgagtttttattttttgaaaacagagacagggtctcactatgttgcccaggctggtcttgaacttctggccacaagagatcctcccatctgggcttcccaaagtgctgggattacaggtgtgagccactgtgccaggtcagcccatcatatctttgagtagaaatgcattgtctctctcttctcgctctctcctgatctctcttttctttccccctcttccctctccctttctattttgacatttggctgtaccattttgaaagcagtayagccaaacctagtggtcatcattccagaaatggcctacatctgggaagtatttttttttttcccattgggccagaatttaaaagaaagtagagaacatcttttggttgtttttgttgtttccacatttttgtatccggagttatgagctaatgccttcacagctgcaaagaaattttttaaaaaaaatctggatagaatatattctctggttatgtatcacaatcaccagaaaaacaaatatagactagtcgaccatctgtaattttcatttttctattatccaggagccatagatttttgcaatgttttaaacctgtttttaatagggcaagatttgcatactctagttcactttattactccacaattttgaaaagaagatggaggttgcttttttacataacctcatgaaattagggctagaatttaatttccatatattcgtctgtgtgtatattatgcatgcgtttctagttcagggtttgtcaacyatgacactgtggacgttttggagcagattcttctttgttgagtggaggggctgtctggtgcattttaatggttccacagcatccctggcctctccctactcaatgccagtaccatgcctcccaccttcagtcatgacaaaactgatgtctccaaacatagcagtatgtgaatatttgtatcgggatatccatatctattccatctgtctctgtctctgggtctctatctctgtgtctgtctctatctgtatatgttttgcttccactctatggcaaacatcctggcagtcatgacatggcttagcttcttgttctcaggaaacactaagggtctgtgctgtgtcaggctctttgctaggcgctggtgttgccaagatgaccaaggcacgtgccttcattcccaaaggactgtgtcagggaactggggtgcacagacacaaatgaggtgtcaggtgtcactagctcagagatgggaggccacaagaggaggggttacagggtgatccagagtgcactgtggatccagatcgctggtgccctaccctggttctgtcccttcctatgcttacatctctgctgtaagtaattctggaatcaaaactgatgctgtgaactctctcgcttatgaggagacatggacatccccattcacagtcagaggagaaggtttgggccctgagatgaccacaaaaggacagggttagcctgacaagttttcatcttctgaataaatgagaccttgtagcattctgttaagtttctctctcctaaacgaaaacctcactttccttgcgtctttggcaaccctgattgtgaagatgtgtcgtggcatgtgagcatgatcatataagtagatggatggttttatctatgagcagactcatgcaaacttagttatgctgcatcttcttctttaaattcacattatcattatttctgttggtgagctggtcctaaggtcttctgtttttgggacttctttgcaagtaaacttcttttcctttctgaagactgttgtctctgccctctctctcagaccgtcgactgccctttgcctccattttgacggtggtgctgcttcattgagttttctgggatgccatgcattttactcagaacagagcctcttacttggctctacagacgcgctggctgtcatcaggttgagttaggcccagagggagtgcctggtgctgatgatcctgggattcaaaaatagtgtggtgcatgcctgtagccccagccgcttgagagactgaggagggacgatcacagcctaggagttctagtctagcctgggcaacacggtgagaccctatcgctaaaataaaatgaatagtatgtaaccctggatccccagtgctctacagtctggtctgagagacccctccacttccaaaagagatttaaaaacttaattttttaatttaagagactctttccagtttgttttgaagtatctagttcaatcagtagagcatgacatgcagatctctcgtgtgtgcttttgttacttaaagatttcccattctgggtggccatggtgggcctgtcatcccagtgctttgggaggctgagatgggaggatcacttgagttcgggaatttgagaccagcctgggcatcagagtgagaccccatctctaccaaaaaaaaaaaaaagaaaaagaaaaaattagccaggcttggtggtgcatacctcttgtccttgctacttgggagtctgaggcagaaggattgcttgagcccaggatgttgaggctacagtgagctatgattgagccactgcactccagcctaggtgacagagagaccctgtctctgaaaaaagagaaatatttcacctttccgtatgatgcataggataagattaagtagatttttaaattgaaatttgaaatcctggataaatattgtgtaaggaaaaaaagtcatttaattccaagtcatctattctactgggaaaacatacctgacttttcagacatccttctaattctgcaatgaacacatttttcttggaatgagttttatttttttgcaaagcagttttttcttggggttattgctctttgcgcttgcatcacatttaattaatcatgttttctcaagtgatccctcattaaaacacactgtcttttgaagtttatattaaaataacccagaatcatgatgaatgggttagaatataagtcagggcataatagactatgaggtactctattttagtttgatgaattattctgcactctttaatgaataacataaattagcataatgaaaaagcatatatcacaagaaaacaatgtgacaaaaatctgacacttagtaaagtcaattagaaggggaaaacatgtatttttagtcattttttttccccttcttgggtgttccctactacaaatgaagctcaactactaagtcctgcatctcctagtttacatgtgtatagcaagatgggggttttgctttaccattaaaacaacaacttctaggacttaccaggcatattccaaaatgtgttgctaaaatattcagtagggaagcacatggaaataatagtttttatctctggggcacggtacgttttttcaattagatttttttttaatggttatagtgataatagcaatagttcccagctcatgttatccggaagcatatcctctccacctactcttaatgcatgtgagtaattagcttgataacttaacattaatccttaacctctgctggtcaacatgccagattccaggcagtaatgtgccttgtgggaatgacttgttatgtataacatattgcacctgtcaagctttgcagctgccaagcatctattttgaaaaataatagggtgatttgagagtgcctttaaagtctgctttgtgcttttgccacacagtcatccccagcaagaaattacatgtttctacagttgttctgtatgaaaatggccagagactgagatgaggccaagacagcagaggccagagaggtctagaccgccctgaatgttgttaccttgagtcttggtcttggagaaaaagaaaccagcacatgcaaagatcaacttactgctttacaaagagggttgttctttctcaatgacaagaatccaataagawacctgtaagagctgaataagggtctcagtcatttatttgggacacttggaagggagagaagagagacatttgggccggacacggtggctcatgcctgtaatcccagcactttgggaggccgaggcaggtggatcacctgaggtcaggagttcaagaccagcctggccaatctggtgaaaccccgtctctactaaaaatacaaaaattagccaggcgtggtggtgggcgcctgyaatcccagctccttgggaggctgaggcaggagaatcacttgaacccgggaggcggaggttgcagtgagctgagatcgcgtcgttgcactccagcctgggtgacagagtgagactccatctcaaaaaaaaaagaaagaaagaaaaaaaaaagaaagaaaggagacatttggagtgtatttcgtgaagtcacataaagcaaaggaagagtaagcatctcaggctttcktggggatcagccatatttggacaacttgtaaaacagctgactgctctccagccccaggagttttgattctacgagtgtaaggtatatcaccagaatttgcaaaagcttccaggtgaggctgatatcactggttccagtaccacactttgaaagtcactgcttcagtcagtcatgctgtcgggcttctctctggtacctttctttgcttgataagaggtgccaagttctagctttggaactgtccattctccatcccccagcttggacattcttctgggcagccctttttgattcaggttatgtacaattgattaagtgtgagcttactaagtagaagtcagtggtggtgtcctcagcagaaacatcattataggctcacttagaatcagtagactcatttgtcaaatgagagggctggagtcactgtctggctgccatgtcttttgaaacatgagttttgattccaccttgttgacagatgaagaggccattgtcaattcctctgaacatatgtgttcagggagagagagtgggtctcctgggagagaatgggtcattagtaatcaaggtccaggtatggaacaaagatcaggaacataaagctgaaggtctcaccagagggtgcaacattttaaaagtagattggttacacctggggagaattgtgtgcttggccaaatcacctcattatgacggtgtggttcttccatgtttattcaagcaatcaattttcaccaaaactggactacttgattctaaacagtttacattatggattacaaatgccttcttatgatacacccacttgctgtcagattgaagtactttatgaaaggaaaaaccattgtcagtgagatggacagatgggttgttacaaaacaccatgttctgacatttgctgggagatggcaaggaggccaaagtgaagaaataaacattgatagtgagttgaagcaaattgaaaaaataatacgtgaacatattaacacatagattattaactgaggtgcaggttgaagtgtggctgaaacaatgtagtatttgtcccatggctttaatttattttagtcgcttccggattgaataatgcacctctaactccatatgttgatgtcctaacccccagttcctcagaaagtgacaaagtggccttatttggaaataacgtcgttagagatgtgattaattgagatgagtcattctggaggagggtaggcccctaatccaatatgactggtgtccttactgaaaggagaaattttaacacagacatgcagagatgtgaggacacggatgtgaaggttggaatgctgccacaagccaaggaactaccagaagctcaaagaaagtcatggagccaatcttcccctatggcctttctgagagagcatggtcttgcgataacttggtctcacacttccagcctccagaaccgagagacaataaatttctgctctttcagccccctgggttgtggtactttgtcatggcagccgtaggaaacaaagtcatatatttcaatgtgaatttgaaattatactaagaatagcacttgacagtattgcattttcatgttctcccaagtggggttttgatatgtgaatctaatttagtgtgaccttgcattaaacaactgtatagattctattctttacatggatattatgcctttgcaaagacttgaaacaaccatacaatgtagaaattaattaggctgctcttatttataaggcactggaaaccattttctttactgttgtatcaaaacttactgagggattttagaattctgacttctccatggctaatcgcatgattaattgggattaatcaacctccaggtggggccccagagctctctgagaccttctacgttattgaaagtcactccttgtgtgcaaagtggtcatatcactgaacttggcatcttgccagctagactacagccttgaccttggatggtcacaggtggttttcatagacatctctgtgattatcttgtaaagacattattcatctcatttgagaaaagaagacattaatttttctgagagcttaccacccatggtggatgagtagtagcctggcatgtgaaataaagcctttgactttaagtaaggtgtgcttactattaaaatattctttgtgtttgaatcagtaatagttcatacattttttagccttcctgagccccaattgactcatctacaaagggagactgttgaacttgaattgctattaacttgccattctcaggatgtagaattttcctctgactcttgtgttgccactgttgccagtggctttcacatgttattctgatgtgtgacaatgactaacctgatgatttgggacagtcttaggcatggtaattttgaggtttagagctatcattggacacttagattcctcttcagcatggtaattttgaggtttattggacacttagatttctcctccaaccccattctttgcttttcctttctcctcagacattagtggaaattctaagttccccactatatgctcatttccatgatgtggtttgtgtcatcgtcttggtcctgcccttgagtattatggaattcagtaatatgtgtgtgatcttccttcttcacactcaggcaggatggtccctgcattgtgtttttctcttctggttttgatgttttcctttggcatggtaaatgttttggagagagttactagatgaattagttaatcagagaataaaatattagcaggcagaaaatctgaaagttgatcacttgcaactcctcaccccttttcccttgaatggctttgagagatttcgctaggaattcaggatggaaaagtcagcatagcggagtaacatgttacagggacactgtaacctcttttccttggaaagttccctgtattatgagacaatgacatgtcattaacgagttacatttgtcttgttttcaccaagaagatggattgaatggccctcaaagatcttctctgagttgtaatgatatggtatcatctgagtcagaatgctaccatttacaaacattttgagtgggtatttggaatcacttgttgggtcctttttcttatcctggttgtgtttagagaacaggcttggtcagattcaaatagatcttacactttgacagagaccggaatgcccattgatgaaaatactttgcacagaaggactgctggtgaggtagaagttctcagagagctctggactcctatgtggctcatgtggttaactataaaatcggaatttcaaaagccctcataaatttataagataacacggccgggcgtggtggctcacgcttgtaatcccagcactttgggaggccgaggcaggtggatcacgaggtcaggagatcgagaccatcctggctagcacggtgaaaccccgtctctactaaaaatacaaaaaattagccaggcgtggtggcgggcacctgcagtcccagctacttgggaagctgaggaaggagaatggcgtgaacccaggagacggagcttgcagtgagtggagattgcactgctgcactccagcctgggcaacagagcgagactccatctcaaaaaaataaaaaaaaattataagataacacaaataatggttttcaatcatttgtgcataagagcagctattgcacactacctttcccagggtggacaaggttgaatcctgatgtagctaagaaatgtcgcaagtcatagttttagtctatgcaactttagtttctgctaaaatttttcttgatgaatttttagttatatttatttataaaacatcctatattaagaacacaacacctacaacagttaaggaaatacaagacctaagaaggcttcaaaacacttctagttattacgtatcacctaaagtacactatagccagataaatattcgcatcatgtcatactctttgcagataaccatggtgaagaatgtccctggaggcgaaggttgcagtgagctgtgatctcaccactgcactccagcctgggtgacagagtgagaccctgtctcaagaaagaaaagaaaagaaaacaatgtaattcaaagtcatgtaaagttatttaatattgttttctctctgtgttggtcttgcataattttctcctttgatgattttcattattcacaagaactttgaaatgaaattgacatttgttttcttaaagacatttctttttttatggttgaataatactccactgtgtatatgtactgctttttctttctttttttttttttaattacactttaagttctgggatacctgtgcagaactttcaggtttgttacataggtttacacatgccatggcagtttgctgcacccatcaacccatcatctatctatattaggtatttctcctaatgctatccctcccctcaccccccaccccctgacaggctctggtgtgtaatgttcccttccctatgtccatgtgttctcattgttcaactcccacttatgagtgagaacttgcggtgtttggttttctgttcctgtgttagtttgctgagaatgattgtttccagcttcatccatgtccctgcagaggacatgaactcatccttttttatggctgcatagtattccatggtgtatatgtgccacattttctttatccagtctatcactgatgggcatttgggttggttccaagtctttgctattgtgaatagtgccacaataaacatatgtgtgaatgtgtctttatagtagaatgatttatattcctttgggtatatacccagtaatgggattgctgggtcaaatggtatttctggttckagatccttgaggaattgccacactgtcttccacaatggttgaactaatttacactcccaccaacagtgtaaaaggattcctatttctccacatcctctccagcatctattgtttcctgactttttaatgatcaccattctaactggtgtgagatggtatctcactgtggttttgatttgcatttctctaatgaccagtgatgatgagcttttttcatatgtttgttggccacataaatgtcttcttttgagaagtgctgttcatatccttcacccactttttgatggggttgtttgatttttttctagtaaatttgtttaagttccttgtagattctggatactaaccctttgtcagatggatagattgcaaaatttttctcccattctgtaggttgcctgttcactctgatgatagtttcttaggcatttctattgttcctttaaactgtctggcactcagcttccccctaaagttttttgtttttgtttttgttttgaggcatagtctcgctctgccacccaggctgcaatgcagtggtgtgatctcagctcactgcaacctccgcctcctggattcaagcaattctcctgccacagcctcccgagtagctgggattacaggcatgtgctggcatgcccagattatttttgtatttttagtagagatggggtctcaccatgttggccaggctggtcttgaaatactgacctcgtggtccacccgcctcagcctcccaaagtgctgggattacaggcgtgtgccaccatgcctggccagttggttttaaaagtacaggtggaaaataactgctggttacattgaaacaacagtatgttcttcttggatgaatatacttgaagaacacaattctattagtttcaggaaaagtatatcaaagttataatgcaccctaagggtttcaggatctgcctcccctccccaccccggcagacacctacatctgaagatgctcaagttattgaagtaaaatggtgtggtatttgtatataacctgcaaatatcctcctatatatttaaaatcatctgtacattacttataatacctaatactgtgtaagtgctatgtaaatagctgttacactgtattgtttagggaatgatgagaagaagaaaagtctggcatttgctgttctatatattttctttaggtactgtatctacaccctataaaaagataattagtatttttatttattaaataacgtatatttgatcccaaatgcaagtctttgttcagttttcggtgtcatcatgccaaatctcttggacatttacatcataggaaacaaaataatgagcctacttcttaaaagctccatccagagaagatgaaacatttcatcagctcagtctatttatatcattctttctagctcctcaggacctaataactaaagcttaaattcctttgtatgacctcctactccattcatttatttcttcaatcagtaccatttgtgaagaccatttactctgtgtcaggcacgctgctatgtgccagagagccaatggcaaacatgtgctagggatagacactaccgccaaagcttttccaggctggggggcatatgatcattaaattaaaacaacacacataatttgcacttgtccactgtgtgatagagtgcctggggggagaagtgcagaacgttatagagcaagcaacagagagagagagctgtggaagtcagggcgtgggggtcagggaaggcttcctggttgaagtcgcattttctttgaagaaaggacagtatgggaaggctgggtgtctggaggcaggtgtatttctttctatatggtcaaatatttgtttcctgtagaattccattaaatgtgaaatatttgtagaatacagagagacttttttcttggttaatgaaaagactgctgaggatattccataacatttgaaagaaatcttacttatgaacaacaaatatataaagaaagccctcctcctgaaccttttcaatagactttttattttgtagagcagttttaggttcacagcaattgagcagaaggtacagagaatatccacatgctctctgcccccaccatgcacagcctctcccattaccaacatcccccaccagagtgggacatttgtgacaagggatgaacctacgttggcacatcatcatcatcagggtccatagtttacatacgcttcacttttggtgttgtatggtctatgggtttggacaaatatataatgacttgtatctatagtttcatctattgctttaaaataacttacaccaagcaggacacaaaattgtccattcagggtcacagctaattatttgcagtgtcaaagcattgattggtaaagttaaggtctatggtgggtttcctgactgatttctatttcaaatgttcagttccattgttagacactagtttggtatgtattttggaaattgtagactgactagttccttagctgttccatgccgacacctggctatgttgaaggaaatgagtgagatctgttcctgttttctcttttcatatggtgggatctagagaactagtttccatttatctttattcttcccgtgtgtgttgtctttgcatgaatgatgtgttttctttacttgaagcttttgaagagttatctttctttaaggaaaaatcaaaaggctagaaatgaaaagacttggaaaatgtcattgaaataacggctgggtgcagttgattgaacttatataaactctttgaaagccagattgactagcattcatgtttgatctagttaaaccaataaaatacaggatgtaatctttatataattacaaaagtcccactgtctaatcctacctggaggttacaatgatggttctagaggcaaatgtgtttctagcctaatgtactttgactctttatctttgttggctttaagccagaacaagactttattgcaaatactgttattttatctttgttgtcaaatggcttaactggtgaaggctattgtaatctgacgaaggacttctgctggggcagggtattgaaatatactggattcttgtatttttttattgctcttctgctcaaagagtactatatgtaagcaacataggtggatcgtgatggggtagcatctggcctaaacaaagtggccagcattaatcgggggtttattggcatccctgatgctagtgggcagggttcttagaagttcttagtagagataaatagcacagcacatgatgactgatacaggtaaaagcacagaacggctgcaaaaccttggcatgggggcaattattttaagaaaaacaggaaacccagaatccaaaaaggaactatggatgcattttgagggcaaatatatatgtgaatgcatggatgcgtgcatctgtgtgtgtgcatgcatataaaatttccttgtggaaaaacctcacaaataaatgcaaaagatgaatgaggggcttgagaatttttgcaatagacaaatgatcattgaacctaagtgatactaatagttgctaaaattgattttaaaaatggtgaacaatccgcaattagataaggtaaaagagacagactatccacggtaaaggaaaataaatggccagtcaggaaattaaartaaaaatrccaataccattgcccactcatcctgttggcaaatgttgaaaaattgcttccacccaaggaaaaaacagaatggaaaggcatccttttactgcaagttttatttgtattttagtattgctaaaatactgtatcttagtattttcaatactaaatacttttgartctcactataataagactgaatcagttagtctagggtgagtattatccgttgtgagctgggagatattaagtctaggattactcccaaactgctaaagacaatataatggcaaatgacaacaaaatcacatcaataataacaaaggattttttaaaaatcctgagccaaacattttgataaatactttacaaggattatctttttaatcatcccaagcagcctatgacatgctgtcctcactaattttaaaaaatcattctaatcataataattgtttatgcatgcttgccattgccccaaatatttctttgtaatgacagagtttttcattttgtgattagtagaaaattttgcttgaaatgaaaatgccttgctcaacgcaatgtattgatattaattcccaattcaaaataggctctgtggctattggctttcttctcattttgatgggtgtgtataagccaatggtatggggagcattgaattgcaggaaagaaggagagttggtgtggggcagggcaggagggtttacacttgggaaggggaggttgggcagctgaagacaatctctgctgcatcctttgtgcttttgttgttgaagtttggccattcaacatacacagtagaagggaacaaaagaaagctaatcaaggtgtgtattagtctgttctcatgctgctaataacgacatacctgagactgggtaatttacaaagaaaaagagatttaatggactcacagttccacatggctggggaggcctcacaatcatggtggaagacaaaggaggagcaaagccatgtcttaaatggtggcaggcaagagagcatgtgcgggggaactgccctttataaacccatcagatcttgtgagacttactatcacgagaataacatgggaaaaacccgcccccatgattcaattacctctcctagggtccctctcacatcacatgggaattgtgggagctacaattcaagatgagatttgggtgggaacacaaccaaaccatatcaaggtgtgtcctgcacagggcttctcaggactctaatcctttatttttgttttaattaactctctgatatttgctaaattaaaaatattatttccagagataaaatcttgtgtaatgaaaatcctgcaatctactttctatttacctgatctcccctcctattctctgctccaccccatccatctgaactgctgctacctcaacatatggtatttaggactgttggaccaatcttcatctctccttttaaggttataaatctggaaattccttcaaaatcgagtgtgcatcttgttcctttcttcacctgtggcttttcctgttgtgttgtttaccattgaggttaatcactggctttgtcactctgcatattttacttggtttccctgactacaggtttcttaactgtaaaatgaataaatgaagcttatgtcattttgtgggatgattacatggggtgagtattaaaacatcaaggcacatttctgccacatagatttggccactataataataataatagtcaaaggtgtattgccgcgttagtgatatttttgtcaacctgttgacaacagtttctgtgcctacttttggaaccccaggcaacagttgccatgcccacttttggaaccccagtcactcttgcatggcctcagaaatgtgccttctctgtgaggaccaagagctgccctcccttgctaatgtcttacagacaggtaaagaggaaacatggaatcctgtccccagggaaaaatctagttgagcaaccaagacacagacaaaataaagcatatcattcagcaggagagggtgtgataaaactccaaagaggaatccagcaagtgcagaaatagctgagggtcccctgatctcatccagagataaggtcctgcccatctgcctaggaaaagaaacatccagaagggaaggaggtctcacctgtgcccatgtcaaggattctagtccaaggagcagaaccccactgacctgactcaagaagactcaaaaccttccaaccaagatggtgctgaaaaagaccttcaggaactggctttgacctagtctccaaggtctgaggctgtccacttcagccctgagtctctttagaaggtgcctcattgcttcccatcactggttggggaggagcttggaacactcaagttgaatccaggatgtgctcagacaggtgtcgtccttggaagtcctggcaggagccaactctgcacaggggaagcaggggaagctttaactatgaaacccctctagcatatagccctaatatttacttcttctcagccttaactcccaataattccttcacatacctaggattttagccaatcctgtatgaatctacacaccgtgcaacatgctgaggctggctgtcatgtaggaagttcttcaaagctgccctgccccagcccccagcttctgcatgctcaatgcctggcccctgctttttgcagttgtcacactgtttatgaccatcccctagtcagcctggcccctctgaacttttagcttataaccaagccaatggctccctttataaaatttcagttttataaaagggtatgttatgccctcttacatgctttctcctaacatctcattttccggtaattcaaccacgcccatcatttgtctggcattggcctctgcccaatctaattatttatctgatgtaatccctgccaaaaatcataacgaacttcaccctaagctgttcgtatgcgtctccagcttcagaccttactgtctctatgggggacatagatgtggggggagagatgagggcccagatgtggacgtacggaactcagtaggtggtaggtaggttcataggagattggctcaaatcctaagaatgtgtaggaattattgggagttaaggctggctaaaatcctaagaatgtgtaggaattattaggagttaaggctgagaagaagtaaaaagtagggctatatgctagagaggtttcatagttaaagcattcatatgggaccgagatcttttaagccaataatcttcacattgaagaagaagattgccaatcctatacagctgagatttatttagtggtttgggggggatcctataattaagctattactgggaagggacatattcagatatgttattggcagtggatgggcaaaatgtggtatatccatgtagctgaaactgacagtcaaaaagatgaagtaccaatatatactacaatgtacatgaagcaagattgctgtagcatttagcatcaagaagccagacacatattgtatgattccatttatataaaatgtccagaataggcaaatagataaagacagaagcagatttagtgtttgccagggtaaggcaagtagtggggaagacagaatgggagtgattacaaataggtacaggtttctttttgggctggtgaaaatgttctacaattaaatagtggtgttggttgcatagctttctgaatatactcaagttgtacaatttaaatgagtgaattttgtgaattatatctcaataaacttgttataaaagtattttctaaaagatattttttggttcaattttcttttctcataactgcaaacatatatcatcttgctctgtcaatactggtatccttcatattaaaagtttagacgttcaaacataggaaatgggagattttgtttcatctccaccttgaacttcagagaactagaggtcatgacattttagctattgggtgatggtttctgctagctttgctacctattccggcctagcataacctgacttaaaagatcccaaccagagaaaaaaaaaaatcaccaaaatcttagttatgtggaatacagcaattctaatgttcaggataataaatcatagtacaattttatttatttatttatttttttgagatggagttttcctcttgttgcccaggctggagtgcaatggtgtgatttcagctcactgcaacctcctcctcctaggttcaagcaattctcctgccttagcctccccagtagctgggattacaggcgtgtgccaccacacccagctaattttatattttttagtagagacagggtttcaccatgttggccaggctggtctcgaactcctgacctcaggcgatccacccgtcttggcctcccaaagtgctgggattacaggcatgagccaccacgcccggccccaaatatttgttatatattgagtgtatctattgtttcatttagttaccccagtggcctgatgcatgagatattgctgttaggcttgctttactgatggataaactgaggcatggggatgttaagtctcttgtctgtaatcatatgttttgtgaaagagtaagagaaggcttttcacgtgggatctgatgtagtttggatttgtgtgcctgcccaaatcttatgtcaaattggaaggacaggcctggtgagaggtaattggatcatagaggtggatttcctcctggctgttctcatgacagggagtgagttctcacaagatctgatggcttaaaagtgtgtggcacttccctttttgctctctctctctctctcctgctctgccatggtaagatgtgcttgcttcccctttgccttccgccatgattgtaagtttcctgagcctccccagccatacttcctgttaagcctgcagaactgtgagtcaatgaaacctcttttcttcataaattacccagtttcaggtagttctttatagaagtgtaagaacagactaatacaagatctttctcccaatcccaaactcttatttctgtaaattggttgagatcaaaagcatccacaatgcttaagttgtaaatttctcaaaactgctgactattggcggaacgtctagtgttcatttacctgcttcactgctcaacacaccatcaaagttgcctcagaccctttttcatttcagacagcttagaatctttagtattttatatgtctttgtttacatcatgaaatcgacaacaaaatgaaacttacaaacacattttctatcattggaagggaaggacagcaggttttgcaagattgggtatttgttaaaatgcaaatattcaaaaattatatgcataaattataattttaaattagaaatctgtgtatgtgtagctttctaatggatcaatatttttcctttttctttttgcagaacaatggttccctggtttggtgccagaatcacaagcaatgttctaaggtacgtttcctatacctgtatgaatggtgcaaaaaacttttaattttggaataattatagattcacagtaagttgcaaagacagcacagagaaatcatatatgcccagtttccaccaatggttacactttaagtaattgtaaacaatatcaaaagcacaaaattgatatgcatgcaatgtatgtatatgattttgtgacatttatcatgtgtaagattggatttacgtagctaccactgccatcaagatgcaggtatcaatggttctatatactactgtattttattgttgtttgtaattttctgttaaaaaacattaagaagaaaatgccctctggttagaccagagaagatttaatgtattctatttatacttatgttattttgcatgtattttggtttctttgtaggaattgctggttaaataatttgattttttcattaaagagtctctcttccatttttgagtattctttgctgcacactaaagtactataaactttattatgttacttatttatatgtttgatataatacaattcttacctcaatcccaatacaccaaaatctttgttttttaaatatatatatgatggtactctagctccagtctgaagtaggtttcgtaatcaggttatgtaaatgagtaaagtttacaaagtttgctaaaaacattggagcaaaactttgggatcataatagtgtttcataaaattcatttcatggatattacttttagtcctaaaatagaagtacaccttattttataaacaacaagtaatctaaggaatatataataatcttgaaatagcatatttatgaaaaggattattttgtgaaaggtctttcaaatacatacaataaattattatagaataatattcctaaaccaaaaactttgttctaatgatgcatttccacaatcatgctcactgaatacacatgagtgttactttaaaatagaacagagttcctacgtgaatgttaaataatttgatgaagataagctttgcttatctctgactgtctagatactaggcaggaatgaaatgcctggttacggtccacttactctttttatgtaatgtcctaagcatttgttctgtccagacattttctggtattgattatattaattggtcttcaactggaattttagataactttttcatgccatcattccagataaagcacataatgctatgaggctgattaaatttcataagtattctttttgtgcagtgtcgtattaatcgtgtattataggaatgataatttgttacattggtaatacttcttatttaagcactcattttttccatattccatcaagaaattatcttttgcagacttataaggaatttgattagaacaggcttatttgaattactttaaaattattgcagtgaaagaaatttgtacactagggatcatagatggttaaaccatattttgcaaatgattaatcaaggctgccatgagggactttgaatttcacaaggaaagaaagcaatcctttttgtcagaaagcaaaaatcaatcaataagtcacaattaagcccaactgaaactctggaatatattacaaagctgacagaaattgaagggttgtctttaacttgggatccttgggaatctttgggaatgaatcttgcttattaatcagagtttgactcctttggatgttagcatgactggatacctgtgcagataattacaatttgcatttcttttgggattcatgaagtactaggtgggctttttctcttaatgcgtaggttaataaggttactggtaatccgtagtcacatagtcatcagttttacaaatgggaaaattcaggcatgtgcatattgatgatggttctgtaatcactcaacaaaccagtagagacatatacatccctgtcttctacactgtgtttcttacaggccaacaactctagaaaccagtttgtacaaatatagggagagaaaagtcagaaaactcagaaaagtcagaagcagtgttaatgctacaattttccgatgatgtattttaaaagattaggtttgcataatgttttctagaaaccacacactttttaatcacttctggtgaccatctgcaaagcctgtcagctcctccttcagagcccctgtggaatagatctcatctaaccactcttcccacctccaacctgccattctctctgtctgggatgaatccaagagcaacccgatgggtctcctagcttccactctgaccccaaacaatcacatttcctcatggctgctggaaagacccttcaaacatataagtggcatcacactgctgtctaccttaaacctaatgattcatttccgtctcactcagactaaaatccaaagccctattctgattctcactggctgtctcttgactgcctgtgctctgtccccaactttgatgttgtttttgttgtttgttggtttttcgagatggagtcttgttctgtcacccagggtggagttcagtggtgcaatcttgggtcactgcaacctctgcctcccggattcaagcaattctcctgcctcagcctcccgagtagctgggattacaggcgcctgccaccatgcccggctaatttttgtattttttagtagagatggagtttctccatgttggccaggctggaagaaaacattttaactgtagagattcgtctctgtgcttcatctgacttcgggtatgctgggttccacataatggaatcagcactatgagctcaagggtctttagcccctgcaccactcaaccctagagaatatagaagagtgcctattgtccagcacaggtctaggccagtggttctcaaccaagggcaatttcctcccccaggaacaattgccaatggctggaaatatttttgattgtcacagttgggagtgaggagttactggcatctagtgggtcaaggccagggatgctaataaagaacctatactgcacagaaaagccctcccacagcaaggattatctggctccaaatattagtaatgctgagattgacaaactctggtctacacatttgtgaagttataaaagaaattaagagcatagtcctcagcagttttactttatttatgaaagaaaataaatgtgtagtttactgagtacaaggtatgtgccaagcacctttttaggggctcattatgtctaggaattctgattgtcatcatgtactctgtaacactggtgagagagattgctctttgcctgctaatctggtttctcctcttctctgctaatcgaaagctcattcctcacctgagcacattgtcaccttgtgttaaacatctatatttccccaagctccattgcttctaaatatggccagtaactaatttcttgcccaagtggaatcattgtgaagaaatttcaaaatgcctcttttaaagggaactgatttagctagaaaatgcactcatttgttctcttccccttgtctttccctgcttcttagagggcataccaatggcaggggccccagcagctctcttgggccatgaggtacttttgaggatggagtccaggctgagaataactgacaagaaagatagaaggaacctggctctttgatactgtggggccccataccagccttgcacatgaagaggaaatacctttctatcttgcttaagttactgttatttcacatttcttttgttctatgaagatggaattgtgtgtgagtgaaattaatctcggcttcatcttggaatgaccaccttcatgtcatagatgctcagaaaaggtgggtgactttcttacaaagtcactttactaataagtaccagtaaatcccctacacaggatttgaactgagttccggtggaattaaaagccagtgattttctcattgtatacctcacacatatgaagtcttatagaataactttttaaaagttatgaaagatctcctgctcaatttagtggttgattgtcttgatgcactaggttttttttttttttttttttccacccttatagctactgtgaatagtgtaacttcctggcaaaactgtgacccaattctagcaaatgagccatattttctctttcttgcttttatgttcctgttgtctggtgggaagtcagaaagatacagcctaaagatggcctactcttctgattcagcttcatttagggatacatagtagattcccggagaaatagattccttagatattcctccgttaaggtgatttttcttttcttttctttattttttatgttgagagaacatttaacccataagaatgtggtatgcccttggccactccagaataaactgttcgcaaaactgacatctaaacacagtttcagtctcggatgattcagggcaaaccatttatttattaatttagagacggaatctcgctctgtgtgccaagctggagtgcagtggcatgatctctgctcactgcaacctccgcctcctggggtcaagcagttcttgtgcctcagcctccccagtagctgggattacaggcacctgccaccatgcccagctaatttttgtatttttagtagagatggggttttgacatgttggccaggctggtctcaaactcctggcctcaagtgatctgcccccctcagcctcccaaaatgctgggattacaggcgtgagtcaccatgcctggccaagccttttaaaatatatcaaatctatcctaaaaagatgcctttacaatcacttatttttagtagttcaattttagtagtaagtaagtaataagatcacctatttctaatcaagaaagtaaatatacacctttggcataaaaaataatgtattttaaaaattctatctaaatatgttttgcaaacaatttttatcttaatttcctttttttcagtccaagccacactaaatactttttggaatgaaatattactatagtaatgtaaaacatactgataaaacgtgatatatttccattctaataatatttttaagttggtccaatcttaacaatgtacattacttttattttattttatttgagatggaatttcgctcttgttgcccaggctgtagtgcagtggcacagccttggctcactgcaactctgccttccaggctcaagtgattctccagcctcagcctcctgagtaactgggattacaggtaccccccaccatgcctggctaatttttgtatttttagtagagacagggtttctccatgttggccaggctggcatcaaactcctggcctcaagtgattcgcctaccttggcctcccaaagtgctgggattacaggcgtgagccaccatgcccgacctattactttaagaacctattttcattaacctttctcttaaataacaaattactccatgccaaatataatgtaaatcagatcctattttttcccatatattataatgttgtggctgttcagcccttttatttatgtttctagtttaacattttctttaaatgcatttcatttgctcgttccaatagagtctgattaatcccatttcagtagatactcactgagcatctactatgccctaggccctagtgataaagtgatatgaagggtgaacttggtctttgcattaattttttacttttttgctcactgagaaaattcccagatattgttacttcatccattcttaaaaattcatgcaatattccagcctggggcggtggcccacgcctgtaatcccagcactttgggaggctgaggtgggcagatgacaagggcaggagatggagaccatcctggccaacatggtaaaaccccatctctactaaaaatacaaaaattatctgggcatggtggtgcacacctgtagtcccagctacttgggaggctgcgaaaggagagtcgcttgaaccctggaggtgaagtttgcagggagctgagatccagcctggcgacagagtgagactctgtctaaaaaaaaaaaaaaaaaaaaaaaattcatgcaatattccttatgagtccccattactgtaccaatggggacataaccaccttctcccccttactttgcccattagagcatttgtgtacctttagaatccatttctgctttttctctttgctaatctcacaattctaactcttttccatcattctgaagttcctctgtactcacccattaacggttaatatgtgaattacccagtttctgttaggctctgctcatggtcttaaggctcaattctcatgttcgtaacttatttggtactctgggatggaaatatttgatgaagaaagagaaaactatttgagtgagccacagacacatggatcctaggactgactatgttaagagttagatggctcctctcagtaagggaacataggtgatacagaccactgagatcattgtttgcatgaaggatggagagaagaattctaaagctagagagaatatttaggaatatccagtgcaattctttcattgtgcgcttcaggaacctgaggcctgaagcaatgatatatccagccaaagacagcctccagctcagaggaaatgcttattcttacmttctatttttcattgtatgtaatttccctaaaagcccacttaggaatgatttggagcatttgacaggaaattcaaattcatgggcaagatgccctggtgtttagtcatagcacagagtcaaaatattgtaatgagccatgttaacatctatgtttcccagtggctttttctggtagaggaggacaaatatccttctctctacccatcctatgttcatgacttaggtccttttaacacaagatagactaagaagagaaaaacttgcaaatttatttagtaagatttacatgctgtgggagtcttcctaaataaatgaagactccagtaaatggttaattctgtgtatttttatagtagctttgatgaagagtgaatactgatggaganatatgataggacaaaaagggtgtgatctagtgtagataaactggggaatttagcaaggcctgtttgttcaggttcctctctgtgacccttcatcttcagagatgagcatgttcctttcttccagggatcgggaggccctcacatgagtgtcttctgacctgcttcttgggaatgttggaaaagctttcctaagctgtatgccctgcatcggggagaagcatatgtgtgggtgaggaggggaggtcagagagactttcctgcttctgtttttttaatatgccaaggtgccgtattttgagtagtgtgtcctgaatcccatcatccttttcaatgtaacttttcattaaatgcagtgttctaggataagggttagcaaatgacttctaaaaaaacaccagatagtaaccatctttgtctttgcagcccataaagtatctgttgcaactactcaactctgttgytgcagcacaaaagcaatagtagaaaatacatagaccaagaagagtggctatgttccaataaaacattttttgtagatagtaaaatttcaatttcctgtaatttttacattataatattttacttattttttttccaaccattgaaaatgaaagaaccattcttagcttactggttctacaaaaacagatggcaacctggatttggcctgctgctgtagtttgtcaacccctcttctatgacattacattcacacagacaaaactaaacccaaacaaaacaataaaaatgcattcttctgacaatacaaagacatatcttaaaatatttaaagtcaaacaaaaatggacagtttctgacatagcttatagaacattgtttgtcaaactgcagggatttgaaataatgaatagtaaacaatagtgaaaaaaaaacttcaaataaatcacagctaatttttgaaaatccagtgttaaaatgtgatgatcagagtcaagaaaaattgtgaaagatttgaaaattggcaaaagtaaagattatttttctctgtattgcacttctccaagttctgtccagtgttcagtgctttgaactattttcccactctgcaaatggtagaaaattgataatgaaaataactcttgtccatgaaaatgcaaatacattttgtctagtggaatgcacttgatgcttcatccaggaatacaacattttgcatatatttgtaaatccatttcagcaccagcattccttattgaccctattcatccatccatccatccgtccatccatccatccatccatccatccatcttaatctgtctatcatttatctgtctattgtctatttatctatgggatttttcctttgaatcaaatgtaacatatgactatttcttgagttaaataaaatctttggtacatttccatctgatatttgcatgagtcttgtcttcactttataaaatatttctccactttgggagtccaaggcaggtggatcacgaggtcaagagttcaagaccagcctggccaacatggtgaaaccccgtctctactaaaaatacaaaaattagccgggtgtggtggtgcacgcctgtaatcccagctactcaggaggctgaggtaggagaatcacttgaacccaggaggtggaggttacagtgagctgagatcgctccactgcactccagcctgggcaacagattgagactctgtctcaaaaaaaaaaaaaaaagatttctcctttaactttcagctcagagttatgtttcaaaaccttgcatctaacaaacaatggcatgccacttagtaacaaccacctatctgtggggagcctgcatgcttatctttctgcctttgagtgccagaactcactggcttgacttttgttccccatttggtttggagtgtatgtgttgaaaagtggtaatttagggcccagtcttggtgccttggcttacagctttaatctcagtgggagttcagttcttataagggtacaactcctaactgttagtgattttccagctttattcagaaccacgtttagaggtgaggaagattggttttgcttgtgtaaaaatctggacagcttcatttgccatctgtgaaatttatcgagtgagggccaaacctctgaaacacatctgaatatgactgtggaaatttttgttttgtatgagatgctttctgtgatttatgtggtaatgactgtaaatccatagagcccaaggaagacatttcttaggagcaaaatgaaaactcagacatacatgaaaatgcaccatgccccagtacccaagaaccaaaggtgaacgttttttatctgattgcaattctaatatgtagtggatcaaaattttaaatgtttagatactttagacctgttgcaatacttactgatgcttatacaatatctcttgactttatatatgatacatttcaagaataatgttgctgttcaccaagcatctgttgtccaacttattgatctcctttggagcaaacaatgacttcacagccaaatcacgtttgacaatgatttcaggagaagtgcaggcttgtgtaattcaaagagagagatttgtgcagaaaatgtctcaagtcgggtataattaattccccttcattttggatattaatgttattatttccacaagtacatgtctttacttacatgagatcatgtctttatttttcaggagaaaataaatatgatgtgagaataaacattagaagagataagagaaatattctattatttccttaaaccaacattttggtcttaacatttgtgtagaatgcatgcgaaaagaaattgttagtgtgtgtgaggtttcaactagtgttcttttgaaaaagccatcttatgtacaatattatattagcatgattaatataaaccactggatgtaaatttctccaactgtcctatagcatgatgccacaagataattataagtagccttggcgttttgtgcttagtaagacatgaagtctctctctctttctctctctctctcttttttttttttgttttttttttaaagctttattgctcacacagaacctgtttggtagtttcttcacacggatgtgtgtgacaacagggtcttgctctgttgcccaggctgaagtgcagtggcaccatctcggctcactggatccttgacttcacaggctcaagtaatcctcttgccttagcctcctgagtggctgggactacaggcatgtgccaccatgcctgggtaatttattattattattattattatttgtagagacaagatctcactatgttgtccaggctggtttgaactcctgagctcaagccacttgtacacctcggcctttccaaagtgctgggattacaagcatgagccacggagaccggcctgaagtctgtcttaagggagttgatggaattgaaaattaagttagggctggacgtgtggcatgatttataagtaattcatccattgttgctctagaaggacattaaagtggctatcatctctgatgcaaaggcagaaatggaaagaaaaaagaagagaaaaaaatgagagcctgggaaaaagataaaaaaagaactcacaaatagctacataaacaactagtttcaaaacaccatttcttaaatggccaggaaatagtcctgagatttttgagaaaccactgaaggcttccagcagggtcccttctagtgataatgcaggtggatggatgagttaatgatttaaacaattagagatttgctgcaaacttccatctgtcactgccccctggaatgcagactcacagttctaattggagcctccagcattgaaggcggcatgagttggtgtcactgatttgcttcccctgaccactgtcattctcatggtaagcgttttctgccctcacgctgagaacttttatcaaacatattagtgtgcatttgggtgatcattagcctgtggtagctgaaacattccaggttattttagcctagaaactagcctgtctgctgaaagaacatgcaaagcttcctgctaagctggtacacaatcaatatataagggaaagaacgggttcctatttagatttaaatccaatatgtgacaagttaatagctcagtgtgtttctgcttttccatgtcaattttacgggtgtgaaagactcttccacctgctataaacttcaaaggaaaaacatgcggaaggggaaatgcacctccgtgtaagtctttccctaatctcttacgattaatttcttcttccatctgatgaaagaaaatgcaaacgaaatctcttatttggttcacagttgaagacgagttccataaagctgcctttagaaagggaatctgttttgaacatatgaaaaccatctgagtcaagatgcattacatggtgattacagtctgacagatgttttgaagttgtaatgtgttcatcagaaagcacgcagagcagggatgagcaccgcttgtttgaagatgttgaggtttattctggcaactggaaaaatgcaccaatgctgattgaagtttggggacccttatatttgagaaaggagacagaattggatttcagtctctggtagatcagcatttgtgggcattgaacatgagattgtatcatgttgctttatctctgccgtgacagtcactgtcaaaatattctctactggggtagaaaactctcacttgaatttaaggggggtccacatttgcttttctatgttcataattttgactccaccttatacgtaatcgttggaatgaggttcaagtctacttgtctcccgaatcacacataggagttcctcttagaaaacctaatttgtgtttgtgcgtagtctactttggaaacttttcatttctctgtgtttctgaaagagcagtcattgtaggaaaataaatggaggttttaatttaaactcgatttttaccaactgggtgaacatagaaactcttgctgtctcacttgcctgaaaaagagaatatagactaattgtttgaaactaaaacaatttgcctttctcaagagatcttttatctattcaatggggaagaacctgccttgccccataaataatgacattcaaccaccttggcatatttattttccaactaatttaggtctaagaatatccttgtaagattcactactcaaaacatgatgttctttgggtaatcagtgtgtgtgtgtgtgtgtgtgtgtgtgtgtgtgtgtttactggattacaccttctgttttcttctgggttggaaaatgaaatcacgttttctgaggaggatttttgtcagatactcccttctccctatttgatgcatatctatgcaggaagtgggttgcttttttttttaatatttatgtatttatttatttatttatttattttagacaaatgtctgttaggacctttaatttcacagtgaatgtcagagctaatgaaagttttgctagctatgaagtgacaatgaagtataagcaaagccaccaggcatctggaactttccaagtagtagaatatgaaactcatcgtatcctggtggtaccaaaagccactggagagagacagtatttatacctgcctgatggatgtatcacttccaggtgctctagaatctatgccttgattacacggctaagctatgtctttgccatttcaaatcttcctttaacaaatggcttttgctgaatggtaagttgctgcaatgcaatatggatgataacctcagaaattgtcctacaaacctagtcgttggggctgctctaagaaagttgttgaggacattggtctcttatgtcatgccattttggggaggaaacttggagagatattaattaattaattatttaatttttttttgagacgaagtctggctctgtctcccagggtggaatgcagtggcgcgatgttggctcactgcaacctccacttcctgggttcaagcaattcccctgcctcagccttctgagtagttgggattacagatgcttgccaccacacccggctaatttttgtatttttttagtagagtgggggtttcgctatgttggccaggctggtctggaactcctgacctgaggtgatctgcccaccttggcccccaaagcgttgggattacaggcctgagccaccatgcctggcctagagacattcattctgattgcattatcagtactaattgtgcctccttgagaaatgggtagatacttttggcctatggatactgtggattttgcagttaatagtgttttcctcttacaattggtctttagaaagctaaaacttaaatcaaacagcctgtctttaacaagtgtgctgaaattgatcatatgtatttaggaaacttgctttatccttgacagtatttattttctccccattttaatttccctttatctcatttttttttcactcacttaagatgtgctttccagctgtaatcatatgtagctttgtaaattgtcttgaattattttaagagtgagaaaggccatagataaatgcacacatccataaaataataaatcggtagaaggatatcatactgtggctgcgcatgttgccagatgagttgtttagtctcttgaacccttttatccagaatttcatggttaaacaaaatgaagtgacaagacatctatattcataccaaagttctttcagctgagaagtgatgattatgggaaaagatttactggaaaagagcaatgggagcctcttgtaaattaggtaatggctgtaactgagcaagaaaaatttaagagaacacaacttaaattatgaaaacagggagtgcggtagaaacttgtcctgatgggaaatgtggtagtggaacaaaggtggggcrcttttgtttgtgtgggccatgggagccagaggggtttggccctgccttcacagatctcaagtcataaatagcagaggtcaaagaatcgtctttaaaactacacaataaagaaaggacttctctcaactgggtcttttcagagcatagctaccaatgtgggtaagttcattttccatttgtgtgggggaaaatgacttaaagtgtgcactttgtaaatcttgctcgtgcactctttctttctcttcttccctcctgcctttctttttccttccttccttcccttcctccctccttccttcctttctttttctttctttctttctttctttctttctttctttctttctttctttctttctttctttctttcttcctttctttctctttctttccttccttccttccttccttctttctttcttccccttctcctctctttctctctctttctctttctttctctttctcttctcttctcttcttttcttttttctgttcaattgttccctccctccctctctgtccctttttctctctattcttatgggtggcaaatgtttatgttggtttccatgaaagactttctctctgccttaagttataggagccccagctgaaaattttaagcacagagaggtataatgaatggcttctggcttatttaacgataatggaatggccactctgtcgatactgtgttcattatattaatagcaatagctcagttggtgtcaatgtgtatattcctgtgtgatgacaggttgaagaaaacgcagggtttaaataggaaaatgttgctgttggttagaaaattgggcttatgcgaaactgtctaattaaatcatactcattttaactcattgcaagtgactaattctgtgtcaaattccacataaggagcactgtttgcagggagaactgtgagagccgcaggggccaggacaacccctgaactgtgcaagcagagatcatttaagagttgagctgcctgcagatgcacccagattcagccttctgcagacttctcttgtggggctggaayggatccttgtggagaggagaagcgagttcccgagatcttccttggggacgcagctcctctggcttccgcttgctgaggaaggtgggtcttttgatggctgcaagtctccgagttctcacagctgaatggttgaacttggtcagtcgcagatgaatgaacagtgtttcccaagagaaacttcacaatggcttcgggactattaagctgtgaagattcatgctttcgtgtttgggagtgtgtgttcagcaacttttcctcggggaaggcggggggtggggggcaggcattcgaggttggctttttacatccaactgtatgcacattttccctttttgtatgaggaaataatgcctgcactaaggataaccctcccctcctcctaaatccttccacaaaaagatacttattaaggctggcattctgaagaactaaatgcttctttaactttacttcatctgcttcagtgagcacagtgtaccgactctggggaattcacattacggccggcaagcagccttctctattctctaggggctctttgggcacagaaataatcccttcctagaatcttttgaaaaagcaactgaactatgcaggctaatcaactgtaaatcttagccctcttggatgaagcagcaccaaaaagtcccctgatgaccgggaagccctgttgtgaaggcccttcaaagatagcagttccaagacccaaggcaaatttgccacaagtgcaattgtctgctgtgttttcacgtttctgaatgttgccctattccccacatgcatcctgtgcatcctctgcctgtctccctagtttgttttgaggcagaaaggcaataaccttccttagaacttttgttttctggttggtaatggccatgttataagcagacatgagctcagatagaataagtacatggggaggattttctatatttcttctgaatcattttctgcgcagtcctagcatagtatttgtcaggaaaaagtagcatagatcagaagggtgacatctcccagcctttgcgtgcaccgtgctgaaacctccagtgttataacattagctgtcactctgctgagaggttacctcctgatccggacaaaggcaacactagtttgcctgcattctgtttggacttgcaggataatgtcagtcatgcattcgcagcagcagcataaatcaagccctaagatgatttaaagaatagaattgaagcctctctttcacaatcaccataatctaaaggaaatggrggcaatggcgttgctctctgatatttgggaggcagagcaagaattctatttttggccaaggaaatacctcttctttacttgccttgtttctgtaacacatgtagaccgttgcagtattcctgtccttctagattcaactttttactggctatttctgatttaagatcctatctaaatccttgacattgatgtgtcctgatttaaatggacatyttctgccgtttgagtgagaggcacartagagtttggtctttgggcaccagtgttaaaggctgaagggattcactagctccatcacctgggccgagttacttactagtgctccccaaacctgtatatctctctggaattattaatattaattaaaagattaatatatcttaagcacccaagctaaaaaactcaaaatcctccttcatcgctcctcgtcctttacttttctatctagctgcctgcaaagtccttctgataaatctctcaaactgttttgctatcccctctgatatcactgaagcatttactatccctaaaatgtggtaatcccatagccccaatttttctctccatttttgctcttcacagatcccaaggtcttaaagtttgtgcttctcaaactttagcatgctcaagaatcccgtggcgggcttgctcaaatgcagattcccgggccccacctccatagattctgatgtggtgtgtctgggctggggcctgagagtctgcatttctaagaggattccagtagatgatggtccgtggtagccctaacctacaggatcacatcaaatttttggcacatttttcagcatcctttatattgagtctccatctaactttccagatgactctgcttttttttgtgtgtgtgtattttctcagggttcatttttttctttctcattagacaattttcccagactcctcagcatgccacattctttcatacctctttgcttttgcttgtagtactttggagaggtaatacagcgtggggatgaagagcaagtggcaagcctgtgactactaaaattcagttcaggaattaatcagcacattatggcctctctacttaggggctatgtgatcttgagcaagtgattttgttttgtgtacctcgattttgtcatctgaagaaaaatggggcagataatagtaggggccactgtatagattcttgtgatgattaaacggcttaatgcatcccacgggtcttgaacagccatatagcatgtgttaaatctctttgttgttctctttacacttattacattacctgttgctccagtcccttttgtgtatgtgtgtgtgtgtgtgtgtgtgtggtgaaattctcgttttccgaaaaaagccagatcttactttttttttttttcttctctgtagctttctctgacatttatcttcctttagtcccaggaccaattgattaatccttcctgcctgttagccatgacttgtagttttttgcttacatattttttgcaggtagagcctgaaattattgagtcttggaaactcattacccccattcctccttcttagctcacttttcatttgttaagttttaaatatatgccatccatgtgcctgaccccgtgcttgcgaagggttcgtttgggtgatggagtgctgtgtggggagtggattggatataaattcagtcatctgaatcagaaatcttaaattctgtgctctcagaagtgtacccccaatcagtgtgattctttcacttccttatcttacattaggagtaatttgacatttttattacttctggatttctccccaaatatgttgatagtaactttggcttgatctttggtcattatcttaatatcttacatttggttaggatttacagtttgcaaagaattgtcacataaatgaataccatttgcttttaaagcatctttctgagatgggaatggaaagtattcactttccttgattattatgcaaaatgctggacagagtgaccctctcaaagtcctgtggctaataagatgtggggaccatagaatgggccttgatgtccttggagactttgaaagaggagtcttaggaaagcctggaagacagggggcagactgcatgttacttgaggaaagtgtggaaagggagaaatttcattccgggtatggttctcctttcttttggtagtgtggccatgaggaagagaaaaaagagggaagtcaggttttgagaggctgggcaatctctcaaacgagatgtaactatattctcttgaaagcacgtaaatattcatcttcacattttactggtttgtattgatactagttttctttgtcntatataaaatwnctaggtaaatacactagtatagcaatggaaaagctttccttttacccttgcagggttctgttattggggcctataaatttaatgcacaaaagacattaacaggaaaacaaggcaaacaaagcttatttgatgataataatttcacatgcacagggacttcacagaaaagaaataaaaactcaaagaagtkgttagacctagaagtttatataccattttaatgaagggcaatacattgtggagaggagaatagacaaagaaaagggggttttgggctccgggcagtaaattgtgggaaagtgacctagaaatgtatggtagataaggcttgtttactaaggcttgttatgcggataatatgagttatttttctcttcctggtatggaagaagggaacctttttacaaatggaaacttacattgcctttacaaaggggaaatttatgtctgcttttaagcagaaatggggaaggcagagagttcttcctgcatctactgcttctcaattgctctcagctcaaaataatccttatgccaaagtagcatattttgggatggcatattctgatactcttaactagggaatctgtaccatacataacctgatcacatattatgagagttgattagtgctcagtgctagagtgagagaatgacgggaagaaggagattactggacatgagctgagagcagtgttctcagtgtggaaggtgaaatgagcaggtgcctccatgtcacttaagttgtataaaataggagaaataagcacagttgattagattgccttatgtcttcctgggatatcatctgatcgacaactctaaaacttttcctcaccaacaaaaacaccctggttcaaaatttttattacagttgtctgtttggaaatttaatttgaagaaatatcattgaaatatgttgaagaaagttagtgttttatgactattacttctttctaataaacagcttttcttttattataaaagtaacatttttattttttattgtggtaaaaaaatcacaccatacacacacacacaaaacataaaatttaccactgagagctatgatcacatcattgcagcccagcctgggtgacagagtgagaccctgtctctaagaataaataaataaataatttaaaaattaaaaatttaccatgaaagcctttttttttttttttttttttttgatggagtctcattctgtcacccaggctggagtgcagtggtgcgatcttggctcactgcaacctctgcctcctgggttcaagcaattctttctcctgcctcagcctcccgagtagttgggattacaggcacacaccaccatgccaggctaatttttgtatttttagtagagatggggtttcaccacattggccaggctggtctcaaactcctgacctcaagtgatccactcacctgggcctcccaaagtgctgggattactgagcttcagtattcacaatttagttggttagactcttgctactcaaagtgtggtttatggaccctgcagcctcagatcacctgagacgttgttggaaatgcaactggtgagccaccgcgcccagcgtgagagctatttttgagtgtatagttaagtagtgttaagtatattcacattgttgtgcaacagatctccggaactttttcatcttaccaaactaaaactcyatactcatgaaataacaacttctcatttccccctccctcagcccccggcaaccaccagtctactttcggtttttatgaatttgactgtagaaataacctttttgcaggataagacttttttttttttttgcaagaaatccctaaaggtggatattataagcataaataatttaaaagtgtgaaacatttgactctgtgtctctagaggcctaaggatctcaatatgcctacttatagggactcttgtaaagaaaatcaatgtaattattaattgattccccccattccacaaccatcattctaatttccttctctatgaattcgagtactctgagaacctcatacaaatggaatcataggatatttatcctgttgtgtctgccttatttctcttagcatgctttacctcttaaagccgatttttaattttattattattattttcactctgagttgttgaactgaaggttggcaggatggtatcatcctcagtctcttggtctcttgagttggataactacatatatgaacccatgattttataactgtttatccattggaaaggccccttgaacctaacagatgcctgacagtttctgttttgtaattaaagttgtttactttgctctctttgggtggttgttcacttaggggaacattttctctgtagattatatgagccgtggagtttgggtgctctcacagtaagtggtgtgtgtttccatgatggacttctttcatctgctccagtgtttgggtaacttgtttatgtgtctgtctccccagatcgtttggcatctccttgggaaaagaggctgtggattacaactgttggggctcacgtgaactccttaaaaggcagagcaagcttttattcttttctgtgcctttgagcactaagattggccatgctcagtaaagggaattgaagtttagagaatgtgaaatgggcgacatacacaggttggtctaggggccctttcaagttctcccaataacccaaggaagtagctgtcattttcctcattgtacaatgtagacaactgagggtcagaaggaataatggacaaggttcccaaaatttgtcatttggggactacattgcaggactttttgtttttaaagcccatgttctttcttcatactttaaatttctgttcttggcatcagaaactgagtagattctctctccaagtatttggaaaggaaatataaaatttaattttttcatcatactgaatattgcttctttcagatcatctccctacatgtagaaccagaaatgaagacattggaatctctaggcacttggggttcaatctcctttgaaattctcagggatattgtttgttttacacaatattccctttgaacttggattcactttgggactttaagtaacgtataggattccctaacctaacacagttgtcccattatgataggaaattgttttcactcctcaaatgaaagtgatagttactaaactgttcaatgtgtaggatgaacccttgcaaacacttttttaaaagtttctttgccttggctcagtgtctaatgagggaagtgagaaaccatcagcgcaggtctgtggagagcttgcgggtcaggtcattcctgctgcttgtgaacaatccagaccttgcctgggtggggcaagcatggcgagcccagcaggaacagcttggggtggttatggctgttaattttttaatttagttctggaccctacaacccatcgatatctgttcatctcattattccctccctgggtggcaggaatggatataaaaccactgtggtagtttccccctcctccattttattattacttttgtacctttttatgccttgctaggttatgagctctcttactgctctgagttaaaggcagcacataaataattatgtgtaaataaaatgaaagcttacattgtttaacatatgcttagccctttcagaggaaaaaaatatatatatatgtatgtaatctaaactttccaacatatttcttaactgttgtatctgttttcgaaaaataatctcagtaaattttctttttaaattttaatttccttaactttgtgtgggtacatagtaggtgtatatatttatggggtacatgagatgttctgatacagtcatgcaatgtgaaataaatacatcatgaagaagggggtatccatccgtccaacatttatcttttgaatctcagtaaattttaaagcaattccgttcagtatggtagacatcagccacatttactatttaagtttacatttacttaaattgaatacaatgaaaattctccatctctgtagcctagtggttttcaaccagaggtgattttgtcctcaaggggatatctggcaatgtcgagagacatttttagttgtcactaccagggaagaggtgctactggtatctagtgggggcggtcagggatgcagctcaacacgctgcgtggtagtgttaccatgcacagaacagccaccatcgcaaggaaccatcggcccaatatgtcaacagtggcgagagtgagaaactgcactagtcacatttcacgtgctgagtgtcctaggtagctagaaactgcaatattggacagcaccaacttagagtattccccactgtcactgctgacatttggttctatcaggcagtgtggtctcaggcgagagggaaaagttaaggaggactgggagcagggaagtgatattctcatgaaaatacatttctttgaatgagacaccacagattctagatttctttgccatagacaggctctgtcttaagtttctgaggttatgattgtcactgaagtcatattattagcaacagtactcagctgtttgtggagtactccatgatcgacaaatggtttgtcataaattgtctcatttaattttgtaacactgtaaaacagagaagctctctgtttattacaggtgagaaaagtgaagtgatttatttgtctgttataacaatgtgtaggatgaacccttgcaataaaaaatgaatatatttaaaaaagaaaactggctagaccatgaccgtgttacatgggtggagtccaggtctttatgtgacagttagggatccttacaaattcacaaatcatatttttatggggacatctcattaaagaaaagcagaacttcactcccttcccctcacacttcaacaggacttattgacagatgatgtgcccttttttgacatgtatcaagtcattttatttttcatatttgggaagaccattttactctgattagcttatacaaataaagataacataatgcatgtgtcttagttttcctttagcttccactttaaaaagaaaactcagggatgtgcttaagtagttgcacattagttatgttatcttggccaaatgaggtaatttggagagaaaatcaaagtatataatattaaatgagacatataggaacccaatactaaaatttagttttttgctggccctacaaataaaggtggctagttggccatttgggttagataaaagagaaacagtcaaaatgacattttgcttacagaagtaaaaaatatatgatacaccggataaagaaaatgtacatgtatatcatagaatactatgcagccataaaaatgaaaaaatcatgtcctttgcagggacatgaatggagctggaagccattatcctcagtaaactaatgcaggaacagaaaaccaaacacctcatattctcagtcataagtgggagctgaacgatgagaacacatggacacagggaagggaataacacacactggggcctgtcggggggtggggtggggggagggagagcatccaaacaaatagctaatgcatgctgggcttaatacctaggtgatgggtcgatacgttcagcaaatcaccatggtacacatttacctatgtaacaaacctgcacatcctgcacatgtaccctggaacttagaataaaaataaaaactaaaaaaaaaaaagaaatataaattaaggcacccagagagagacccctcttaacaatttctacactggattgttgagatagtagcattaagctttagagacgcatgaaatggtcttcttatatttaaatatcttaatgattgcattgtatcagtggttaagacccaccgcttttttcagctccacttgcaatagaggctgctgttgtcattatttcctgaggctttattatgcatctgggtggactgtctttgcacactgccacggagggaatgatttctgatgaaatggtttccatgcctttcttagagtaaaggatttgaggaaatcctttgagatgctgcctttctctgctgagcgtggcaggcagcatatgatcagtttatgtattaccatatgttttggcctaaaaatgatgcctatggaaatgtggaatacattatgttacaaaatactttggagtctctttttctctttctcttcctaatgtttgaaaggaaatttgtgctagttgagaggtgccaaattcacagctttgggattttgcaaagttcatttcttgtataggatgtacaggagcccagacgaactagaccctatttctggatttccttcactggctcacataatgcattttcgatcatatttgggaaaaatgactcttccaccaaaagtgggctgtggaaatgaggatttgctgttacattacatgaggttgattgtgtggaaagaagacagggcagaaggcagggcagagaagacctggttaggaggtaaaatatatatttatatattacagtttgcttgagaaaatccatttggagcttctctgtggttcctggggtcccccacattttaggggtgagtcaggaagttacatgtgtgaattacgaatttcacatgaatgggacatgtgcattttcttatgaagtcttcagttccatgcttatcattttaaccttctgtttccctaagatcttaaagcaagcgtgtccaacccatggcccttgggccgcatgaggcccaggacggctttgaatgcggcccaacacaaatttgtaaactttcttaaaacattgtgagtttttttgcaattttttttaagctcatcagctatgattagtgttagtctattttatgtgtggccaaagacaattcttcttcttccagtgtggcccgggaaagccaaaagattggacatccctgccttaaagagacgataaagcaatcacatcactcaacgggtaacatttgttattttaaggagtgattcttattctgtttgtgaaacttgttgattttataagtctgacgtcactggatcacagaatcgctaacataaacagcaaaacagactaagtaggcatttttttacccatttctaaaaaacatgaatttatcaagcatagttttttggggaaaagttagttgagactttgaggaagtgctttctgcactctttatagcagatttgtatgttgattctgcgtcttatctttctatcacataaaagtgaaaggagtcccagattatttctatgtcaaaaagaaaaaaaataatccagctaatgagtttctcattgtaaagaaagaagccaaaaggttgttacacttggtttataaggcccttcttgggagctggggaagtttcctttactagtgccatttgsaacatgatgacagagtgagtgtttgacaccttgggtagagagagacagtaaagcaaatctgggataaagagcttagtgtgggtggtaaattacttcttgctgaagtcgccctgcctgtaaaggtgtgaagacaatacagcctccttcactgtctctgtcccttctctgttgttcctgttctctaagcatctgtacctatggtggttcgatcccactcacatgttaactacaactcaacctggaaaatgaatcaagcattgtctctgttctaatgaggggatacttacctaacgtgaccacttaaaaatatgagttgagttaacgtttcgaggcataacaggatgcacaattcatttctcaaaactctcaaaatccagaccagtgagcacagatagaaatcaggagctgtgtgtgctgcaggggagttcttcagaactgcactgctgcccatgtcatgctraatctagaaggctgacgtcccaccaggctgttctggctctcttgttcaagccagggtacatttttttgagggcatttggaaaaactctccagttctgtctgactgagtccttccttttccataaaggttgtagttggggcgagcagacactggtaaacctgccaagttccatagttctggatgctttggaagcagcgtcatgttgcataaaattgcttgtaagtctgtggaaaagaacaacaaaagcgtcattctagatgacatcagtaagcaaagaaaatagctaaattttagtwtggcctgccaatttaaaagctacattaaattagttgtttgccgtgcatggaacattcagtgctgtttaccaaaataatgccaaaaggtaaatttatggtgacacattaacaatgttaaaatacaggtttcatcttaatatcctgttatatcaccttcatatgtttatatttaaaaacatctgatataacaaatgatttcaatgtaaaacttagttgtctttttttacagttctcttttatactatgatgtgcggacataaagttgaaagtacattgatgatgcccaatattagatggcatttatttagttatatgctccttggataaagttttaatttccttattgcttttgttattttcctgggttttattttctctggagaaattaagaaaatgctttcttaattgttaatgctttctttcactcttgttttttgctccctgaaacaatacaagtaacagttatggtctcctgccctgttagatcagacatcctctaattgatgagatttcctgttacaatcaggatatcactagtgttcaggtcgaacaccctagttgataaattaacagattcgtgagtcccttcattggtcagtgaggagcagagtgcggagggtgtctctttctcagtacctcatccaggagacaggagataagcctccctgctctcctatcccaggggctctctcaaatgcagtggagcttgttagcaatgaaagactcatatgctgggaaccagtgcacccctggccactgacagagataataacactgacctccggtcacttgacaaggaaactctcttgtgtggttcgacttcccactgcttcaagccaattcagggggaactggacaggcagattagggatttctatgcacagttctctgcattaccagcagggtgtcctcagcatcagaccatggaggcagttcacatgcaggggccactgaaggcctgatgctccctgccataaaggtgggtttgcaagctcccattgcatgcagagtgggctccagtgttaactcaatctgacctcagaggagtggtgtggtgtaaacatgactggggtgtgtttgtgtctgtgtgtgtgtgtgtgtgtgtgtgtatgtgcatgtgtgtatatgtaaagccagtcatcagtctactactgtgatttcttccaggaagagattttttaatgaaatttaagaaaattgggaaggaggtagtttggggacatgttggtcaaatgatacaaaatttcagttaggaggagtaaggtcaagaaatctattgtacaacatggtggctatagttaataatgtattgtattccggaaaatcactgaaagagtagatcttgagtgttctcaccacaaaaaaattaatatgtgaagtaatgcatacgttaactaccttaactattccacaatgtgtacatattttaaagcatgttctgcacaataattatatatagtttttatttgccaattaaataataatttttttgaaagttaaaaaagaaagcaaattaattcctgtcgttggaattttttcacttatggtcttgtatacttgtatactggtcttatatatatactatactattgtatactatgtatatggtacatatatatactatacagcatatactatatatatagtatatatataatgtatacaagaccatatatatatatatatactcatacacataatatgcagcattatcatgtaaattatgtatagatgttgttttatttgacaaaagattgcaaggtactactcatacagatatagaccgtgccttcatggagcagaattagtacactaaacacagaaggtcttaagaaagtaaggaagtcagtgtttgctcagttaatacacatggtattacatgattttgagaaaatagggtactatgctaagaaagataggagatatgaattattgcaaaagttctctgaggatatgaacttctgaagagtcgggttttctagttaaagagaagagcacgtacaatggcactgaggtggaaaattatttggtacctatagagaagtttaagaagctgctgtatcatgacaggacacctggcgacagggccttagaggatcaagtcttttatattctgtataaagtgcagtgatggaagccagagaggctgtaaggaggggaatgatttgacacaagatattttggggaatgatgaagaaggctgagaatggaaagcgggagtctggttccaaaacaaacacactaatttagacagaagaggtgggtagctcactcaggtgaggctgcagtgaaggcagggtgaggcggatggatttcgggagatgggaggcaaaattggccagggttggatacaagaagcgagggagatggaaacatccgttctgatgccagtttcttaggaaagtggggagaaaggccagttacttaggtgaaggcgactggaagaggagcagccgggcttttccttgtgtgaaaaagggaagccctgttaaaattcattttgggcataataagtttaagcctgtgagattatatcaaggggagctactaaacaggcaggtggacatctgaagtctctggcccagaaacagtcaggactagagatgtaaatttgagttgtccagaatttcatggtatttatggccatctaggaaaattcttgggtaagttcaatatttctgtgtgttgctgggattcttccagggtttggccctaggagtatttgtagttgcttccctcaatggtaattaaacaagcgtggttggagagatgaggactggcattttctgaaatgttggcctcggtgagaaggcgacatgatggatgttaggtggtacagccaattggaatcagaggctgaggaatgagccaacgccaattccaatcccaactctcggctgcatccatcaccattatctccctgcccttttcttctccaaaataatgattagaaaaataaaactttaccttgcaggtccatgaggcttcaaaaacaaaaggaaatcatgatttctgtaaatgttctggtacatcttaggcactatgctgatagatactttataaactcagggaaagaaggaaatgatgagcccagattctgatgatggggaaccactcctgaattttttttttttttactccacagatttacagacagaacgagcatacttttaatagaattaatcacatagttccaacacattttgtgggggagggttagaatttatgaataaaaaagatagtaaatgttttctctacttttctctcatcgtttatctattgggcaagctaccttcatgtcagctgtacttggatgaaagttacttaagagtatatgcaaactggtgtgtttaccctatccaaatgatggtaagataattaaagcaatcggttctgtgtgtctgtttttcagaaaacttctatataggattctaaattgtgctttctttctgatctaccacatcatctcaacccatccaccttctttgaaggactgttaatctcaacacagcctttgtaattaagtgataaattcttacaggtatcatcgttagttaaatattatgcatgagattacctatattatgatgtacatacataatagtacacattattaatcatgtatataagaatattaagcaatctgagatttagaaaataataggctatttttttttttagcagttttgggcctgataaggcattccatttcagaccctgtgaggtctattggatgctgaatatcatcagccatatgatgatttggagtggaaaatgaagagttcccatgccctcccttcctcctccctggtatttcccctactgttatcttgcattagtgtgatacatttgttacaactgatggattactatcgatacattactattaactataatccatagtttacattggggtttactcttgctgttgtatatgctgtggtgtttgacaaatgcataaagtcatgcatccacctttacattatcttataccatgatttcctagtcctagaaataccctgtgctgtgcctggtcatccttctcccattccacacccctggtcttcttgttgtcttcataagagacgatattttccctttctcttttggctatttccgcttagccacaatgaaaggacttgctgtgacgctttgagggaggaaggcaccaccaagtgtcccttcaacttcccacacacagagccagacatctccaattactgagagacagctttgccttctctgacctcctgggcaaaaggccgtcaggcggcagagagcagctgcagataagcaaggaggaagttaaaaaggagagtgactcagaactcctaccaggctctggagacttgatcgttttgatactgtgactcccctttctcatcccaaaccttttgactcaaagtcgatcagtcaaacgatgtgtttgtggctagaacagtggaaggttaatggctcccacaggttgatttgcctctcttgggtcagtggtattctggaagctggcaccctgcacctttgttgataatcccaattctggtactatagacgtggaggttttcattgctattgttttaacttagtagaccttatgtgtgcctcaattcacaattgtaaaaatgtggaatcaacccaaatgatcatcagtcaatgagtggataaagaaattgtgatatatatatggtatatataatatagtattccatcatatatatatatggtattccatcatatatatatatatatatggactatcatatatatatgatggaataccatatatatatatggactatcatatatgtatatgatggaataccatatatatatatgtatgtgtgtgtatatatatatatatatatatatatatatatatatatgatggaatactattcagccataaaaaggaatgaattaatggcatttgcagcaacctggatgagattagaaactattattctaagtgaagtaactcaggaatggaaaactaaacatcatatattctcactcctaagtgggagctaagctatgaggatgcaaaagcataataatgacataatggactttgtggattcggggaaagggtgagaagggggtgagggataaaaggctacaaattgggttcagtgtatactgctcgggtgatgggtgcaccaaaatctcacaaatcaccactaaagaacttactcatgtaaccaaataccacctgttccccaataacctatggaaataaaaaaaaaatttaaaaataccttaaatacgcctgacacttgacactcgtcagcattttgcagtcactcagacctcattgcacttctacaaaatagttattcctcttttctcattatgcatatggggaaggcaagagtgacaagattctaatccagtccatctggctctacaattcatgctctcagctcccccactctcctaatcctccacagccatactcttacccttctcggccaggcaggatttgggagaatgtcttctaaaaacacactactcctttctggtattgggccactaaatcccttaccttactctaccttaccttactccttctaagaagcaacccccatacggctgatgatattttatctccagtagacctcacagggtctgaaatgaacaaagggtgtgtgacccacattacagtcaacacttcgtctcttgcccactgtgcaagccccggcccacagtggttttcattctctggaactctgcttttctatttaaaatgtggagtgatttgatgagatggtttcctctgtttttgtctaaaattaaggatgaagttctaaaacttgaatgaagctcgcacagtggtgcacacctttaattccgggtactctggaggctgaagcaggagggttgcttaagcccaggagtttgagtccatgctggccaacatagcaaggctctgtctcaagaaaacaaccaactccccacccccatccccccgcaraaaacaaacaaacaaacaaacaaaagctttatggaaattagagaagagtttcatttgtccagtacgggaaggcttgaatatccagtcaaaccaatgtaaactcaattcctccactttttagacttgaatgttgtggtgctagaattttaaggagaaatttcagcmgctctgagcacctgatgggacagccttgggtgaaagcatcaggaggacagagtttataatttctaacacctatggagttctatactattcagcccaagccatgggtaatggctggcctaaaaatgaaactttttcatagtcaaattagcctagagcagggtatattttctccctggctattcctactgctgatacttggtgtatttgtttggggcagtttcccctcatggggtgatgttgtctgggcccccctcaacctcatcctggggcatacaaggtgaagtgagttgtgtgagagtcaaaatttccagttatgaagaagcctggagacgaggaggaaatgcaaagttgaaggggacttatcagcgccgatgtcaatgtccacattttggatggacgccacagtttcatttagtacaaaaacagtctgtccatttttgcttcttgggcatgtggggaatgtggagcatttttcctctgaaggtcatccctgtgtctgagataccatttcatgactttggggatatatcaatttagctttttcagtgttcattgtaaccaactaagaagatgcttcaacacattgaaagttacaacgggaaaacttacaatgttgcagattttatgactccattgtgtgtgtatatgtatttattttctctcaggctccaggaaccttatttcattttttattatgacatttatgatatagggaaaataatctaatactggttggggagttgttgaattgataatagtgaaaatgtaaacattcttaacctctttctatttcctttattttccctataaccgtgttattctttagaatttgttaaatacaacaaaggggactcttcatactggtaaatatacatcaaagattatataataaggttaaaatttgggatttttttcttttcttttattagtatcatatttgtttttagagacaggttgttgctctgtcacctgggctagagtccagtggcgtgattgtagctcactgcagccttgaactcctggcctcaagcgatcctcctgcctcagccttgggactacaggtgcataccaccatgtccagctaattaattttttttttctttgaagagacaagatcttgctatgtctcccaggctggtcttgaacccctggggtcaagcaatcctcctgcctcagcctcccaaagctcaagcatcataggtgttggccaccaagtctggtctttctcttccctttctttttaaaaaatggggcatggaggacttggagtaaagaaatgccaacgttttaaatgttaaagaatatcatccaaagtaatttgctttgctaaaataatcatggtggatattgccaccattatctcttaagttattgaaggtcaacttaactgattgttttattttccaatactagtaacttatataaaaggagaatttaaaaaatgtttaagtgaattgggtccccaacatctcagcacctgcaatatttacatccatactgagtagtcttaataatgaaatattttgatgttttagagttcaacaattgtctttatgagcatgagaaaagcagtacacacccattcaaaatacgtaaagaatggaaatagttggagggaaaaaatgttacccatatatctaccacctagctattagcattggacagtattaccttccactatttttttccaagattagaaaagtcttttgtattaacaagaccttttgactagtgattgagttagggagtgcaatatctcacctctgaagtacaactctgtgacagatcagcctgggcactgccaggcacttctttctttatgcagttagtaatttactttctgttttaaggcagagctttatcttcttatttgtgtgttgtcactatggactcatgggttctgaagtattgaaatgggttggaatccattcccaccattatttgttttgatatccagtttgtcaaggtttgacttgtggggaattttgaagcacactgctgcgtccgttggatgagtgcctgtcattctgggagcacgtcccgcctttgcagcatgacgggatgcttcaggcttgtcttgtcgttctcttgctcatgcctgagatcaactctatctcagaggggtcctggggacgctttgttcatcattttgtgtgcctgcttatacagtgttcacaagagagccctgggggagacgatatgcataaaaacatctgcttatgcggacctgtgaaattgtgccccaaaagccataatcactgagttcttcaaaaagagaaatggtgctagagaaagaatgcagaagagcctgtgatggaggcagagacaccaccgtggctgctcttctttcttgccctctgtgcctgttgagattttaccaggaggagaaacctatctgcagagaccgtggggtacccttgtgtcagcaggctctcctcttaacttacaccttatttggttttagccttgcaaatcaagttcatcaagggagggtgaatttgtttatggaaaaggctcaactgaaagggtaaaggggtgtgtgtgtatgtgtgtgtgtgcatgcacgcatacatttattttgtagtggctggaatttctgtattgctgttccagaggctacaaagtaccatattaaaaaaaaaaatccctggccgggggcggtggctcacacctgtaatcccagcactttgggaggccaaggtgggcggatcacgaggtcaggagattgagaccatcctggctaacatggtgaaaccccgtctctactaaaaaaatacaaaaaaattagccgggcgtggtggcgcactcctgtagtcccagctactcgggaggctgaggcaggagaatggcgtgaacccgggaggcagagcttgcagtgagccaagatcgcgccactgcactccggcctgggcgacagagtgagactccatctcagaaaacaaacaaacaaagtttattttatgttctgggatacatgtgcaggacgtgcagatttgttacgtaggtaaacatgtgccatgatggtttgtcgcacctatcaacccatcacctatgcattagctatttatcctgatgttctcccttcccccacccctttgacaggccccagtgtgtgttcccctccctgtgtccatgtgttctcattgttcagctctcacttataagtgagaacatgcagggtttggttttctgctcctgtgttagtttgctgaggctcccagctccacccaygtccctgcaaaggacatgatctctttttatggctacatagtattctatggtgcatatgtactacattttctttatccagtttatcattgatgggcattggattgattccatgtaatgtaataattttattagaaaaggtggatcctgggattagtggttgattggtggaaggaaagggaaggtatggaaagtccttgggcaggcatagttacctcttcacagtacttcatggatcacattcagagggagttagtaggaaacacaagatagaaattcaggccatgatgtcagcaagctttgttctgggcaggctccagttggatctattggttccaactgatttcagccagttttgttatcttacaagcatagggagtttcagcatttcagcaggttgtttcttttcttatctaccatcctgcaaactcaagaatttctgttagtcattggtttctttaactcctcggggcacagtttcaataggagtcagcaaactactgcctgcagcccaaatctgccctgctacctatttttgtatggctcatgagctaagaatgggttttgcatttttaaatgatgaaaaaaaaatccaaagaaacagaatgttttttgacacatgaaaattatatgcaatttaaatttccgtatctcttatcagtttgctcaggctgctgtgataaagtatcacaaacagctttgcttaaacaacagaaatttattgtctcacaattttggagactggaagtgtgaaccaaggtgtcagtggggttggttccttctgagagggctatgagggagggatgagttccaggcttctctccttggcttgtagatgttcttcctatgtctccacatctttattttattttattttattttatttatttatttattttgagacagagtttcactctttttgcccaggctagcacgatcttggctcatcgcaacctccgcctcccgggttcaagcgattctcctgcctcaccctcctgaggagctgaaattacaggtgcctgccaccatgcctggctaatttttgtatttttttagtagagacggggtttcaccatgttggccagactgatctcgaactcctgacctcagatgatccgcctgcctcggcctcccaaagtgctgggattacaggcgtgagccacggcacctggccttctccacatctttttccctctatgtgtatctctgtctatgtacaaatttttccttgttataaggagaccagtcattgggtgagggcccaccctaaacacctcatcttaagyaattacatttgcaaagactctatttctaaataaggtcacattccagggtactgggggcccaacatatcaattttggggggaacacagtccaatctatgacagcatcccacatgaaatgttattggagcacagccacacttattcattttcttatggtctgtagctgattttgcactacaccggcagagtcaaataatttcagtggaaactgcatggcccgcgaagatgaaaaccaggacctgtggtgttatacgcagaacccggtgaaaaatgagaatgcaaggcccctttgaaaaattaagaatctgaagacagtgatggcaaagcattaaaccaaggttgggccccttctaaatgtggggccctgcgtgactgtaatttgctcacccttgaagccatccctgcctaaaatatccactatctggtcatttacagaagaaagcaaaaattgtgggtcctgcattaagagcagagctgggagtgagatcttgggcttcaggggcatcagcctgatgcaggactacagatgcctcaggcctgagtgtaatcaaaagataccaagaaacgaggttcatgtaatttaccaaggactagtgttggtttagttcctctttcttctttcatctttgttgagttttctgtgctcagcgtgtccttaatggtcattgcagcttgctccatttcattggagtgttttaaaccctctttcttgcagtttccccgagaggatgtgctcctgtttgatgtccgtcccttacagtatgttattgtagcacatgcactctggcagaagggctagttgaaaygcgatgctgttgtttttaagctcctagaagtaacagtgctaattgggattgtgatcaactgtgcttgcccaggaccatcagggggcaaggaccacatgggggtcatggggaaggtggttctttattacctttgttatggctgcaacccttctaggctagctatagtgtttggacttgtagtcaaatataatcctgcattaaaatcaaacaggcagtagcattccaaaaagtctactgttacgggctgtattctgtcttccctgcaaattcagatgttgaagtcctaacccccagttgctcagaatgtgactgtatttggagttagggtctttaaaggggtaattaaggtaaaatgaggtcattagggagggccctgatcctataggaccggttgtccttgtaagaagatgaggacacagacatgtacagagggatgacctggtgaggacacagggagaagacaacatctacaagcccaggagaggggcctcaggaggcaccaaccctgcccacaccttgatcttggactttcagccttcaggactgtgggagagtaaatgtctgttgtttataaactgcccggtctatggtattctgtgatagcagcctgaaatgaataagacatctcataagaagaggagatgaggacatagacacacacagagggtcgaccacatgaggacacagggagaagacagcatctacaagccaaggagagaggcttctggaggaaccagccctgcccacaccttgattttsaacttccagcctccaggggtgtgggaaaataaatagtctgttgtttaggctgcccagtctatgggactttattgtggcatttctagaaaactgacccatccacctagatcctcataatttctcacctggctgctctgtgtactgctgtaatgtgtagtgtgttacttaaaaatgtcttctactttgcactgctgtggttctcttgtcctcctgtttgctgttcagcttctaggcctgccccggcttgtagcactctctgggccattaaagttttatttattatgataaatatatatcaaagacatgctacttacaggatactctatacattctttagggcatgtatgcataggaagcatgaagcagagtttgtattctcaacaagattatatcatagttttgggttaaagtctatatgcatttctcttttttaaaaawtttctttttaaaattatagacagggtctcactatgttgcccaggctggtctcgaactcctgggctcaagcaatcctcccaccttggcctcctagagggctgggatgacagatatgagcccccgtccctggccatatctcttggtcataaaatgaggtgggttttagagccagtctggcaagctggctgaccttgggcatgtcattaaagttcatggtgcaagcaaaggttagtattaataactcatcagggagaagtatgtgcaagggccaaacttgagtctgatgcctagtcaggagaaggcagaggaatggggagaacacaaacaaacctaagccagtctcccaaagacaatgtccacatgtccacctgagacctttttgtgtgtgtggaacaagaaacaagtttttgtgtgtatggaacaagacagcgttgcccagagagctgcctcggaagtcattatcagggatgggtttcatgttatatgcaggaaggtagccccttcycctctatgctggctcccctgtgttcagtgggtgtcaagctgatgtctgctcttgttcatgttttccatgatgttctagtgcatttctgcctacatctgcctgagaacttggccaaagtgtgaaagtgtccctcctccaacctgccatctactctcttttttgctttttgtttttgtttttctctaaaaacaagctgggcgcagtggctcatgcctataatcccagcactttgggagactgaggtgggtggatcacttgaggccaggagtttgaaaccagcctggccaacatggcaaaatcccatctctactaaaagtacaaaaatcagctgggtgtggtgacgcacacttgtagtcccagctactcgggaggctgaggcaggaaaatcacttgagcctgggaggtggaggttgcagtgagccaagattgcaccactgtactccagcctgggtgacagagtgagaccctgaaaaaagagaaaagaaagaaagaaggaaggaaggaaggaaggaaggaaggaaggaaggmaggaaggcaagcaagcaagsaggraggaaggaaggaaggaaggaaggaaggaaagagaaagaaagaaagaaaagcaagcaagcagggagggagagaaggaaggaaggaagagagcaagcaaggaaggagrgagggagggaggaaaggaaggaagaaagaaagaaaaagaaagagagagagagagaaagagtctcactctgtcgctcaggctggagtgcagtggcacaattatagctcactgtagcttctacttcctggtcacattcaatcctcctgacttagcctccagagtagctgagactacaggcacacatcaccacaccctactaatatatacatagatgtgtattttttttttttttattgagacagagtctcattctcttgcccaggctggagtgcaatggcacgatcttggctcactgcaacctccgcctcccgggttcacgcgattctcctgcctcatcctcctgagtagctgggattacaggcacacaccaccacacccggataattttttgtgtatttttagtagagacagtgtttcactatgttggccagactggtctcaaactcctgacgtgatccgcccgcctcggcctcccaaagggctgggattacagacgtgagccaccgtgcctggcctccctgctaattttttatttctgtagagacaaagtctttctatgttgcccaagctggtcacaaactcctggcctcaagcaatcctcccacttcagcctcccaaagtgctgggattacaggtgtgagccactgtgcccagcctgccatccactcttgatcatgtttccacagcattctggtgcatgcctctttacctgcaaagtgagagcagaagaggtagtcctctaatctaggtggtgtaatctgagggcttgtgaagatattttccagcatatcttcatcaaggaggttgttccatggctacaattattccattcgaatttttgtgaccccctctaaggtgagactgctcctgagagcaagtattaaattcattcatacattcagtcccagaatgaattcatccatccaacagatagatattcattgaacaattcgtaagtatctttggcatggaggwwaaaaaacagatgagtccaacctttaagcagtacatagtcttaggagggaaaacaagcaataaagaggaaattttaacagcttgaaaatgctataagtgaactggcagggaaaataggagaaggacccataaccctgggacaaattaaagctgacctctgaggaagagctagctaattggaagcgtgggaggtggaggggtttggccgtgtccaacagggaggttggacagcatgttacaagaaagcaagaggcaccagggcatatctgaggcattagaaatagctgagctcatgcagtagggcattaaccatgtcccttccatggtgcttgccaatacattgagcacccacagctctttctgctgcatctgccactctctatctgagaacttgctcatagtgtggaaacttccctattctgactgagaagcaggctagaggtactgggagttaatgccctcgggaactgccctcaagtgccaatagacaggaggtagtagatgagaaataccatggcttccctgtcacttgagaaggagaacagactcccagtggttcccagtgcaggtgacccccaggtactcagagcataaagcattaccttagtgtaccctggactcccttctgtcccctgcctcactccccttcttccttattctccatcttaggatcatgtaaaaccagactgtgccaacctctgaggttaagagcatagtcctggctgggtgcggtggctcatgcctgtaatcccagcactttgggaggctgaggcaggcggatcacaaggtcaggagatcaagaccagcctgaccaacatggtaaaaccccatctctactaaaaatacaaaaatctgtttggcgtggtggcacgtgcctgtaatcccagctactcaggaggctgaggcaggagagtcgcttgaacccgggaggcagaggttgcagtgagctggtatcgtgccactgcactccagcctgggcgacagagcaagactccgtaaaaaaaaaaaaaaaaaaaaaagcaagcacagtcctccaaattgccaagtatgttcaagatgtctgcccaaccacaagttcagcatttctcaaaaccaccctcaggtttcacaatttgctaaaaatacccccaggattcactgcaggctattatgctaaggctcacgtctattacagggatatgatctgaatctgaaccagccaaaagaggagttcacagggtagagtctaggggaattcccaatgcgaagcttccattgttttcaggatgcatttccacacatggtaggatgcacgaaatatcacccacgtgggaagtcacctgagctcaagtgtccagagtttttactgaggcttcatgccgtaggcatgattgatcgagccatgacccgtgtggttaaaatcaatctctgcctgcccccttcccacttctctggagattgggctcataccaattggcctggaggggctctaccaggtgcctcctaactagcaaaaactaacaggcatggtcctaggggcaccatgaataacaaagacacctaccactcaggacatcccaagtttagagattgcctcccaggggtagggacaacagatctctctttgagtgagatcagatttcttactgcacagactccctcagcatgtgtctggggaacctgaggtactggctcattgggggaacatatggtcatctgagggtgaacgccaagagcctcacatcgggagttgagcttttcaagtcatgtatggcgttgagaactgtgttccaaagagcctggactttgcagaacagggatccatgccatgcagaaaggtactggcttccatgggaagaaccaatttgtagagactcaggaggcagggagatgggtaagaagatatttgcaatgattgcaataacttcagtagaaaagcttagcaacttagacgaggatgaatgagtggctcagggcataaaggaaaatggaaagtctgccccaaaggatgagggcagtaaaggttccaagcagctggatggacagggtatggctgactcgtatcatgaaaggtaggtgccttaaatattgttgggcaagactcacaggtatgtttttgtccccatggtattgacaagaaaactgaggcagagaaaggctacacaatttgccaggctcctaggacatttcacaacaaggcattctaatgcatcagcctgtgcttttaactatcactgctggatcaaaggtagagaggcaacaggtttagccctgctttgatatgaggaaggattttctcccaatttgacacatttgcgggaatgcagaaagatgtcttatgaagtggagatgtgcaggtagtggctgggtcagatattgtaggcataaaaattggggcctctttcaattttctgattccttagctccattcctgatatttactggctgctacccttggcaaggcctaatgctcgtgtgtgtgataatggtgttgggtattgattctaggattcctggaatcaaagaaacaattccacagttctgcttactccactgatgttttgagggacttggactgaatgacataccatcagataaaattaccttctccagtttttcctagctggggaactttctatgagagatgagtttgctttgtaattgctagagcctttgctaattgtattagaagtgctttataagataacaaaataataatttgggggatctcagattatttccagaggtcagagttttgctgacaatttcagttcattttaataaacactgatgaacatcagctatgttctaggtccttgctgcactgtggggaggaggagataaattagaccaggggctggaaaattatttctctraagggccagatgacaagtgtcttgggcttcctgggacagagttgtctctgttgcaaccactcagtgtgacgatgtagcatgattgtggtgatgtgtctcaagtgtccccaatcctagggcctcggacccctaatggtccatggcctgttaggaaccaggctacacagcaggaggtgagtgctgggtgagcaagcaaagcttattctgtatttacagctactcaccatggctcacatcaccacctgagctccgcctcctgtcagatcagtggcaacattaggttctcataggagtgcaaacaaaccctgttgtgaactgcacatgtgagggatctaggttgcaggctccttatgagaatctaatgcctgatgatctgtcactgtctcccatcacccccagatgggaccgtctagtttcaggaaaacaagctcagggctcacactgattctacatcatggtgagttttataattatttcattatatattacaatgtaataataatagaaataaagtgcacagtaaatgtaatgctcttgaatcatccagaaaccattctcctcctcctcacccagtccatggaaaaaaaaaatatattccacaaaaccagatcctggtgctaaaaaggttggggactgctaatgtagctgacatagcgtgaaagcagccatagataatctggcaatgaatgggcatggctacatcccattgaaacttcgtgtttggacactgatgtttgattttcatataattatcaggtgttacaaaatattattttttttcaaccatttgaaaattaaatatcaccatggggctgtacaaaagcaaatgtcagagtggattcatttcccaatgggcttagcttgccaaactttgaatgagacacccggcccctgattttaaggagctgatagactattctagagcagtgaacagatgagaaatcatgtcaacacaccgtactgagagccgtagtcatgggacagggaatcacagggtgggctcttcatgaactttgcttcttggagacgttaaaggctctttatgttaaattctttagaaagtgtactgcttctacacttggtgaataaaacggagatgaaagcaagaatcgaggtttgtaaaatctgtgcttgtaaaaagacttttgttttattttagttcccatggtggtgaatttttagcagtaggtcaaaaacatatttggttactgagataaatatctgtacaggtgaatggaatagagatagaccttcaagaaaaccacagctttctttttttcttttatggaattctattcctttggagcagagcacagattgtctttgctggggaacattcgtacttaattttattggttgctttttggttacacatgtggtttgtttatactgaagtattgtgccagaatcatctgccctcctgatacagacctatgggagacataagaccaaatttggcttcaagaaccaggggaacaggtttaacgaaggcagtgtcagctctagccctggggctggatggcttggagttgagagtaaagacagagaaggatctgaggctcaagctgatattcacagccatgaattttgtgtcttttaggatcagtgccaagggatttagctggctggagggctatagccatttcagttctggtcactactgaatccctcaaatgtggcatcatgcttgctactcaatacaatttaacatgaaaacaaagtcattggcttcttttctgcaaccccatgtcatgctgtctccttcttcactcatgcactggatatttattgaatacctactgtgtgctgaaagcttttatggactctggaccatagggtgaaaagacagacacataccatgcccacatgaaactcccttctagcgtgagacagacaaaaaacgcagtgagccaattcwagtactgtggttagtaaggagaaccagggagaaaaattgagccagataaggggaactagggtttgaggagggtgtttattttccgacaagtaagstaaaaaggtcatgtgtatttgtacacttgagcagaaatctggaggaagtaaggcagagattgtaggtatgtggggaagtactttcaaggtggagcctacaggatctgctgaaggattgaaattgggaggagagaggtccaggatgactccaaggatggaggcaccacttcacttactggagtagataacaagaatccactatctggttactaggctctcagtccaggaacattcaatctaggagagcatccaagcaaaatgacagtgggttcatgtagacctgttccaatagctacaggttgagccctatttcttctttcaccccgagatgaccaaatctaaagcaactgcaatgaagaggtgagcagatgataaaagcaagaacaaaagaaacagatcttagtgtgagtgagtgtgagtataataatactgaattatactcagtattctaagtaagcatgatggctgggcacagtggctcatgcctataataccagcattttgggaggytgaggcgggtggatcacttgagaccaggagtttgagaccagcctgtccaacgtggtgaaactctgtctctactaaaaatacaaaaattagccgagtgtggtgctgcatgcctgtagtctcagctactcgggaggctgaggcaggaggattgcttgaacccgggagacagaggttgcagtgagcagagatcgtgcctctgctctacaacctgggtgacagagcaagactctgtctcaaaaataaaaataaataaataaataaatttaattaaataagtaagcacaaagactggtttggtccaggtggacagaggactggttatgctcatgcaatttgttggaccctgtagaattgatgatactgactttgctttggtgagatgctatccttgtgtgaggcatgccatgaagaagagctctatgaaactcctcaaccttgccatggtgaggatgcttgagtaccttctattgttagaacgtgatatttcttaacttcagaagaaaattatttttagattttgtattggggataattgttcttccaggttcctttcatgcttttaacttatgtgaatacttgcattgtaggaattgatcaagttcttcttttcctgttgggaattaggaagctgaaatccaaatttgtggcctacattcagtgggtgttgaggactcagtagagtgtagtttggtatcacactctttacagattccacttgatgtcctcattccctcttatttcttcttgctaacttccattttaggttattttgctatttcttatgaatatgtgtatcatgttgaatcattcctaaaaacaaaaatcagaaactaaatgtacatgggaggccaggtgcagtggctcacacctgtaatctcagcgctttgggagccagaggtgggaggatcgcctgaagccaggtgttagtgaccaacctgggcaacatagcaagaccctacctctacaaaaatctttcaaaaattagtgaggaaaaaaaattagccaggcatggtggtgcatgcttgtagtcccagctactcgggaggctgaggtggaggattgcttgagcccaggagatgtaggtgtcactgagctgtgattgtaccactacactgtagcctgggtgacaccgtgaggctctgtcaaaaaacagaaacaaaaccaaacaaaaaaccaagtaaataaaaaataaatgcacatcaggccagtgccaacgacttccttgttttctttacctgctgtctaaaatgaatgttccctgggagtacaccctagggagacaggaccccagatgtctttgatcactaattgtggctgaaactttaggaaagtaaatgaaatgtcagctaaactactaggcagacaggagtttattccacgtgggtaggaaggcggcaatgtgcctagttttgtacgagcaatttcccacttcaaaatgttttattattgagtgaccttgtggaagccagtggagagatctcaacttgggaaatcgtttcttgatttcacataattttaaattttaaatgaggtctatctctcagacaaactcctgttataaatcaggtaagactacgaaattgaagacacttggctacccattggtgagaacatagctttgaaaaaggatttctctttaattttccccaagtagtcttttttttcccccatcgatgaggtaacagttttgttactttgccaatatctagttaattttatttaacatttttctccccaattcttcaagaccttaacgtattcagttctcctttcagtgagtatgggagtattgaacagttctgggaggcgatttgcattggtgttaaggacgagggcatgggaaggccatctgcttttgatcagggtgtgttttgtggtttgggaggtaaagggccacagtggagccatctctgaggtcctagcatgggctaggctggagccctgctttctgtggcttggccgccctcagcggctccagagttcccagggtattaggggatcatacagggggctgtgtacccacacatgccattgcctcccaggcatcgctcccgtccggagacactgtgtgctttctttcaggtgtcagtgcagatcaaagccatccaaagaacatttgcatgagaatctgtagaatgattaattagcaatgggcattagtaatttttctttcaaggctttgaaatgtctttcattgataaactagttctgttgagccccgactccttttcaaaatgtttttcacccagtactccctctgtgactacaaattggattttgtttccccctgtctacacctctcctttgactttgattcagcagtgtggtcaaaaggacagcctcctgtgggcgataattcattctcatcagcccctgtatctttttttgaaatggagtctcactcactctgttgcctggactggagtgcagtggcgctatctcagctcactgccaccaccgtctcccgggctcaaaagattctcctgcctcagcttcctgagtagctgggattacagacgtccgccaccattcccagctcatttttgtatttctagtagagacgacgtttcaccatgttggtcaggctagtcttgaactcctgacttcaagtgatccgcccaccttggcctagcctgtttatctttttcagatgatattttatagtaggatatcttcaaccctctctttttttgctatcctcttgaaacgcctactgttgttctatttaacccatcttctagctctgatttctgaccatgctgttctcatttacaaatacatgtgatttgacatgttcagattctcctcctgattatccaagaaggcttcaggatctcctcagaaacagaaaatgggaaatgcaccagcagatgtgtttatcagcacattccaaagcaatggtttagcaaagctcagggacactgcagtgttctgcagttgcctggaaatgccaggagggacccaggagaactggaacctccagaaaaagttgcaagtctcaagaggattacactacttatgggtcccccaggaaactatcataagcagtagacacaagtaacactgggcaagtcattgtcaaatataaagcctgtcacttctacaggatttaggcatgtgagatgcaagcttatgtagtttaacaaaaagaaaataggttaattttgcaaattttataatttgcatgtgaacacatttcctgggtctcttccagtgccatggaaggggctcctacaagtgaggggccaccttgaacttgattggcttcctgggaaatccactgcaacccccagattggggctcagcaggctgttgcacccagaagatgtagctgagaagtggatgggacttgttggagcaccattttatgcaggcaaaatttgagatgattgttaccattgttgagaaattttaaattggggaacttggacatgttaagactcaggttgatgcaattttattgttgtattcgttcactgaatacctattgcttatgcaaagtgttcttggggatactgatatggacaaagacaaaagtcttgtcctcattgatataagaggataataaggcgtatggcaacaaataaagcagaggaggagatgggaatggtaatggtaggtcccacctctgtggaccatgttgataagatggctcattggtgaatccctggggatgatggtgggctggccatgatgagacatatcttcaagttctagctttgtcactatcaagatatattgccctagacatagtcacgtatgtcaactccctgggtcataaaatcctcagcagtaaaaatgggactcttctcgctcttacttggggttaataaaccctgacattttgttttccctcaatgcttccatccatacctgcctctcwccatcagagatgtagacaatagatttgactttataatttatgaaacatcttggaggtcaggaccggcccttttgtgaatactctgggcactaaaggaatttgggtatcgttcctgggggagctgtagacgagggtagtgaagcgtatgtctagtggattttcacttcttaacacctttctgtattggaaccattttaatggaggctgataaaggagatgctgcctggggagactgtccgtttattggtcctttatatcaaagaaaaggtgtctaagtggctattctctcttggattcaatttttctttactaaacacctagagtgcacctgatgctggtagtgttctttaacatcccacaggactaatctttgcatttactgaacaaagacatcaacggaattatagaaagatagaaagtatatatgtcaaaactggctatttaatagcatatgtggaccttttggagattcatgaaagcattgttaaaataatattgctatttgataataagtgtaatttctatgatattacttttatgaacaatagtccaaatataaagaattaaaaattaacacaaacaatttttaactcctcaacttagatacagcaatttttaaatgattgtcattattttagactagatttatggcaaatagttatttgagtgtttattgcatttttgtggcatttacttcatccagttaaatttgtttcctcagttacacaataatttccatgtaattgttcttttttttttttttttttgacggaattttgccttgtcccccaggctggagtacagtggcacgatttcagctgactgcaacctcggcctcccaggtttaagcaattttcctgcctcagcctcccaagtagctgggattacaagcacccaccaccatgcccggctaatttttgtacttttagtacagactgggtttcaccatgttggccaggcttgtctggaactcctgacttcaggtgatccacctgccttggcctcccaaagtgctgggattacaggcatgagcaactacgcctggccaattgttctattttaatatatcatattggttcactttggaggcatataaattgttttccactacgaagattagttcatcctggaagcattattttaattgttttgtctatcaatttataatatttgtacagtttatcaatttataacatttatacagtttataaatttataacatttatcaatttataacactatgccatttaataaactcactggatttcaaatgctttgtggagatgggaagttctgatgatattatttgtccctaatgagatgcccaagctgcatagagcatgtcagggtgttgaaatgagaaattattaaaaggtataggtttaagatgcttttttggctcaaacgattcattttctcctctgtcactcaccctaatgaagtcccaggtcttttcttaaggagattgaacatacgaagtgcacttgcttactgcttgtagctaagaggaaaaatgtctctaaaatagtttctaagctggcaatacactcaactcactcaaaagctaagagttcactttttttttacataaagattccagaattatcatagaaatatgcttcaaagcagtttggatttgtgggaattgtttgaaagctctcaagttattttcaagtgttagtgcgacttgctatatattttgcttgctcttttctatcatcctttgaattgcggtgacagtgaattgcttctctcctagcctacgtgagttagccctttcttagaatttccatctggactgtgtgattgggaaatcaatattgtggagatgagggttctgagtcataaccagaaagacttgttctgaatgcctttccctatggtggtgatggtttcgtgcttatttatttataagcatgtaccctatatcactggttctcaacccgggggcagttcttgtccctggggggcatttggcaatgttttgagacatttcgggctttcacacctgaggatggaagtgctactagcatcgaagttgctaatatcctccaatgcacagaactgccccccacaacaaaggcttatggataagccctgcatgtcagtagcgtggaggctgagacaccctgcctatacaagatgaatagtacatttctgcctttgatggtagaacaaagcgttctatgctcacgacaaattgtaccctagacaaggatcggaccctccacctcgatctcattggtagcatgcaagtgccctgtgaaatcttcttttttttttttttttttttgagacaggttcgcactctgtagcccagggtggagtgcagtggtgcaatgtcgactcactataacctccacctcctgggttcaagtaatcctcctgccttagcctcccaagtagctgggattacaggcgtgcaccaccacgccaagctaatttttgtatttttagtagaggtagggtttcatgatgttggccaagctcgtcttgaactcctgacctcaaagcaatccacccgctgcagcctcccaaagtgctggggttacagatgtgagccaccacgccggtccagaaatcttcttttgaaacaggattttattctcaagccttcccccttttggcagggaaggggattagcctttacttataattgtaatctacaaaatacatgaagctttctattgcagccatgaaaagatggaaaatgagtgttagcgttcacatttattttcatgctgagaaatacagtatcacttcaatgtagcaattctcaaaggactttaaaggcctagctatggtttccaaaatcactaggcccacaaaatcctactttatctgcctactacaggtggcggctactacaggtgatggcatgcctattacaggtgatggcacgcaccgatagtcccagctactcaggaagctgagatgggagaatcgcttgagcctggcgggtcaaggctgcagtgagctgaggtcgcgccactgaactccagcctgggtgacaggagtaaaaccatgtctcaaaaaaagatgtcttccttgactgtcctatgtttattgccttgttgctagactcaccatctttcctttcgctctttattattaacctaaaagaataaaattgtcccagcacggtggctcacgcctgtaatcccagcactttgggaggctgaggggggagggggtggatcacctgaggtcaggagttcaagaccagcctggccaacattgtgaaaccccatctctacaaaaatacaaaaattacccagacacagccaggagtggtggctcacgcctgtaatcccagcactttgggaggccgaggcgggcggatcacgaggtcaggagatcgagaccacgttgaaaccctgtctctactaaaaacacaaaaaaattagctgggcgcggtggcaggcgccttagtttgacaatatgaatctattcatattttcctatagtcccagttcctgagaaggctgaggtgggagaatcgcttgagcctgggaagttgaggctgcagtgaaccaagattgcaccactgaactccagcatgggcaacaggagtgaaaccctgtctcaaaacaaaactaaactaaactgaaactaaaaataaaaataaatggaaacaacagcaacaacaacaaagcttaaagagaacacattcagaagaagagtggagaaatatgaagaggggaagtaatagtaaaaacaaaagtccagacaggtaaatctactgctatgttagggtaggatatttgctgaaatcaggttgactgaaaggtgtgtgtgttttgagcctggggtctgaggggccacacgagaagtatttcttcagaaaggtgaagttgagaatctttgtcaattcacattctgccgacacctscagaaagctctttggttcctctttctgctgagacatggccatttcccctcctgctggacaacaggatgcctggactcccttcgtcgatgttgcactcagctcctagcttcacctctgcctcagtgcttctccctggaggaactttgagctgcctattgaggggcatgtgtttgcagctgagttcttttacagtgaaagcattgcattttgaaattacacatgggaaacccatctaatataatgttaaggtttgtaaaccaataagtattggagacaggtctcaatcaatgtagaggtttattctgccaaagttaaggaccgtggcctatgatagggcctcagaaggtcctgagaacatgtgcccaaggtagctgggttgcagcttctcagtacattttagggaaaaagaagttacaagcaaagatgtaaatgaatacatggaagatatacattggttcagcctgaaagggcaggacatttcaaagcagagggcttccaggtcataggtgggttcaaagatttcctgattggcgattggttgaaagagttaagctctgcctgaaatgttgaagtcagcagaaagaaatgcttgagttaagataaggacagtggggttgaagaagccaaggttcttgtcatgtaggtgaagcctccaggtagcaggcttcagagagaatagatggtaaatacctcttattggaccttaaaaggtgtcagattctctggaaaagaactaataagggaaggcgattctctacagaatgcaaattttccccacaagagatggctttgcaaggctatctcagaatatgtcaaagaaatatattttgaggtaaaatacttttttttttttcagggcctgctatctgtcatgtgatgctatactacggtcaggttggagttgggtatcttattgctacaaagagtctgttttgtcagtcttaagatccctatgctaatgtgaatgctggtcagttgtgcctaaactccaaaggaaggaggcatgtctgtcccttctttcctgtcatggcttgaactaatttttcaggtttatttgggaccccttggctaagatggggtccattgagtggaggcttagaactttattactttatttttactttacaggctgaatggtcctctgcataacggtattttcgtcaagctaaatcttaaacacaagtatgtcgacgaaaagagtcaaactctgtagaatatttgaagagatttattctgagtcaaatatgagtgaccatggcccatgacgcagccctcagaaggtccttagaatatgtgtccaaggtggtcggggcacagcttggttttatacattttagggaggcatgagatatcaatcaaatacatttaagaaagacattggtttggttcagaaaggcggaacaactcaaagtggaggcggggttgggggggtggcacttctaggttataggtaaatttaaacattttctgatggacagttggctgagtttttgtctaaagacctgggatcaatggaaaggaaatgttcaggttaagataaaagattgaggagaccaaagttcttttgaagtctcacagtggctgctgttagaaacaatagatgacaaatgtttcctattcagaccctttaaaaggtggtagactggaaggaaaaggtctagctatgttaatagggattctttacagatgtgcatttttcctcacaaaggatggcttgcaggaccatttcaaaatgtaacaaaaaacatattttgggggtaaaatattttgattttcttccttgtctcgtaatgttatgccagagtcacgttgcaaaataagtcatgatatatagagttaaataaagcccatctaatgagaacttatggtttgtagggcatgactccctagaccccttagataggaatttggacaacatgaaagaatcagagcttagtcctcaagtagaatggaacaacagcataacacaaaatgaaagggcccaacttattaatgcaacacatgatttatactgaaaattttagtcaccagatctttaaatgatacattattttgttaaattgacatttaaaaagagtagatgattctgagttgcaaacacttctattttattcaataaagaccttctatatgcattattaggagttcactgagtgccaattctttcattgatatgtctctaagtttttaatttttcaagtggtcattttcctctaggtcatcaacacctagaaaaaaatgtgtttcaattgactcataaaccttaagwtaatgtaattgctgtctaacagtttctagaattattgcttttgaatggttatgttgcatgaaaaattattattcaaaaactaacacgaaagaggaggcattgaaagttctttataaagttttccatttttatgtgttgatgatctattctcagacttcatgtaatttgaagtaattgctgctatatggctcatgactctcaaattcagcctgcatcaagatcacctggggtgcccatggatgcatttttctggctgcamcttcaaacctactcaatcctaatcttggtggagtgtgggagaggggaggaccaaacccacactttaagagataccgatccatgtgcttagtccattgaatggaatagacatgtttgacaatatgaatctattcaaaatgggatagttgaagatcactgaatttttaacttacaatctatttgacagggaaagtcagtacatttttaattattgttcaatataaattacatatatatactggtgaatttagaaactttttttttttgcctaataacattcttgaaatataattcacatgctgtacaatttacttgtttaaatagttcattggtttttcatgtatttatagtcntgcaattatcagcagaattatagaatatttttatcactacccccaaaaaaatcccatagccattggcagtcgcttccctttccctccaattccttcagtcctacatatccactaatctattttctttccctacatagattgactcattctagacatttcatataaatgatggaatcatacagcatgtaatctttttatctggctttttattttacttagcataatattataaaggcccattgatgctgtagcatgctttagtattccatttcttttcattgctaaacaatatttccatgtattcttttttcattttatttattcattcattcgtcagtaattatatatgaaatttgcttccactttttggctattatgaataatgctgtaaggagcatttgtgtacaagtcttaatggtatggatagaattataaatatgttgtatttattttattctgagattttatacataaaactttactaatttactctagaattacattacaatattaaaataaactctgtgtctcttcctttgcccctattgcaaacccctgacctaataaaataaaatcccagacaacagggggaaaaaaacccggcagaatggatgcctatctagaactctaagcattaatcttaaatcagttttcggggaattttgatgaatactttttagaaaagatgagcagactacctaaacaccacacaattttaaatcattaccttggaatgactttactttcatgtgccaaactgactatggtgtgtatttaatatttgacrtaatattcccatgcgctttaagaaatccatgaagacttccaataagatagcctttgtatttgtgtgtgtatgcacaccagtgtaatttgcatttccatctcctgatgtgcaggtcttgaatttttgtgtgtgtgatagtgtaatggagcaatggtgacaattgctaaagaagctgattctccagtggatactytttttctttttaaaatattgatggaataatatcatccactttgctgaagaaaaaagggatcacagaaataaataatggtttaatgagaagatgaatgtgaggaatgctgktttatatcatgtgatacctccttttccctctttctgcacatctgattattccctcctttaccaagggtgagctagatagttggcaatttatgctttagtttctttgtgctgtgtgtatgtgcatgcatgtgtgtgtctgtctgcatctgatgatttttacaatgattcttcagattcatgaagtatgttattttttattgctttcgaatcccctgtgatattccttactcttccggatactccatacatctgactgacctacttatttctcatttatcatttcctactaattttctcatcattttaaaaggcttattcttcttgcatataggctgacatgaggaagtaagtatctattcttagagaatgacacagggaacgaagtataattctgttttctgagaaaacattgatatgtgggttttaattatattagaaaaccaactctacttttgaactattgactttggtcatattcagtggtttgagtttttagggaacaatccctacccactggtttctttccagagtagaaattgtatctatgacttgtagaaataattaatattaatcatgtcttgtaaagcttttctacataaaggctttctttaaatagaatgagctctttatttgccttgagtagcaatgtctcccaattatagcaacagggtttctgtattgagaagaattaattttaaaattctatgattatattacaagagaaaaaaaaaacaagaaatgcgacctttccaacagttttttttttttttttgtacaggttcattttctttataaaaagtctgagcaagaaagggtcttgctttgttttttctctttagagcaacaagtgaggcctcagcctataagaaaggaaaagctccctgtctcacggctcaatcgaattgattcggtggggccatcagtgtggtaggcattggatttacattggcctcatagtctgtcaagccgctgaagggaatttgcttgccactgtgaaggtggttttctgaaactgtctctcctcttcccgcttcccttcctctccctcccccttgttaggaagatcatggcgtgaagacaaacagatgcctgctgccaaaatgtgctacttaacctgaccctcaactaggcccacaaaggagggctttgagatccccagagaggcagcccctgcatttcatcatgccgtgaaatttggagtgaaagccccatgcctctggctgcttagccatgagggatatggtgatgatggtgcccggaggggactgggaagccagcgagaaaaaacacaaagtaacagcagggacaaagacggcctccccctactgccctgctttgattgttaggtggtctataaactccgagaaatagagggcctagggcacaagagcattttgttgtcactggttcatttagtcctctgggtggggatgcggtggaggcagtgatcaggagtcttttctgagctagaggggtcactgattttgctcattaacaaagagcaacagcaagtacatttcccaaagaaagagagagaagcttatcacttcatgggaaggacttgccttatatctgacagatgtgtaacctccaaaaatatttagtatcctctatttccaacagaagatgccattctgatatttttgccttgtattctctttgtaatatattctttgcatgttagtctatcacatttcctctttaaaatgagtaagttggatatgagtttcttgtttttctataaacatgaatacatttctattatagtaaagaagcagaagagaagcattctgtaaattataaacgtacattcagtgacattagaaataaagcaaatctgtttcctcttggtgaagtgagggtacattatcagcagcatcttggtgaaacagttttctgaggatacagggtatttaagttactcttatgaattgatatatgtataacaatctgaatgagttggaaagaaactaataaaacatggaaaataattactcttccttctgtgtgttcttgtccagttaaactgttacatgtagnggcattaaattacattaagctgcctatttaaatttgtgggatttgtacactttattttaaatctccaaaatgatttcatgtgtgagtgagattctttttaagctccccccaagtggaagaaagcaggcatgaatggcatcatctatattgtaaatatcacatgtctgttataaaaatgatgttcttatataagttattttcaggtgcattagaatttcacttagggaatcttatcatttgataaagcagaccttcgagtgctgtctttttgaagtaattagattactcgttttaccagtggtatgcatgctttggggaaaggaaagctaggtcctttctctctgataaaggaaacgtacatgtcttcaataagaatcattttcttttctttgttctactggtctacataaagcctgctatacttctaaaaacatatccagcagtcgctctaagcattgctaagatccaagctcccacttgtcccaaagctaaagttgactctaaatagcctgtgaattatagatcatttgtcttcatctcagaacacagcagaaacctctggagtgcctctatgttgctaaaatttacagttttattttcatgcttaaaaagatcaaatctatctggaacatactcttctctcatcccacctgcttttgcctggttaatcctactcattattttgttttctgcctagacatatccctttgcccagggaattttgcatagttgtcacttgggttaggttctccccatctgtacttctgtacgcctttgtctcacggctttgatcccactgtattgtaatggcttaattttgttctccatcatattctaaggtcaaagcatgcagactgtgtgtttgatgcatccacgtgctcctaatatctcttggattgcccaatgcatagatgtgaatcaataaatacatacgcagagaaggtagagagggaggttacaaagtaaagggagactcttgtaagattagaaatgatattggtgacacaatagataatcagaaaagttatggctacattctttgcatttttgatgtcacaagggttaaaaaatttcagttcacatgtatcatcttagttgctttcatcaggtagtgtcagtgaagaaaacaaactactctaggtacataaactagaaggaacttaatacaagggattagatgcttctaaaatgattagaggtgttgaaggaatggactctaggctcagcctccagaagtgactctaaaacagagagctgactctcctgcttgctctgagccctctctggagtaacaatgtgagagtcaagggccatcccctgatgaagcctctacagatacccaggaagctggagaatgaagacttgaagactgcagcagaaaaccctcacattttcacaagggttctaaaccacagaaatagtgaacaaggcacaagcaagaaaatatcttctgttttctttttgccttcaaatgctgcgtaaatatattgatgagcataacctaattgaattcagaatttcagtggcatgatcatctgggaaatgcagcttctacttcctcttccactggaaggtgggtgtgatggatgttgaatgcatacttttgtactttccttttaactttttcagtttcttctctccaatatggtagctaccagccatatagctttatagatttaaatttattaaaattgaatatttcatctttcagcctcattggccacatttcaagtgctcagtagccccatgtggctgctggctgccatattggatggtgtacatgtagaacaattccattcttgcattatgttggacaccactggtctaggtaatgtgagctactccttttttcttttttctgcatttttttggttcagcagagcagctgatgaatgaatgggtaaaggggtaatgaaggtaagcttagagttaatcaaaacagtgttcagttagctaagttgtaaaatgcaaaacaacaagaggaagagacatctttggttgagtccttaaatgtgtatttcagtcaaggggataacaagggaaaacaagcacaagaaactgacatttgcattgcccacagtatgaaggaggctcttctaaaccctgtgcaaaatctcttgaaagactgcagtagttaaacaaaccttcatgatccaaacttactgagttagtgcttgctgctcgttttggttgagttcacaaatagctttcattgttactgtattatgatggaattccattggccacaagaacttcaacatcactctttttgtggtgaagagagaataaaattaaatattcaagtgaggttgtacaaatttcaagtttgggttaaaggccaaacaggttctattataaacggagttttccatccataactaacatacattctccaccatggtgtttccttttaagcatctgaaaagttatgaatatgatgtctaactcattaatctggagcagacctaccacataatgccaaattgaatgagtttgctcagggatgcactaatgtcttagaggagctttcatgytgacaaagctggggtgatttgatctggcaagggagacaggaaacatgaaagtccccatgagatttggctccctggtcttttcaagagcacaccatgccttccttgagtttgacatatcagacaaccaagccacacagatagatattaagctgtcagtgttacaagctccttctatcagaagaggattagtgttgacactgttgctgattggtctcactgcacagacatgcttcattttaggttctctcttagaacctactataatcactcacctctcagacaaagagatgcatttattggaaacaataagccaacagcatatagttacccatggcattcttatatattactgatataaacaatcttgttaagcaagaagcagatattataaataagacaggcttataagtagctctgtgagatttaacacagggacaaagagcaaaatcccattcctcctgtgatgtatgccgcattttgtaaggtcattagcacaggaagaaaggacaccaggccacccaacttgggaataagattgacatggttctccaggactaccaatcaaatgttttcttaggagatgtgtgttgtcaagaaaatgtgtaggaaaaaaatatatatggagataaggatcagagctagatgagcataagcttttaaacatagcaccaagtgagggaaatcctaatctccattcaacttgtcacagttttttttttaaccttgcagcacagtgatgtcagaatcatgctgtgcagattcaattctgaccttcactggggagacgggcctggctgtttaagttcttcgaatgctgtgactggtgattccagttgagttacgcaaaatctgatctaatgaacacttgagattctggacgcacaacatggatcccgttaattcagcctgtaaaacctggctaatggctctgccaggattcttgagttattttgattacctgggggtcagtattggagaaagctgagcgatggatttgatagtctgccgaaggatatacagatgtcctataatcagattataattttaaaaaattgtgtgtctgtgtgtgtgttacactttctgggttggaaattacatgtacagataatagtttctagcccttactgattttttagcactttgattaaatatgcatttttattttcccagagaaaaggctgtcttgttatgtatatcattttattaagctgtctgtgcgccagtaaacttcccactgagggtgagtttttttgtgtctttaggaaaatgttcatgtgaggatgtaagcttcctcctgtgaggaaaggacacctacccctcctttactgctctgtcttggcaaaacaccaacatcagttttccttcattggacttttaataaacacagactgattctgctgattttagaattcatgtatgaatgtagccagggagtgaacatactactgaaaactaatacttatctaggacatgccatgcagtagtttgcaactgcaaaagaagtaggttctatccatctcctatcttcgttgtgaggaacatcgtgcttggatgttgtaagaaggacttatctagtataaaggagggagggacacagagggtccaagaggcaaattggaccacagtgctgagtgacctcgtttcctgtgttttgtaattagaagtgatggcagagaggaaggacaattgggatccttacagagtcaccctggagcttacctgggacttccaagatgactgaggctatgctgggtcctctactttagggtttctgaggctgtggttaaaccaccagtttatacagcctattgaaactgactttacagagcctaaaagattctaggttttgtctctttcttcttgaacagttgcttgggaagacatatcatctatttggtatgaggtttcagatctgaagcatttgtctttaaatctgtttattcctataagcccattgataggaacttaaattttttaatgctctctgcccatagatttatatccataatagctttttaataatgccagctagagaaaacttgtgatttgagattttaaataattttaagattattttatgaatttattttttattttaactttaaaaaacacacttaagttatgagaacactgcaaagaacttccatatacttttcatctaaatcagggtattgcaagctctctgtcaaagatttataaatattctttgctggcttggtcatctgttgcaactactcaactctgctgctgtagtgcaaaagcagccacaggcaatatgtaaatgaacagacatggctctgttccaataaaactttatttacaaaaacaagaggtgggccacatttggtccctggtttctagttgcttgacccaatctagacttaccagtcgttacctttcctttttttccttttctttttcttttttttggctatatttgcttcatcatattctctctctctgcatatacatatatgtatatatacacaaatgtataacgtatacatatatactatgtgtatatatacacacacatacacttataatcatttttttccaatcatttgaaaagaagatgcaggcatcatgattctttacctccaagtaattaagcatgcatttcttaagaacaagtgcattctcttagtaactactaagagaatctactaagagaatggaattatcaaatgtaagtgataacactgatataataccaacatcatttgataaaattatcaagtgtaggtgatttaacattgatgtaacgccaacatctaatctacggtttatatttaaacttcactgattgtcccgataatgttctttatagccttattttgtctgattcaggatccaattcttcattatgtgtggcatttgttgtcatgtatctttagtctcctttggtctggaaccattcctcagtctttctttgtctttcaggacattgatatttttgaagactagaggctaattgctttgtagattgtttggtatttcctcttggttagattcaggttctctataatgggcaggaatcctgcctctgtgagatgctgagtccttgctagtgcatcctttcaggagacacctgagtttcgttttgctttyttcccccattcttggaggcaatatctttgatccttttgttaaggtgcgctctgctaggtttctacactggaaagttagcactttctcttcataattaatatcttttaaatttgagcagtgaccatgggaatactatttgaagcttcaatactgtaccaaaaatgccatattagaagattgcggttgaaaaataggaatgcaaagaaggtatgctttgtcttccaggtaagagaattccatgactttgtctacttcaagaaacttaattaagtggaaaagaattacactgagagtatggttttctgattgctttcctctcatttacttatgtagtttctaaacacttcccccgaaactccaaggactccctttgttgtgaaaaagtagttgtgataaaatgaggcccgtgtttcctgataagtttcgcagtgagagagtcattgcccttcggacgtttcagagcaagttgatttgtgatgcgaacgtctcaggcctgatgctgttgtggttgtgctaggctggcatgctaatcctctgtgattgaggctgcaatgattgttcaactgcacttcagagggctgtctgccaaaagatttcattattttggcaagacacagtgcacttttcgacacacaggattgtaacaatttctatacagtaccaatttagagctggagggaggccatgaatacttctaaaggcagtagggtgcacatattttaggaaatatatttgggagaaaaaaacagctttcatctaaaaagcaggtccacagctttttagagaaacttgctgccattaattcagaaaacagaaatggtctttgcaaacttttgtagatagcattgttatatgatatgaatgtatacccatataaaataaaaagttggaggttttttttttttaagaaccccaaggcttattctttatatccaggcaatactccagacaaaattaagtataaggcattatttgattttttaattattcaacagaaaatactttwgtgaaagaaaaggtactgggctatggtctcaggatatcccttctcattccatgttctggccacacacagaatattaccacaccattcaatcttagcttttggaaatgtgggcaagaaatgtggcactttaaaaacaattattagaacatgcttgagagactggaattaagagaaatttgaatttcttttccaattaaaagggaaaatgtaggtaggcattagggaaatatgaaagaactataaaataaagtctccttattggtcccctagaaatggaagagaactagattcactaagtacctactatgtgtagacaccttaaaaggtggtctttataaatttcatttgaaaaaagtccacctgagcaaatattttttcactsttttatgtatcagaaacgtatagttgagagaggttaaaataaaacttgaatgggaaaaaatcatttagcttgaggtagatgagggattctcctctgggtcagtccaaatctaaaactcagtgctcttttggttgccttcagacttggctagaatcatgagtttcagagtccctcacctgggaagtggcctgacttatctatccattcaagactactaaagcccagccaccagaattgcatccacgaaggcacacacatctaaacatcagtgccttcccaccatattggaaacctgtggcttattcacacaggttatcaacatgccacatgatcattgtcacatttccctacatccaaatgcttacatcctctaagctggagtgaaactgtacgttcatgtccagtcctaggcagagccatggatctaaaccctaccacttggccgttgcctctgtgaaaatgtttcagttttcaaatctggaagctgtatagggttgggttcaatgataggagtgatacgttgcctctctaaaattcattgttttcatattgtaacccctacaacagtctctgggaccttgatcaattgataatttcctacttcttctacatcttcaatcatcctgatcttcagtcagacttcctccgtttgatcctttgttttctgcctattaacgtgttccagtcacctcattttgaagcacaaacacgtaaagagagaacaaaacagattaaagaaaaaaaaactttactaaaccatgaaatctcatacaggttgccattctagttttcgcatagcccaactcctaaaatttttgacactccaatttaattttgtctgtacctctttatctgtatctttgacgtttgcttgtaaatgtacatgctatgatctttgtagagacttaaggtccttgaaggcagtcccttgtgtagttcatagatttagccataggcccatcacttagcatgatactgtggttatagttagaactcaggaaatggttgtaaaaggaataaattaatgatgagagagaaagacaaaagaaacttataaatgccatcattagctttaacctttatcctaaactgcatatccacaatttcaatagcttgttggacaacactccttgtacgtaccctggacacctctaactcgctgtgttaagcactcagttccgtatctttccccatgcttgtttctccttcttccttcgtcttggtgacaccatcagttcccttgagatctagattggaaactttggtgcctttccccatttgatttctctcatccccacttctcaaaacaaattggtaaccatgttgatgagattgcacttccatattccctttcataggttaacatccttttcctcctttcacccaatgtcctctgacaccctggtggcatactgacactagaaatggcagacagaagattggaagacgttgtaaagacttttgctctggtttactttactgcaatgtctcacctctctaatccatcttctgttccaacacccaagtcttcataaacacaagttggaacaaacaattagttctgagtgtgtcagtggctcctcattgaatccaagggctatccttccagccttgttttctgctatgtgttttctcctactagcaatcagacaccatactccccactccatacattcaatattatccttatcccaaatttacttacagctggtcaagttctagtcacagtcacccttctaagctgatttatgggtccctagttctgtgaagttcttttcaatgatcctctatgaaaatacatatcctttttttcatttcttatgacttttttttggttttgtttgtttatttatttatttatgagatggaggcttactctgtcacccaggctgtagtgcagtggcacaatttcagctcacgcaacttccagctcccaggttcaagcaattctcccacctcagcctcccaagtagctgggattacaggcgcttgccaccacacctgcctaatttttgtattttttggtagagacagggtttcatcatgttggtcaggctggtctcgagctcttgacctcaagtgatctgcccacctcaccctcccaaagtgttgggattacaggcatgagccaccacgcctggccggcatgtcgttcttaactcgtttattttatgattcactgatgcggacttatttatctacatacttttctcccataagagattccatgctccctcagggcagaatgaatcatgccacatttccccctgtcttggtgactagataagtactttgcacattagaaatattaatccatattgttgatttagctaatttgttgctaattcgaacagattgaaatctatggacctgctgcttctttgttttagcatgggttctattcatttagcataatctgatcacgagttccacttgttgattattggataatgtaaaattttgaatttcgtgtgaaccttttttgctttagaatttattgtgatggctgttttggtaagaacatttcttctgctgtccttttatgaaagtgtttggttaaatgtaaagtatggaatttggtgccaaactggccaggtggtgattcacaaagtagtatccacaatttccttgttgatcagtacttccactcatgagttggaggtctctctctgtgacatgaaatagtcttattggttgtgcttatatgaaggtcttggaatgcgtaacacctagggcattctggaactgaatcccagagagatctgggagcaccatagtttactaatcccatggatttgcaaagtacttttcagtgtacagatatcttttatatacattgtctcatgaatcccctgtagcaagtggcataaagtgctttatcatggaaaataccctttatttgagtgtgctaaagcatgggttcaatcccaattgccccaatctctcccagagtcactagctttgtttccttaacctctcttaacttcagtgtttcctctctaaaatgtaagaataattgtgccctttttaaaatttttttttcttttttgagacagagtcttactctgttacccaggctgcagagtgcagtggtgcattctgcagtctcaaacttccgggcttaagtgatcctcccacctcaacctcctgaatagctgggactacaggtgcacactactatgcccagctagttttttaatttttagtggagacaaagtctcactatgttgctcagtctattcttgaacttctgggctcaagagatcatctcatctcagcctcccaaagtgctggggttacagacatgagycaccattcccagccaatagtgcataattttacatacttctatagatgtgttgtgatgaggctccactagacaaatagttttaaaagtggtctgtaatctgtaaagtttctatgttaagtagaaacatacttagtatctacctgccaaacgatgacatatgcgattagctctctcaatctacatatttttctttgaaatttaaagtgtttcttcattggaattgaagcagtagcctcggaagaaatgattttagtctatcatcctaaaacttgaaagcctaaaacctttgctaaaaatataaactttggttactgttttggatagttttaggcagtacatgatcatggcgcctataggagtttatgtaatacattctaaagcaattgtctcctggtagtagtatttctctcataatcactcctctcgtggaagagagatgtggggttgtcacaaggtaaaccccaaaattggagttcagtctgggaggccacatgggttcttggcttcatgcaggaaggaattcaagagcaaggctacagagtaaagtgaaagcaagtttattaagaaagtaaaggaataaaagggtggctgtgccataggcagarcaatggcatgggctgcttgattgagtaaacttatcattatttctagattatatgctaaataaggggtagattatttatgagttttctgggaaaagggtggggagttctggaactgaggtttcctcccccttttagaccatatagggtagcttctggacattgccatggcacttgtaaactgtcatggcactggtgggagtgtcttttagcatgctaatgccttataattagtgcataatgagcacatggacaaccagaggttgctttcatttgccatcttggttttggtgggttttgactgacttctttactgcatcctgtttcatcactggggtctttgtgacctgtatcttgtgcaactagtcctgccaacctcttatctcatcctgtgactaagaatgcctaacctcctgataatgcagcctagcagttcttggcctcattttacccagcccctgttcaagatagagtcctttgggttctaacacctctggcagggctgcagtcttttgacatacctttttttttttttaaattgcttgcagaaataggaagttttttgttctacatgaagtatgagagaaagtgtgtcattgtcgttttctcccgcaacactttagcttttgttgaaatctttttttttttaactggccagagtattataaagaaatagacttttggcaaacttatcctgcaaacatttactcagatgattgtatataggttgtgcttgtcagagagatttcatggaggattattaaaagaaaatgttggctgtcattaataacattttgaaaaatgtctttagatactgctgattactagttactggatctgaagcaggaatgcaattaaaatagagctttaaatgaatgacatatactgatgctagacttggcagagcttctggattaatagcaaaacaagtgtgttgtgtattgctttgattagcattccagaaatatgcctgtttttgtaaatagtatttgttttgtataaggtatttgacaattccacaagctctcaggaccatggttatgtgggattatggagatttcaaaggcttgagactttttgtgcaccgatatctatagttgtgaaaatgcaactgtgtacacatgtagcagcatatttttataatttatatttttagcaataagagaaaacaaaaatcacatgcttattttcagacgttgttagccacatagcatttaacagtgtctttatggaataaatgtttgttgggtgtttcttgagtgaaatgataaagacttaccttgcagtggcaagagtgtcatgtattcatttcaaatggtcttgaggaagaattaggtcttagcatacttttaaataactactaaacatttttgccttgaagcaaatgtctagaaaaaataagtaacaagagctttgaggacaaagcattgatgtagccataggaaacaaaaaactagttctttaaggaaatcataagtaagttggataagtttttttcttttctttttttttttttttgagacggagtatcactctgtcgcccaggctggagtgcagtggtgtgatctcggctcactgcaagctccgcctctcgggttcacgccattctcctgcctcagcctcccgagaagctaggactacaggcgcccgccaccacgcctggataattttttttgtatttttagtagagacagggtttcactgtgttagccagaatggtctcgatctcctgaccttgtgatccgcctgcctcggccttccaaagtgctgggattacaggcgtgagccaccgcgcccggcctttagataagtttttaaacaatgtttcattactattaaaattgtttttcttttagaattgctatattgatgaaaaatttgtttttgaacattcttgagagaagtaagcactgtaacttggggcaggctcatatatgtcttagaaaagaattattaaagagctcaagtttttttaaaaaaatgaaaataatttaaaatgttcatatgcaacattactatgacatctaaaaatttttttatgagaaatatatgttcttaatggcacttatatgaagcaagaaagagacattactccaaagagtaatggtctagggattgttcacgggcagagattcagctacttgcaaggtaagtctttgtcatttcactcaagaaacatccaacaagcatttattccataaagacactgttaaatgcaaacatcaaatttggtggcagttcttttttttttttttttttttttttttgagacagagtcttgctctgtcatccaggctggagtgcagtggcatgatctcagctcactgcaacctctgcctcctgagttcaagcaattttcctgccttggcttcccaagtagctgggactacaggcgcccaccaccacacccagctaattttttgtatttttagtagagacrggttttcaccatgttagccaggatggtctcgatctcctgacctcatgatctgcccgcctcggcctcccaaagtgctgggactacaggtgtgagccaccgtgcccggccaatggcagttctttttaaagtttactaagcatcagaattttcagtagaacttgttaaaatagattcctggaccctggtcccagagattcagactgtaggttgagaatgaggcccatgaattttcatttcacacaaactccaaaggatgcccataatatcagtaattgatcacactttgagcattattgttataaagaattgacagttggcacaggggcagttgatttcatacatataattgataaaaagatggcaacaaatattgaaaattaagtttcttcagagttttccagtgtatcttctaactgtatctgtattttaaaacatggaagagattactagaaaacagagtgcaaaagtagtattgcttcaccatatatcyggaattctacattatacatatctgaaatttaactgagaatttctactgtcatttgaaaactcatcaataatgaaatagaaataatatagataaaataaccatgaatgtatgagagctagggctatgcttatatttagatgactgacatctgactatatgactattaatgtttaaaattacaacttgcattaaatataattttgaggatcaagtttccatgcatatgaatgtaacattttttttttcaaccatgaggcctggctactaacaatcaggcacacacagacatcccgtatgtacacactatatatgctttatttttatttttatttttatttttgagacagagttttgctctgtcacccaggctggagtgcagtggcccgatctcggctcactgcaacctctacctcctgggttcaagtgattctcctgcctcagtcttccgagtagctggaactacaggtgggcgccacaatgccaggctaatttttgtattttttggtagagacggggtttcactttgtcggccaggctggtctcaaactcttggcctcaagtgatttgcacacctcagcctcccaaagtgctggcattacaggcttgagccaccacacctggcctcagagtatatatattttatatatcatgtgtgtatatataatatatatagtgtatattagtaataaactatattatatgtgcatataatttgtttatccaacaatcttactatttattattacaaacgttcttgaacaatggagtctggctagtgtctttgatttattagaatgtatatagtaataagttatatgcatgtatgtttaagcaaaccttattttctgttatgagactctcatgtcataatctaacagatttattcaatgtattttaatggagtgattaaactcgatgtatctgagtgctgttggattcattgagataaggacacaagttaacaataatacatatgtgtacatacatacagacataaatttaatacaatgcattttcacttgtagaagagtgtacaaaaaatagccctatgctgccaatttaaaagaaatgtaatattaacttttatgaggaaaaaaatcccatgaaacaacaacctttagaaagtatttcttggctgggcgcagtggctcacgcctgtaatcccaacagtttgggaggctgagacgggtggatcacctgaggtcatgagttcgagaccagcctggccaacatggtgaaaccccatctctactaaaaatacaaaaattagcccggtgtggtggcaggcgcctgtaatcccagctactcgggaggctgaggtagaagaatcacttgaacctgggaggtggaggttgcagtgagccgagatcgccccatcacactccagcctagggacaagaatgagactttgtctcaaaaaaaaaaaaaaaaaaaaaagaaaagaaaagaaaatatttcttactgaatagaaaatatgtcttaccccaattcctccagctgatggtgacgatcattacttttcctgtaagtcactgccgggcgctgtaacttttcctttccaattgtgttgaaatacattttttggtccgcgttctgtaatgatgcttttgctcagattcgtgttatacccagttaaaaagagcagctgattctttggttttctaaactaactagaataaacaggcattgaaaaagcaacaatcacaggtgaattcttttttcctctcagcwttgtttgtttccatgttttatttatttttattgttcctctcttccagtgcctggagccctgcaaggaatcaggggacctgaggaaacaccagtgccaaagcttttgtgaggtaggagaacgtcagtggtacttaaaacacttgacccaaatctgactatgcttacgtggggtcatgggaatgaatgggccttcttattcttctgcagcttggggagatcattaactgcaggtgtgtgtggatatacgtaaattcatgtaaaaaatatagagccttcttaaaacctggctacccactgcttgcattattggctaaccagaccaaaaaaaaaaatatgatgtgtagatggaagactacaggctttctaaaggtatagattgtcaccaccctcccaccttacatcatagctattctgagtagtttttacatgcttttgaagtattcatgccatttgggagaagagactcatattattgctaatggtgtttctcaaatattttcatctctttgttcccctcggggttcctcctcatatcctgggcagaatgcttgcccgcttttaactgtacaggaggcatcttacttcagctaactattagttagattagtatctatctgttcatctatccagccagccagccagcaagccatccatccatccatccatccatccatccatccatccatcatccatccatccatccagctatccatccatccggctatccatctatctattatctatctatatctatttgtctatctatccatccattcatccatccagccatccacccttgtatctacccattcatctctctatcatccttattgggagaatgtgtaatattgtcctagaggaccactgtctaaaatcaccaatagtgcaaaaaaggagatctgctttactggrctgtcttccctatggaatacagggggcacaggccctgtaccagcctggattctgctgagaagtaaccagacacaaggccaagcagactgcctggttccaaggattccaaggacagtggacttgagaagtaggagaatctgaaggtttggggagaatagtagagaatgagtcaaaagagtccattttggcagtcaggagagctcagttgagggtcttggccagaagaggtgcccccgacatcagaatgaaatgatgttatggattatctttgaacagaactggggggtgaaagggaactcttccaaggatccagagacattggtctggtcttcatccactatagcaaataaatgctagtgtaatcccattgcctatgtttcactctggatcttattctgagaaaatgaatgcagaattaggacaataatggcttcatcaatatgtattgtgtgtaaaatatcttcataatcttacttgacctttcccatactcctgtagttaagcaaggcagatagtaagtccccaagagttacgtgtggaagccaggaaggactgggaagttgaggctcctcagacgaatggcttgtcaacggtcaaccctccaggtagaaagactgggtctaaaactccttgattttgatccctcttttgatccctcactgattatctgagtgttgttcctggtcaactccgcttggccaatcaccaggggtcatagtgggtttgggccccttgagatgtagaaaaaacatagcagaaataaacaaaactggtgatttgctgcaaggataaggagagtgaggccatcccatgtctttgtttgtgttctgcttttaccttttctgtgttcctactttaactattttaaaaatatctattcattcatttattcaacatgaactttttgaatacctataatgtgccctgcagtttggtagagatgtggcagtaaaaaaatcacgcaaaaattccagcttttgtggggcttattttctcctggatgaaagatctcagctgtgaatgatggtaacttgattctaatcctaactgcaaaaccaacttactctatgaattcagttaaatcaattaacctgtgtcttcaacctcatttttcaaatgagggatttatcctattgatcttacacggtgtttattaaaatagataatgaatgtaagtgcatggtacagagcttatcaagctgtacaaaagtaacacaatgatatttactttgtattatgtgttataggcttgtgggtcacagctctgtgaggtatctgaatcaactatttattctgaatttttacccgcattggtaatccttgtcaacacaattagagcacactgtctagtggagtgactgttgtgctcttaactttaattttctaccctattccatacacaaactatacatctataggcacaaaaataaatatttatagaatcttttttttttttcggtttcccatgctggagtgcagtggcgtgatctcggctcactgcaccctccacctcctgggttcaagtgattctcgtgcctcagcctcccagataggtggaattacaggcgtgcaccaccatgctcagttgatttttacatttttagtagagacaggagttttgcgtgttagccaggcagctctcaaactcttggcctcaagtgatccgcctgccttggcctcccaaattgctggtattataggcatgagccactgctcctgacctgtttatagaatcttgaggaacaaggtgtttgttttataaatttattatccctaaatatcagtgactctgggctgatatttttacatctgatcgctgagaaggaagatataattgaaggtcatttgaaacctttcttcctgtaaatttcaaattcaagagcaggtttctgtaattgccattctctgaggtaactgtgaggtgttctgaaccaaatccagtttattaaaatgggactcaggtgtttgaatgtgatcccttctggcatgaaaggttaattgaaacttgaaaggtggggaaaacagatgccatttaatgtgaggagctttgatgaattgcttcagcccaacggttaaataactcaagacttgatgttccattttagtggctttgattgtttttaggtccctgtgtgttttttgcatctgttttattttgcagtaagtatctgactattgtgttgaagtaggctgaaccttgaaaacactgatggctgtttcagcatttttaagcctagtcacttatggagacaggcctaaaacaatcccgttcatcctccccattctcacattatttgttaagaatgcacagaaktccatattgtcatgactctaagctttccctttgtaaaagttcagacccagaagggactctagattacattattcttcaacggaaacaattacactgttagacatgttcggcccggtatgtttacctgcagggcagtctgagcttatttgtcttctaaggcataggtttgcaaaccatgactcgcaaggcaaactggtctgcctcttgttttataaataaaactttattgaaacacagccacactggtttgtttacatattgtccatggctgcttttgtgctacaacaacagaattgagtacttgtaacattatatggcccttatagctgaaaatatctaatatctggccctttatagaaaaagttttttaattcctgctccaagaaaaagaacaggctgggcacagtggctaatgcctgtaatatcagcactttgggaagctgaggcaggaggattgcttgaggccaggagttcaaggttgcaatgagctatgatcatgccattgcagtccagactgggcaaaagagtaagagcctgtgtcaaaacaaaaaacaataaaacaaagaacagtcataattatattacaaaactcatcttaccatttagagtactgttacttcttaatctgtattatcagcacccatttctaaacataaaacattgttcttggtaattttaatcacaaataagttttcctacatggaggagacttttggaggcatgttaataacaacatacctagaattggttcatttcattctcatatcgtgatctctctcacttctcatttgattaccgattttgttataatttgcacggtaacttttgctacttttaggctaatgtcagaggtaataatgtcttcttctttttcttttttttcttttttgagacggagtcttgctctgttgccaggctggagtgcagtggcgcaatctcagcttactgcaacctctgcctcccaggttccagcaattctcctgcctcagcctcctgagtagctgggactacaagcatgcatcaccacgcccggctaatttttgtatttttagtagagacggggtttcaccatgttggccaggatggtctccatctcctgaccttgtgatccgcccgccttggcctcccaaagtgctgggattacaggcgtgagccaccttgcccggccaataaatgtcattttttaaatgaagaagttaaatgtttgtatcaaaacaggaaaaaaattgagatatttcagcagtcctctggattatatgagattttattttcatgtatcaagtttttggaacatggcacgtaatcatagatacatagataggcaaatagattctgttttgtaggttcagtttattaactaaccattatcactgttcttttcttttctttctttttttttttttttttttttttttttttttgagagaggtttgctctgtcgcccaggctggagtgcagtgtcatgatctcggctcactgcaacctctgcctcccgggtttgagcgattctcctgcctcagcctcttgagtagctgggattacagacatgcatcaccactcccagcttattttttgtatttttagtagagatggggtttccccctcttgtccaggctggtctcgaactcctgacctcaggtgatccgcccacctcagccttccaaaatgctgggattacaggcgtgagccaccgtacccggcctgttctcttattttcaaaaatcttaaaaaccatgacaaactttttttaaccaaatacaaaatatacattttcctaggttgaaacattcctttctcacaatcaatggaatcttaaattttaaatggcattatttatttctcattcttaatgatcttagttttggtgaaacttgatatatcattgtttatgacttgcctccttgctgaatgaaacagctcccatctttgattttgacgtttctgatgcatggcatctcaaccctaagtaagaactcagtggatgtcagcattggataaaacagctggtaaaacagctgccatctttgactttgacgtttctgattcatgaaatctcaacactaagtaagaactcagtggatgtcaacattggaagtatgcagtacctgttaacgtcatagaaagctgaaaccttattggcttcagggatcaatcaagggtaaaaatacaagttgtttgggatgaatatgcatcctgagataagtagtctttctcagcctggaaatgggaaggaaaaggaggttttcactttactacatatataattatcaagtaatttctttgcgattttgcattttgaaatgtctttcaggcttatagatttgattcccataacagtccttagaagaagttagatgtgaatttcattaggtaagcttgatggacaaggaaactcatacacaaggagaagagatttatttgtccaagatcacatggttggttagtggagtataagatctaaaatccaggtggtgtagcttctagttacatttctttcctgctgtattgtagggtttcccttctaaacctattctgtgtcacagcacacagagcagaggaggaggttttacttccctcatcagggaataaaagatgagcctgtgtcgaatgtaaggttcttggcccagtcatccctgcttggacaggcttatccttaaatgagaaggaagttttagtggtttaaaatcatagttaattttttttttctttttgagacagagtctgactctgtcacctaggctggagtgcagtggctcggtctcagctcactgcaacgtctgtctcccaggtttaagcgattctcctgactcagcctcccaagtagctgggattacaggcacctgccaccatgcccagctaatttttgtatttttagtagagacggggtttcaccatgttggccaggctggtcttgaactgctaacttcaggtgatccacccatctcgacctcccaaagtgctgggattacaggcgtgagccactgcgcctggccaaatcatagttaattaatggcacctcaaggagagaaggaagacagggctccttgccccttcacgtggctctgaaagaaatattccaacactactgaaaagagacctcagaaagtaaaagggttaacatgcctctcctgtggggatttcttgcactcaaaactttttatctcttcrctgctctataactggttttatgtcttaaaatttaaagtgataattaaatgcatacctgtagggattggaacagaacctgtacctgtctggatatgtctgtaaaatagttaaaggtcttgaaagaagctgatgagagctaaacgtgaaagtgatataatattccccayatgtgtgttggctggaaaaggagaagcacatagaatttgtaccatttagcaatgttttgctttaacatatcagaacaatagcttccccaattagaatatacttgtgaaagggaaataaagattaactttgttgctattctttttaaacagatatatgtccaaactgaaagacagactcaatttttattacaaagattttccacttggaaatattttcctaagagcattaaaatatggctcctgagtacttccttttaaggaagttgtcaattctttagagacactagaatgggacctgcagtagtgtgtctagtgggtgagacactcaggctttttcttttacttggtacaatctaatccactgagcaaatgagagatagtggtggctcagtctagagtggtcatggtgagagattcaatatgaggaacgggagaaagagttgagtcagtggtgttgccagggcttttgtccttaaaaactagggtaagaaagctggaatgtacgagatgtgggatatgtgtcaggcacagatagttttgggggtggggtggggagaaagaatagaccagaagtttggtgttgagcatggcatgtttcagatgtaaatggaaatccgtatgagatgtgctgtagggaaacaggcataggagtttggaatttaggtgagagttctaggctgaaagaacaaatgccatgcatgaaggtactgtttaaagtaatgaagctcaktgaggtgacagaaagaaaacaggtctatgagttaaactgaatcacagcaacataagaggaatagggagatgaagaaggagatttaagagaggccaataaattgggagaaaacacaggggagtgtggtgttccgatagccaaacgatgaaagcttttcaacaaggaagaggtaatcagttgcgtcaagtgctgcaagagcatggagacttcaaatttattmatcggattctgcgacagggagctcactgtggactttgacaagagcagtgttattgggtggcagaagaaaatgcctaattggcatgaatttcagataaatggttggaggaaacagagagggagtatagaaacatttcagtgagcattactgtaaaaaaaaaaagtgatcaggggcgcaaatgagattgtgggaagaggtgtgaacaaggtaatcaaacatttaattgtttttagagtagagaaataattatattttacaagcagatgaaaattattcagaagagaggggttatttgatgttagaggagaaaggggggaattgctgaagcacatgaccttaaatggcaatgtctaccattgtgtgtgtatggaggcaggtttgaaatgggagcaagcttctacgtcctgggacaggagatgcatgagaattcatggatacatgagaatccatggatgcatgagattttaatgcaccagatgcagctgcattggtgggtgtgaaaatggcgtctatggaacttctcttttgaatgctttacttttctcagtgcaacaggaatcagggtgaccagctgagagtaaggaccagacaaagggatggaggctggagtgactgacacatagacaattttcttttcttttcttttctttttttttttttttttgagacagggtcttgctctgtcgcccaggctggagtgcaatggcacgatctcggctcagtgcaacctccgccccccaggttcaagcgattctcctgcctcagcctcctgagtagctgggattacaggcacctgccaccacacctggctaatttttgtatttttagtagagacagggtttcaccatcttggccaggctggtcttgaactcctgacctcgtgatccacccgcctcagcctcccaaagtgttggyattacaggcgtgagccaccgcactcagccacatagacaattttcaaaaagtttttagtatgataaataataggcttttatttttaaaaatgattaacattggtattttacatttttgtaacacataaaagtgttacttgtatttctagatggtgttacttgggcaccaatgaagagatgcagaattcatctaagtcttcttttcgacttaggggacgtagtagtagtaaagtggaaatgttttgaagaatgcttatgaatttttataattattatgagatattctttgccaaccaccatatgatgggtacagtctgcattgtatcaaattttatagctctggaacataaactttttttcctttttaagcactgagactcagtctgcattgtatcaaattttatagatctggaacataaactttttttcctttttaagcactgagactcaattttttatattttttataaaatataaaaatttttttatatttttcttatattactcgggggagtatcaaattattctagactcagttgtaggagaattgatgagttttgaaaatttatgggaccaagactggagattattcagaatgatttaaaracctaagcctgaaaagaagggctaggcaaataggcacataaggagttaggggagtatcatgaaaattgcaaaagcactaaatttaagtaaaaaaattttttttgaatgcatytaaagcacttaatcagtatctgaagataacacacattacatatatattagctacttttattataaaagaggaagacaaggagacaaggtcaacactttttaattctattggaggtcagtgagatgcgnactaaaagggctcactgagttttgtagttaggaagtcactggaaatctgtgtgggagactttctgtggatcaatagtaggtaacagatacaactctgcgttatagaataaaatgtaaggaggaaattcagaccaaatacatgcaactttttctataagtttaaagtctttccctaacactgtctctagagcatagaggagagagaagaggctgtgtttagggggaattcacagttgagaaagtgatttttgtgttttaccttggaaagactggaatacatttatatgtcaggggaaatgaatgctgtcaggagtgtgaggtcagagatacatggagcacaaattggataacttgatctctggagtaaggaactaggggtgaaggaaatgtaaatatggagagggagaaactcatgcatctgaagatgccaactccagtgtccagcatgatccagaactggccttctcagacttggtcacgcacatgaatcatctaggaatctgctttaatgcagattctgattaagtaggtatatggtgttcagtaggcatatggtattcagtaggtatatggtgtggccaggagagtctgcatttccagcaagctcccaagtgatgctaatgctactgaaccaaggcctagcctttgagtagcaagtgtgtggttgtacttcttggatactggggctccctgttttagggatagccatgtttatgcctgtggtggcacatgcctgtggtcccagctacacaggaggctggggcaggaggattgcttgagcccaggaggtcgagactgcagtgagccatgtttgtgccactgcactctagccagggtgacagagtgagaccctgttttaaaaaacaaacaacaaaaaagcactcacttgaagttttctaccaattctgtgaaaccttctgtgatttgtgcagtgatagtctatggggagaaaatgtgcaattgcttaaaatgattgaaaaccagcagatgaggctaggctcagtggctcacacctgtaataccagcattttgggaggccaagacgggaggatcacttgagcccaggagtttaagaccagcctggacaacaaagtcagaccccatctcctcgaaaaataaaaaataaaaaaaatcagccaaacatggtgtcacatgcttgtggtcacctgtggtcccagctagacaggaagctgaggcaggaggatttcttgagcccaggaggttgaggctgtagcgagccatgttcgtgccactgcactccagcctgggtgacagaatgagaccctgtttcaaaaaaaaaaagaaggaacaagaaaaagaaaaaatcagcagatgaaaatggttctttataaataaaaacaaaaaacactattttattattcaagatacagaattataatcgttgatttatctttattccccaatgcattgtaaacatgatagcaggaataaagtttagccttctcatctcatgtaactagcagaatgatgtactcaggttaaatgaatcaatgaatgaagagagtctccttttatgtgagttggtagagctttcatggaggaatttagaaagaattctgatatttatcttctctaagaagtagaagctcctgtatgagcttaaagtttatttatttacttattgagacttttatatgttatttccattttttagtagacataagactattcacgttgtctatttcttctttagtagcatttataamctatgtctttgtaggaagtgaactatttcatccaagttatcacattgataaaaatagcataggtcatattatcgcctaattcacctttatcgttagcattttgatgtctgttaggtttgtagtgatgaaccctttttgcaatactgacattggtaagttatgtattctctactttttcttgattcatcccaatagaattttgtcaattttagtgctkctttaaaaaaaaaaaaaaaaacttcttgttttattgtttttctttatttttttgtcatttcctatgctattgatttctgtcctttattatttccttacttttgcttaattttgattagtttgactctctttatataatttcttattgtaggagcttagataattaatttgagaccttattttcctttcatatataagagctttatgctataaattttgccctatgcactattttagctaaaacccacattttgtgttatagcatgtttttatttttacacaggtattttctgattacttctgtgattccatttttgaatttcatatgagtgtatggtttattttgtaaatttttgagaattttacatatatcttcctactgatttctagttaagacaaaacttaggatttctatccttttaaattttttgagaattgctttttggaacacagtatgtttcatcttgaatgacttcatgtataatatgaaaatgtcataacaatatactttcattgtttactcccttcatttgtattcttagtgtcctaaatcatacttctacatttgttgcaagctccacatcacatttttatggtttttgctttaaacttatcttcttccagagatataaaaataagaaaaatcatcttttaaatataatcatgtatttattatttctagaattcttcattctttgtgtagaccccaaggttcatctgttatcattttccttttgcttttaacatttcttataatgctaggttgctggctatgagttcaccttttgtatacctgtggtagtctttaaggcatcttcacttttcaaagatatttcatgggtataaaattctaagttgattttttttttaaatagcattttaaagatattgctttattttcttccgacatgcatattttctgaaaaacctttgagattcttatccttgttttactatatataaagtatcttttaatttttctatctgctttgaagattttccttcagtatctggcatatgaagcaatacggttaagtatactttgagttaattatctttgtttcttctgcttaggggtaattgagattcctctaactttggacatacaattttaatcaaatttttaatttattgttcaatattatttattgatttctcccatcttctctcttctcttgttctgagactctaattacacrcattagaccagcttattttgtctcatgggtcaatgagtctatgatcttttttttttccttttggtcatttcccaccctctgcttcattttaatagtttatttatttatttatttwttttaaatcattgtgtctttgctttccttttaagtaatcttatcttctatggtgtctaacattttaaaaatcctatttgacatatttttcatttcttcctttttacttctggaatttctatgcagctctgttctgtagctttcattcctgtcctccctatgtccatgttttcctctacattcctgggcatatggagcatatttatattagttcttaaatgtcctttgctgttaatgctatcatttctataatttctggtcctgcttctgtagatcccttttttcccattttatgtgccgcaatttcctgcttctttgcacactggattatttttgattggatgtcaaatttttgtgttttgaattttgctgtatctttcyagaaagtgttagactttgttctggcatgtagttaagttccttttgagattcattttcttatttttaaaagtttcttttaagctttcttgggggcgggttcagagtagtagcctttagmctaggcccaatttatcccattactaggtgatatccttctgaggactctagccaatgcttcatgaattgtgcattctctgcactctgactggttgaaatgtgagtttttgctagaatggtttcctttattgctgtctgattattcttyccccagacttatgcagtttgaagccatgcacattcaagtcagtattcagccagaaatcaaagggtccctctgaatccctgtaggtttctctcttcatgcagtttcatcctgctttacagtctgcccacaagatctggccatctcagcctcaagctttaatctctttatccacaacttggaaaaattgcagagctatcttgggattagccttccttgcactgtggatttgaaactacgtcaaatcatttttttggcaaaattgtagctcatctcatttgtgtccttataggttttcttgtcttgtgctacctattgtccaatgtctgaataacgtggttacatacacaagaggacttcagaaagttcatggaaaaatggaatcaaaagccaaaaataaaacatataagctttgtttcccaacataagctccatcaagcttaagacacttttataagtgatgttatcagccacttagtccatccctaaagaattgagggtcctgggaatttaaccatgtcaatgtaggttttgaaaaatattattcactgaagaaaaatgggtgctctttaaaggttgttgttttttttttttttttttttttttttgagatggagtcttgctctgtcgcccaggctggagtgcagtggtacaatctgggctcactgcaaactccgcctcccgggttcacaccattctcctgtctcagcctcccgagtagctgggactacaggcgcccaccaccacgcccagctaattttttgtatttttagtagagatggggtttcaccgtgttagccaggatggtctcgatctcctgacctcgtgatccgcctgccttggcctcccaaagtgctgggattacaggcatgagccaccatgcccgacctaaagattcttataagaacaggaaacaagaacaagtcaggagacaaatcaggactgtaaggtggatgcctaatgatttcccattgaaactctggcaaaattactgttatttgatgagaggaatgagcagggccattgttatggtggagaaaggctctctgatgaagctttctcagacatttttctgctaaatctttggttaactttcttaaaataccctcgtaataacataacattcaatgttcactttggggcagggttttagcattaagatgaggtggaatttggctctttacatcraaaagtgaactacaggacacagaatttgtgcacagcctctataatctagctgaaactggcttgtggtctgcagttgcttatcagaaaataatctttataaggccagtcttctgtccaatcagagttgtagaggtctgggttgtaaatcagagttgatagctcctattgttaacaagtttagctataggaatttagaaatgtgccatgccaaccaagaaccttagcataccccttagttgataaaggggcatccattttggtctctcagatcatacccactagatgccaatagcaccttccagttgtgaggaacaaaaatatctccagatattacctaatgtcccctgggaaccagtcccttaacttatggaatttgtactttctcttacttgttcataacgaggaaactatgttctrtgtacattagtgtattggtctgttttcatactgctataaagaactgccagagactgggtaatttataaaggaaagaggtttaattgactcacttttcagcatggctggagagacctcaggaaacttacaatcatggtagaaggtgaaggggaagcaaggcatcttcacaaggcagcaggaaggagaagtgcctagtgaagggggaagagtcccttataaaaccatcagatctcgtgagaactcactcactatcacaagaacagcatgggggaaactgcccccatgattcaattactcccacctggtctcttctttgacacatggagattatggggactacaattcaagatgagatttggttggggacacaaagcctaatcatatcagttagtttctatttcattttgtgatgatctaaccagtccagaagtggtataatatagtagtgtataaacaaagaaataagaaatttcaaggaagatctctaagaggtaaaatatgagatttttttttcttgtatcttggatggatgtgatgagtttgtagaatttgacagtgtttgcaaaatgagatgagcaaagaaactgaacaatataaatcaaagagtaaacaactgtatttgacaactttctaatttgttcctctttaaaagaaattatttacatgaggattttaggccatctataattaatgtatatggattcctattgtttcttgtaaaatttctagaactgcgttaaagaattctgatgctaataaaggtggctagcactgattgcacctttattatgtgctaggatccatgctaagtgttttggaagctttatttaaggcttagggtaatattttatcttcctttaatattttgaagaaagtgacacttgccaaattaattttgccccccaaattgtacagcagttatcttrcttgtgtatttgtcaagctctgaaggggacaggctgtatttgtttctkttccctctctctttttcttctgttttccacatcacttttacttgcntaaatcatcagtattgatgactggtctttaaagttttgtccttgtctaattatttgttgatctcgtccttatatctgtaacttcctgtgtctacctttattataatgcaaactaaactgtttaatgatttttacctgtttgttagtaaacatgtaaactataagcatagtgggtcatcattttcacantttcacctgttcaccattaaattcctagtacctagaatgccggtttggtctataaatcagtatataaatggtttagtgggctgaacattgcattggcattcttggtattcactactaacaaatgcagaagtaggagagggaaataaatcatagtttaaatgtggtacctgaacratccctaattctctagggatttgtgaacttctcgagctatttatgtgcctcatgatcttccagaaatattgcagcaagattctgaggtgttgctgactcatacaaggtgacacatttgttttcaaaataaatagaagagccaggccaggaagaaggaagccaagataaacataagtaaagattactgtaattgaaagaagagggtatgtacttgtagaaaagtgacttctctaatatgcgtgtttctgcttttctcctaattttatattttccatggccaatgtctataatttgcctgggaatccaattaattgcaatcacatctaagaaattagtatttataattgggcttccaagcaaattataataatacttccaagcataaattagtaacatttgaacggagagttatttttcttatttcatgcctagtgtttagatgtcttctttgaaagacacacttggcagttttgcctcattttttaaaagtacaccctattttcttttttgagttggaatctcactcactctgttgcccaggccggagtgcaattgtgcaatcttggctcactgcaacctccgtctcctagtttgaagattctcctgcctcagttgtccaagtagctgggattacagttgtgtgccaccacacctggctgattttttggatttttagtagaggtgaggctttgccatgttggccaggctggtctcaaactcatgacctcaagtgatctgtctgccttggcctcccaaagtgctgggattacaggcgtgagccaccacacccagccaagtatactatttatttttaatagaaactatacatgcccattaaaaattaataaaccgcacagaaaagtaaaaccaaaccatcattccagatttaccatgtagaaacagccatggtttactgtgcagaaacgtgttaacacagcaaggccaagactgctctcccaatgcctacttaaatggctggccaagaggccagcacctggaagctctgtgcacactagtttcaaataaatgcttaaagtttaatattacttgaaggcaagagaagacaaagacaccccaaaatattataaagaaaagattataaaagatattatgtggttggaattgttactctttcaattccatatttgttttattatttactgatgttctaatattaagttcaagataagtcacactcataggttttctccaccactcctcccacctaccagtttttctaacatattattatttgaaaattcttagttttatcacagcaaattctccctcctatcattcttattttatttaattttagtttcatacttaggtacatagaaaaatgattrattttactgwttcttttttccactgtatgcttaattttgtaaatttaattcatatctttgtttttaaacaggggtctatggatggtgttttctttaagtttatgcatgataaattttacctacagttatatctaaaktacacttggattggacaacttttttttcttctataagtattactttattttatctgggtacygaatattgtactagcccatttgttcttgttttctgtttatgataggatggctaggttttgccwttgcatggcacatcatgccccctgcccccaacacaacccccccacaaggcacatacactcacagagtttattttccttagaattatgtagacattgctttgttagcttcacatactaaatttagtagagagacatttggtagcaattatattttcttcctcataatcagcttgccttttttacctgaatgcctgaaaaattaaagttttccctttggtgttcagaagcagaagctatattccagtgttgcttgctcttttcagttattcttggaacataacctgccctttgatttataatttttttctattaattccttgatctatctttctttcttttcttttctttcttttccttttttttttttttttttgagatggagtctccttctgtcgcccagtctagagtgcagtggttcaatctcggctcactgcaacctccgcctcccaggttcaagggattctcccatctgagcctcccgagtagctgccaccacacccggctaatttttgtatttttaggagagacggggtttctccatgttggccaggctggtctcaaactcctgacctcagatgatcttgatatttctagtttatttcttaactttatgtttttgtcttatttcacattttatatttttgtttaactcttttctaacccttttcatctcatttcattgtctcactaccttgtcttcatgctcttgtattgaattcatgttctgttcatctcgctgtgttttttgggagtgaagttttcagaaatttggaatcagaccctttggccaggttagggagggggcaatgctgagatgggggcagcagcggcagaagtcaaactttaatgattttaacattttcaaagtgcccaggacatgtgtacaaagacacatttaatggaaattgtgtaggttgcttttttgtttaatcttaacatttaatcttaacattttctgatttaaaaattgtaaaatcttgtttaacaaaaacttttatgtattaacatactattttcctttcattacagaattgtttataaaagttcctttgttaaaaaataaggatcctttttaacaccacagcatttgtactgttgctttttaatatagtgaaaatacaaaaggaagagcatgtgctatttttttgatgtcactgacttcagagacactgtgttcaaagaattaccaacatactttaattcagtgattgcttggtgtttagaatgtcagtgctttaattttgagcatcctgaaatatatcttttgtacatacagagacggatgtatcagaatcagattttcagtaacccctggattatagtttggagtactttaatttagttaccctcagtggtctctaggagtttatgtacacttagattttctgtttataaatgcatttagcttttctgtatctgggtagatggagctattcaactactcagcatagaattaagattaaaaatttgtttgctaaagaaaaggaataaaaaaagaaagaaatttgaaatcaccccactatctcttcccaggaagtgtaagattgcatttttgaatattcaggttatttctaaacatgtagaatcaggaagtctaataactgaacacaaattagagagctattcatccagcagatttctagtcttggccagacattgggaccatctgcggttctttccaaagtgcagtttccagggtccatgcctggaatgctgaagaaacgggtcagaagttcacccaagacatcagttttagaagctccctgggaaattctaatagggaagcaagctgagagccactgggtgagcccagtcctcttattttaccgtgagatatggtggggccctcagaaaacactagctctcatcgttgcccagactcttacgtgttttgtgatttgggctatgttatgatctccctgagctgttgtttccccatttttaaaatggaaataataacagttgtggggactggggaagaataggtgaaatgagaaagtaaagcagctggggtagagtgagggatgtgatagacatcagcatctcttggtgaccaactgccactgctaatgatgatggtaatgatggtgatggtggtggttatgacagtggtgataatgatggagcactcactttaggaaattgtatatttgaggtttcattgtattcagcaatcccagttgttggctaggagcaggaagcgaagccccccattccctgactgtttgcaaaggcaattataatcctagagaattgacgtatggtacaagtctgttgaattgaaccaaatagccaaatgcaatgttctcctcatagctgaagccttgtatttatgtgattttaaacacattaagataatttactgaattggatgtctttatcattccatgattgctgaacagattattttactgtacaataccttgcattttataccaaactaaacaaagatagtactgtctctctttctgaaagcattcaagaaatgttgcctacttttgttagtatttaattttatttttagctacttgccacaggtggataaattaatgttttattcattttcttcttagtggagcttagcatattacccaggtaagtcactaaaaaccacattttagtttttagctcttaggagatgacatgtagaagggatatatgagaattcattaatactgcatattaatatatagtatgacatatatctattcgttaacatatgaaggattttttacttaatccaatgcacctcaaagatatttttctttaacactttgctttatctcttctttggaggcataatgacatccattagatactattaatcactaatctagaaaaaatacataatctttgcagactaattctttcttagttttggggacagtaagggcaaaataaacaaaattaatgggcatagtgaccatattcttttcaaattttaaattggagccaatgacctggcaaaagaatgacatttggctgggtgcggtggctcacgcctgtaatcccagcactttgggaggccaaggcaggcagatcacttgaggtcaggagatcragaccatcctggccaacatgatgaaaccccatctctactaaaaatacaaaaattagctggacatggtggcgcatgcctgtaatcccagctacttgggaggccgaggcaggggaatcgcttgagccagggagttggaggttgcagtgagccgagatcatgcaagtgtactctagcctggygacagagtgagactctctcaaaataataataataataataataataatttgagagtgacatttgtgtgattcgtgaaattaatcatatgaatagttttataaaaatgaattgtagttataaaaactaaatttacagttaacaatttgccttcattacctgcatataattttagaaacaggaaatagaacatagaatctatgttgtcacacgtgtttattgaccataaaattgatgggtattacatgcatactgatttgaataagtctttttctattattttctcattccttttaacaaatctctgagtaatttgtattatcacatgaaattttacatgcttaatggtcagaaattattatacttttgtgacactcaaattacctttgttcacaggatttcctactggagaccaatttgcacattttgtttatatctagagtattaatattcacacagcattttctctgacctgtacacatttttctccttattccattcaatcaataaattctcattanactattattaatgacctggagagagaccttatgtacacataccatatgttctctaatttatattcaaacaaataatattttttcaacccaatccaagagaattatgaaagaaaattaatagacagcatcaaaacctccctttgataaatctgcctttaatagaacagttaaataaagctcctctgtaagactgttgcaccaaatccacactgctctaagatgaacttcatttaagtacagggtacaattcctgagatgcagatttcagtgcttaatctggaagtagtgggttggaatctagtggctggacacactgtagaagaatacagacttccttctgtctttggatcttacaaaattttcatgagcacaccagaagaattttgaaatgttaaagagtaaacttgtagcagtgataaaagaaaaaaagacacaaattacttaattcttattgagtatgtattgtgggccaactatgcacaatagtgcttaattctttgtgtgtgttacctcatgtaatattcataatgttacctgtattatttcaagattataaaccagtctagaaaccatgrgtgcaaagatgaacatatgtgtttctatgtccttaccaaaaaggaaaacattgaatatccatacagaataactctcatatcaactgaaagatctaaattgttgggctaattatgatcattccccttttatagtcattgggaacacatgcttcataactgttctaggttactgtctttgtttatttgtttttatgtctgccccaatagttcagtaaataatgaagataaggagacatagcctctgttttcctgtccctcacagttcaaatgtgtggcagttggcatatagataattagaataatatacgaatacaggatccaaactttatctgattcttgactcatactctgttttcatagatgaagagtatgaactgagttgatttcattatatcatgatgcaaactaagtcactgtgatttccaagttaccaagcaggaaacacttgccagatttaatacaagtatttcttttttttttttttttttttgagacaaagtctckctttggttgcccaggctggagtgcagtggtgcgatctcggctcactgcaagctccgcctcccaggttcatgccattctcctgcctcagcctcccragtagctgggactacaggcacctgccaccatgcccggctaattttttgtatttttttaagtagagacagggtttcactgtgttagccaggatggtctcgatctcctgacctcgtgatccacctgcctcggcctcccaaagtgctgggattacaggcgtgagccaccacgcccggcctaatacaagtatttctacttggaaatctcagcccatgaggcactggccaatgattttggtaactaagtattttctttcagtgtgtgtaatgtatatgaattgttgaaagaagaaagttggcaaatactacataattgttacagatctgttagcatacttctttgattattaacttaggtttgaaactaaacttagagcttcaaaactcaatgaagtaaaacacatctaacagctaacagaaaaatggactgtgaaatagagtaagagataaaagccttgagagttaataatgctttaaatacttataaagtttctttttaattaaattagctgtaaatttgtcataattcaatattgacaccatggcccttctaagttttaccttaaagttcttaaattgagaaataattttagttcagtcaactcatgttattttcacgttttatgtatgattaattactaacaaacaattttatatgacatctacaattctaattcaaaccttgaaattatagtttttctagctagtgtttccactgttttccttttgttaattaagaaaagaacaggcatttaattgtatttaacttgtaatgaagtactaatgctttgtcatccactaaatttacaatatcagaaagattattgtcactatgaaacaataacaatttggtgctgcacacattctcatggtataaaaattttctgtctctttcacagtgtttttttaaaattgtggtaaaatgcacataatataacatttgccgtcaactcttacgcatattttaattgaacattgtttggggaaaagaagcaggtgagacagtggagaatcatttacgttgaaattgtagtttattctaggattactaagatattccttgctgaagttatgttttgagtcttcagtggaatttccagtcatcatcaatctgagaatcataggctaaaattaatgaactaactgccggaaaagagagacattcctcccaccaaccttccacctcccactagagactttgataatggtggttttgtttgtttgtttgtttgttttataacatacctccactattggtgaaatactctctggttaatagcccaaaccattcagtctcctgcctagataacctcctatctccagggtatctaggtgctaccagacacctatctgactaaagggtcatggttgtttaacagtgaggagtagccagcagcatgctggcaggtttggcaggtgttacctcgtggtagggagccatattcaatcactattgagaagcaacagcaacacatgagctggtcttaccaggtgttgcccaggcattaccaggcaatggtagggatgacccggtgttacccaggtgtcacgatggtgcagagccatatttagtcatcagggaggagcagcaggcagcacacaggcgagtgttcccaggtatcgtccaggtgtaacccaggtgtttccagatgttaccagtaatgagccctggttagggatcactgtggagcatcaagcagcatgctggcrctgagctgcttgatgttcctattctccccctagacttctgttcaccaaagctaccacatttatttcttatattcctaaccctgttgtgacatcaaataaacagaaagtgtcctccttgttcatcttccacttccaacgttgaggaaccatggcagcccttcactggatggcctttgcattggttcaggtaccctgaatggttgtagcaaacggagcttgacatgtacaagagttcaaacacgtgtgtacttgctttatacccatgaagcagttcaaggcagctgttcccggcagggtgctgtccttctccatatgggcagacagcattctggcgtctctcctcctgtggccccaccattccctcattccctacagctgtggtgccacccatatccagctaataaagaagaacacgggggcaccatcccccaccatctgcaagcctcggtccacagtggcacagaactttgctgattacgttccattcacaacaacrtagccacccccaggtaaaagagacagtgaaatttaacctggctatgcacaggcattccaggtgaaaatgcattttgataaaagaaaatgtcactttgataggagaaaagaaaacaaatacatctattttgttaaacattcaagcagacttcatgtgtctttaatggaatagtagttatcatggaaaccatctcccataaggataaaaggaggcttggtataaaagttagggttatggtgatcatcttttcagccatcttctataaagcaaaaagagggttagggatagggctgggtggagggctggggctggtggggctgtcttggccattctcttccataggaaaaaggagagcaagagcacagagagcatccttccctttctttccctggatgggacagcttttagaaatctcagcaactcctctgttcagtggcagaaaagagccattatcttccaattgcagctcctgtrttagggatgaccgagtgctgtcctgaaccattttttcctaaggaaaaataggcatttgataaatggctctttcacattactcaggctttttcaataatgcattcctctaataagtccagggcttcctattctcactaatggttgattgattctgggctcaaccaaaatgtcctcagcaagatgctgttcagaccccaactgtgtcacagataacataggtgtgggctgatttttaaagaagattcacattcttctactgcagaactcattgacaattccatattaataataaaggctggaaattattgaaatatgttcaattagaacgcttagacaactgtgctatacaataccaataaatatgttaccattgtgagaattgtaaagttttatagagctcctgctattttgatgagtatttatgatatatgagaaaatagccaggtgcaatggctcatgcctgcaatcccagtgctttgggaggcttagagtgggagatttgctggaggccaggacttaataccaccctggacaacatagcaagacctcatttctacaaaaaataaaaattagccagggatggtggtgtgtgtctgtagttctagttacttgggaggctgaggcaggaggattgcctgaggttgggagttcaaggcttcagtgaactgtgattgcaccactgcactccagcctggggtgacaaagtgagaccttaactgtaaaaaaaaaaaaaaaaaaaaaaaaaaaagggagaaagaaaaaattaaagagagtgatgtgttataagtgtaatgtatataatccaaaaagggccctcaaattgtactgaacaggttttgtgactataatcagtttttttggaaaacatctttgaccaagatagaatatatgatctgtgaacgtgggcgcatatacatggtgtttgtctgttgcatgcaatataaaatcatcacttatggattatgttcctttgagaaatcagcacaaaatgtcacttggataggagaaaagaaaacaaatacatgcattttgtcaaatattcaaacaaaggtttggtggggaaaaatgttgaacttcctttcagatgtcttggaaatcagacttcatgtgtctttaatggaatattttttaaaattcttctttgacttagcctctcttccccaagaagagctacgaatgcttgaccagctgtgagttcctcaaatacatcctgttggtgaagcagggggactgtccggctcctgagaaagccagtggatttgcggccgcctgtgttgaaagctgcgaagttgacaatgagtgctctggggtgaagaaatgttgttcgaatgggtgtggacacacctgtcaagtacccaagactctgtacaaaggtaaggggcagcactgggggtgtgaagacacatgcagtgtcacatatatctgtgtgtgcctagggwagggtgtccatcataggtgtgaaaagtctaaaaaacataaaatctttagaaaatttattttataccacatacagacatcttaacataatcacagacccataaagattagccatattaactcgacatggggcagagcaagtcattcatattaattctttttaatttgacatatgtgatggacagcaacaattcaggaacatttttgtctttttcttcagtcagactgattcaagtaagctctactaggtacactggaataaatcgatttaaatccttagaaaataggctggsagatgaagcacacttgaaaaatgcataacaaatatactggtattgtgctttttctgccgatatgacccaagaacattagtgtcgttgtacagatcttaaatattttcattagtaccttgagattctagacaaaggatttcccttcctcaaaacatggaggttcagtttatcaaacggtttagcaaatgcaatagtttatattcaaaagccgtttctagagcacttagctccttaatatcgagtgctgctgatcattttctgtaaatgggactaagctcttttaaagccaagatgaatccattgtattaggtatagtttgggataccatcaaaatacaccgtgacatataacattttgttaattttgggggtctcattgaagagttatatagagcagcagtccccaacctttttggcaacagggactggtttcatggaagataatttttccatgttgggggagggggcaggggatggttttgggatgattcaagcacattacatttattgtgcactttatttctattattataacattgtaatatgtaatgaaataattatacaactcaccgtcacgtagaatcggtaggaaccctgggcttgttttcctgcaactggatggtcccatctgggggtgatgggagacagtgacagatcatcaggcattggattctcataaagagcatgcaacctagatccctcacgtgtaattcacaatagggttcatgctcctatgagaatctaaagctgctgatgatctgacaggaggttcaggtggtaatgtgagtgatgaggagtggctgtaaatacagttgaagctttgtccactcacccaccacttacctcctgctgtgtgacccagttcctaacaggccacagactgctaccagtcagtggcccgggagctggggacccctaatatagagtcagtcagtaggcagtattcattaaagtacagagagagtaacagatgtctttctctctctatgtctttcacatacacatgccaaatccatattatttctaaatactggtacttaaaaaaaatgtgtataaagaagtattcaccatcaatgccagttttgatttatgtgctggctgcctatttttggaagtccatgttactctaacacttacaacaattcacatctcccagaagttaagtatctgtcccatcttcctttagctcccacttgggaatactttcctctgaaatctatgtaattcawccggttttttttttctttatcgttggaaacacaccataagtcctatgtcttacattcaaaataatcaatgcttttctcttcttaccaagtgatgtttctttaatagttttaaagttttattgtggtcatgcctcttattttaaattacagcaagtcacttttgcgaaatttaaaaccatctaacttttaaagcatctgttattatgaaatcttatctgtcattaaagataatatgctatgtatgagtagcattcaccataaaaataggatgctttgggaatcgtctttttaaacccttttgtaaaacctatagtgttttaaagagataatataaattaaaatatgcacttttataaaaggactgaagagttaatatgaatttcaaatatgcctgtttcacttgagaataaggggaatattgtagaacgggccagaataaatgattaagtatacaaagacactttcaatgtaaaactacgtttaacgaaaccaggtgaacttttgttaaagtactgaagtcactcttctactacaaattagctcttaacttagatttttgtggagagagagagaatcaatgggaatcaactacaaatagaataaacagactctgttaacctgacagtgacttttgtgtaatgaagacagtcaagttaatagattgttattttgcaaaaaaaaaatatatatatatatatgtatatatatatacacatatatatgtagatatatatatgtgtatatatatgtgtatatatatatatatatatatatatatatatacacatatatatatatgtagattttttttcttgctttcttcagtagtccctccaggaaggctggttttcatgtcctgggagctttgacagtgcctcttaatatgttagtgtgtgtaaaaggagggcaaatagagcctrcagcaactccttcatcatcttagctaatgaggcatttgaagtcccttttggcattcccaacctggagtccagctgcttcttcactctcaaaagaggagagggggactgatgtacacaagccccagggaaagtgtccgttctaacccatcccttggctttgcaaggagaaaaccatgtgcccagtcagcgcacaaaccaacctgcaatcttaggatactcgtgatcactgtctttcctacctccaagatgccttcttattgccccaaactaatgtgaaataagattgcctccctctctctgtctctgctaggtctgtgtagtttttttctttaataagagtgggagtcatggtgggttgagattatctagtcctgctctctgttcacagctgctgaaacagaggttgcaggctatgcctaagtgatttggtagtaggtagcagaaatagatctaacatctgctcccatctgggctagctctcctgtcatttttattttgaatgtatggatctctaatggaaacactcactgggcatggttgtgttatgatataataggctaactaaggtctgacacagtggctcacccctttaatcccagcactttgggaggctgaggcaggagttcaagagtagcctgggcaagatggcaagatatccctatctctacaaacataataaaattagctaggcatggtggcatgtgcctgtagtcatagctacttgggaggctgaggtgggaggatcatttgagcacaggaattcgaggttacaatgagccatgatcatgccactgcactccagtctgggcaacagagtgagaccctgtcccaaaatgtatctaaatctgttatccacctgtctatctaataggccaactaaaagatttgtcaatatagaatatttttaatccaacaaaatcactactttatgaatcattttaggctaatgaataacatgggattgttttacattgtagagttgaagcgtataaaactagatacagagtgtgctatatggagaaccacattctatgggataaatattgaaaacctgaagttcctcattcattcattttttatgtattaaagtgttgcatagtgctgtttggaaatccgaaataacattttcttaacatttccccggtttacctttacaaggggctgctgtcacttggatggagaagtattgacacatttcagttgaatacacatttacggagtgcctactatttgctgtcatctataatgggcattggggtgcaaggatccatgtgacactaaccccccacatggtccagtagtttattactgagattgtcatgctcacaatactctttaagtgggcaaattgtttttctaacctttaaataaatggacatttaccaacctctgtatatatttcattttattacttaatgaattaatttttaaaaatatttttaaattataaaaactcatacatactttctgtttggtctgctgtgtttgtggaagggaagatagaaagtactggttttatagcttcaagagctttttatactggtcacttgagtttttaaaagcgatgggtgtcttgaaaatatgattttgggctatgctgtaagaactgcacttaactgatgcctggaagtaagttaaccttcatagactatagtttaaaacaaacagcagagatcctttcttttactttttaaataaaattattagcatcaaaatgaaggcttggaaatattaacatgattggagatgcctgctggtactagttctatgaaatgcaaaacttcatatagttgtagaaagtctacaggtagaatacaaatgagtgcatttgggggcactcacttcctttttcctttctatttctatttcctctctaagtctattttatggcttggtgagacaatctttcctccagagggtgatatattttactattttgttgccaaatcccactgcctctcttggcttccaactgtagcaaaaatggtttgggcagggagaaagaaaagttaaaaaattttacaaacgtaaagattcagactaatttgtgacctatagtttccttttgccatggataaaccaagaattaattgtacttcagtctgtttcttttcaaaaagacccgatcatagagttaatttaatatttccacaaataattaatatatcaaatagtgaaacttcagacctctggaaatagatttatacaacttctcacaaataaattttcaacattttgcatccagtagcccaatgccttaatgtgatgtaaatacaaattctagagttctaattacctttatgagagatatcaagtagtgattaaatcactagaacaatacatcttgctacatttttatatcatttagattcatgataaaaattaatagtaataaaatctcacaatgagtatgcaactgtagattgcttatcctaattgatttttctatccatatattttcaacatttttaaaaagcattgggtttctgttcctttgatttcagcagaatgtttcttgcatttcaaagaaaaaaactggacgtcacatattgcagtttgccatacgataacgtttgtaaatttttcaacagaatcatttagatttcagatgactaatttgttcaaaagtaattttaaagagaaaaatgctaatcatttacataataaaaaacacattgagaagagatccagtctatacatctggttatgcagttgggatgctggttcagccagtgaggactgtgcgccccggcagtgagggctggaggtcttgaggggggttgagccccatctgcacacaattacagtagagcgctggagttacttccaatcaaaggagccaactgactttaatggaaagcagatggaccatttcttaacatgcaaattgcagggtcatgcttcatcataattaaagagatttttaaatgaagaaatttgaactgacatcgccctgatgctcattacatttgattaaggctgttggtccttgaatgctattcaagattaaaaccttacagcgagggcactgggctgcttggattggcttctggtgagttcaggtcacttcggaggctatttactgtagctatatttactctagaagattatacattggaaagccaaagagaaaggtagattcagaagtctcggagaatgtgctctatgagtttgaagaattggtcatcatttttttttactatgcaccaaggaatcaagtaaatcatgaaatgttctctgcggctactctccctcgccttatccccttcggtagaactatttgtctggcatatgcaggccacccttcaatgcaagaatgatactaaatgatcaccttgttgagattggtttttcatcactctgaacaaattttggtggcttttttcttgacacaaaacatacagagctgcttctattaaaatcaattaactttgggttttctctccgatcaggaattggtcttttttttctttttaatgggaaagtcctatggtcagtgtaataaaaacgttctatcttgtaaacattttggcattgctttattttctggtatttatctttttaaaaaacagagtgaatgtacatgtgagtaataagaccatgctggaaaagagatctgagttgcttgaaacaatatatgataaagatggcagtacagaatacttatgataaatcttcacccttccctaggtgactttcaaacagagtagggattaccattgttgcagtggtttgcataaatgttgcactagtctcttatttccacagacatattcttgagtgaagaataagaaagtgggtttggctattagttcagcaaacattgactgttcattgaacatttgctattgcagaatgttctcttctgggacattgtgaggtgcgggaatgaaggagacatggtttttgacctctgggggctgtggcttaatggaaagacaggcatcattaaatgaatttgctgcagcaagaggcagttaaatgcatgtcttgacagttacaggctcaacattgaaggggggcaaaagaataaagcctttatttccaattgagaagtttaggggaagtgtcacagaggggtggcatttggtccgagcctggaaatattcaagggcctacagttagaaagcagaaggcaagacatttcagaatgaaaacaaacaaacaaacaaacaaaaaaaccataaacaggccatggtattattaaggacctggcagtgtatttgtaggaaagctgggtttaaagataatatctgtgacaaaaaattaaagatgtaccaggagatagattgacaaataaatggtagccaattatgaagaaggatgccttgaaggggatgccaagaagtttcccttcattctatagagaatgggatgcaattaaagagtttgggaaactgaaggagagaacctcgcttctacgttagaaaaataaccccaaagtaccaataaggggacagtagcaaaagagattgagatgcagggaaataggttgggaacaaggaagggagtaaagtcaggtggccatcatggagacaaaatgatttgataattcttgaaaatgtactatgcagtaagacaactaaatgttgttagctgcaagaacatatcaaaaaggttctaagatcccttagacatcctaaagaataaagttgtcataaagatagatatcccaggagaaggggcatatctgggacagagaaattcagcaggcaggtggaaaagatggtctgcagcttagccagggattagagatagactggaaaaacatttgcttagcagcagtatgctaatcatccaagtctaggtacccccattgctatggttatgcactgagatgaaaagtttacaatacaagcttgaaataaatgcatgtcatggcagaacaggagtcaaagactgacttggtgaagttccagatccaccaggaaagctgaggatcttagaataagartgtccaagggatttgcatatctatcaaaaccatctcttttctctatctctctatgtggccttttctaatatgaaatgtagaaagcagcagataattcagagagaaacctgagatcagattgtagtcccaggcaactaatttaatattccttagattcagttatctcctattcaacatgtagataattaaccctttacccacttcacaaactcacagtgaggatcagatgagacaaatttattgtaaactaaaggtcactactcagccatgacccatcagtaataaaggagactgcaataggtatggtaaacattttctccagaaaatagctttttttagattaatgacttttgaccatatataaatatgctttaaaaaaattattcaattccatccatccaaatatttgatgactttaaaattttcgtaaacaagacttaccatgaattaagatcaaaatgaaataggagttgaaattcaaccatgtcaacatgcatcaaaccttatttgcatttggtgtttgcacattttccagtttcttctgtgtttaaacttacaaaatggaagaagaaatagagcattcttaactagcttttgaaatgagttttcaatgctttcagcaaacgaccattgtgtacagaaaatgctattaatggtaattggtgttcttggtgttgatggcattcaccatcatggagccatagattctatttcattcagttagttttgcatattctattagtattacaaatttctttacaaattccctttctgaaatgcctgctattttgaactgtggttcttcaatgtatcagttgccagacaacttgcatgtacagaaggcgataaagaaatcagaatgattaactactttaaaatgaaacacctgtgagaaacttttgaagcagcrcactcactcatgccaaaaccaaacattataaattcattattttccaatgttaagccattaagactatatataggggaatgcttgagcaattgattgcggaatccaaaagacttgaactttggaaatcactcttaggagatttcacatgaagagattttgctttgcagtgttttccttaaatgaaaaactccctgagaaagaaggaagatcaaatctggaaaccatgttataatgaccttaggatatatcaatagacacagagcatgataaaaaatgggaaaatgacttgaaactctttataatgatctcctagtgtgaattccatgttaacctcaaatgaaacaaccttgtaacatgatttattgaaaagaatgcacatgaaatgattgctctagagattactagggaataagccacttgttacagaatcaggaaccaatttagactgtcttattaaaaaaaagaaaaaaaagacaagttaaaagaaaaaggagcaaatagctgaactgagtgtcagaagacttcagatgtgaaaccctgtatggagaggccacttttatgaaaggaaatctcagttgtcatcagatcagattcatctcttccatatttgttcttcctcaacttttacttcaatttgagtcacacgcagattgttttaattgatacggtcctgtttcaggtgtccccctgaagcccagaaaagagttacgatttacagaactgcagtctggacagctggaggttaagtggtcctcgaaattcaatatttctattgagcctgtgatctatgtggtacaaagaagatggaattatggaatccatcctagcgaagatgacgccactcactggcagacagtggcccaggtaagaacctcatatagactttgattttcatcctggaggtagtgtctgctacatagctacgcacaaaaaattaacttgctatgcctcaaaatagcttgactacagaaataaattactcagatatgaaatgaacatcatggggtcttctaaagagaggatgaggttcatagatacaaacgaatgtgctcggaaactcgaccattggcttaatttgttcaaatacacatggaagggagataattttataacctgattattcacatgtattttctccaagaaccacattttcctcagctaaactcaaagccaactagaggaagggaaatgcaacattataaggactaatttgacatttaataatctaaatgccttctcttctgtttctcctgcatttacacctttattccacccacagactttaggagcatggcataagatttgtatcacaaaattacttagtgggacatagccagcagcccataaatcttcactaagtactttcttctttgtcttagtcaacttaaaaactgatataccacctgcatggcaacactcccagagagtgcttcctcctcttctgtcttgttgatgagaaaagcaaaatattttctttctttttaagagctgttaaatccagtaccagctgctaaccacccccccacacacacacacaaaccctacatggatataaaaagtaacagattctgaatgtgaaactgtttcatgcctttagacaactaaaatgccttctccacatctatgtctataggaaaaaaaatctcaccttatgttgattagatcattttttccaaggactagattcctatttttttttttttcagtaaatgtaaaataaatgtcaatatttaggtgtttggaagaagaatatcttctaaatagcagtatctcaaaggggttaagcactaaaataaaacaatgtaaagaccccaaaataaataagaagtttgatgtaaaaacacaacattaaattagaaaaaaaaaaaacctggtcaaataaatttagtaattctattctatacctatattttatataaaaaaaatttgcttcagtaaaacataaagctaatcagaatacagcctgaaattccatttgatttacacggcatgctttcataaatcgtggtacagattcatttgtaatttttccaaattacttaaagaattatgaaagtaaccagcaataagaccatctcttttatctccaaaagatttttggaaagtgaaaagctcttttattattgttgctggtattattttttactgttagtgctacatgtagtacttccttctctgctaaacgctgtggataccatgctgactttaagctttttaaattcgcagctgaaactctaaatgatgaagttgaaagtgttttctcaaagtctgccaaatcaggtagaaagccacatgtaagagttcatattcttcctttgatctcagaaatgttcagcttcttttagatattgatgtaaacgtgacagtcattttcacattaagttattttaagctgaggttattataatctgaagtttgggagtgttcaaatccaatcctgtttccttagtttcatccacagatccaagttgagttcggcacctggtgtagatgagggcatagactgtagatggttatttcttggaattcaaggcaaaggttttcagatctaccaatggaaacaaaacacagaacattgttgaaagcaggtatatagtatgaagactgttaaagttatttgatatcttaaaattgtagcactagagacagcaaaaccttctgatcttccccagtgtctatttttttccttttgggcattttattgagcaaatatatgctaacacatctcacccttttagatcaggactggttcttcatagatgttatgtgacttactcaagagatttttaaacagtggcttgggttatactttacttccagaaattgctagtgggttgcatgtgggttgttatacctattttacagttatatttggcatgtgagttaaaaagacattttctttctataatctgaagatgatttcatcttcttgctgtaatgtaacaattactatacataaatattctctattgattgaatatctcaaatgctgtaattagtcaccagatttaaaaatagcccaagctcttgtcataaggttttgacttcaagagatgtttaattctttggggtgaaatatcagtggttctttgttccctgacagctctcttcataactgggcatgataagcccctcttatcagggggaagacagactgagttgcattggctgatgggttagtgtatttttctaaacagatccaactaacatgtcggaataaaaagtgacatgttccctgtgctctgtgacatgtcccctcagaccacagacgagcgagttcaactgactgacataagacccagccgatggtaccagtttcgagtggctgctgtgaatgtgcatggaactcgaggcttcactgcccccagcaaacacttccgttcttccaaaggtcagtcttccttttcttcccagacacagaatactatccttgctaccaggcacacatggaatgcagattcactgtctctatgttcatatttatagttagtcaacaggtggctttgctgttttagagaatgggaccagatgtgtttgaaggtaccatgtacatttatggctaaggacaaaattggaattttacctgcagtatatcatagaagataacataagggagtttttttaaactttgaagtggcgggggggttttcattatcaacatctgttgagtttttgctttaagatattctgtatcaaacaccattcaattgattttcaaagagaaagactgaattttagctattctagacaaaatagcctttcttgaaatgattgttaaattgaaagtgaatttgactcctacgtttgcttcataacatctagaatttaaacccctcctgagtcatttaatcattgctataattttgttcagttctgactgccttgatattttaaaacctctgtgtaatcagatcaacagtgtgttacatttgtggttaatctgtgacggttgaaggacataatttgaccagctattaataatatcttcaagtttatttttctagttgcatccatatggctgtgtaccttccaaattaattagacatctgcttgactaattataaggatctggtttcataaatacagattagttacattagtctcttactaataacaagtcatcttcttacacagaagctaatttaaatttattttattttaagtaaatttatttattgggacattaacaaatactgtaaccttacatttaaaagcctcttttttttaaaaacaaacaaacaaacaaacaaaacactttttttttctcctcagggaggcaaattcatgaactaagcaaactttaaagtgaaattgtaaataaagacatcaaaccttgtcttaagactctgtctccaagtgatttgaaaatttagagaggcaagtgaaataaataattaattgtgggttaggaggtagttatcaataaaaagcctcagaatgcttcaccttgagtttcatggttcaaatgcgatccagagatgttctggtcaaaatatattaccatctgttcagttgcctgcaggatttgggctggtgctctgtgaataagactgcaaaatcagacctcagacagaagtggttctcagcctctagagacagatgctgaattaatttcctgtaagagttgcagtggcacctcctgcctagtggaggtgaccaaggtggttttgctctcatgatttgttacagagccttactatcacaagatcctcaggatctgggcagaaatcctgtgacagccccagggtcatgagggtgctaactgaaagtaggaaggccaagctgtcctgacacttcctagtatatcggagcaacttataatctagaatggaagctgcatctcccaaatttaagtggacttttattgaatgaaaatgcaactattgcagttttcattaaaatgttgttctgtcactgttacaaatatacccaaaattcacattgcatatgtctcattgtgaggagcatcccaaactttagttcttgcaattttacaaaccaaaaatgtctgtacagaattcatggaagattccattatattttcagtgaagatgagtcctagaatgacgggagtttaacatatcagccaaagggtggtagacattccctctatgatatctttaaagcagatttaatcactaacaaggtgggacaacatccttccacacttttctcattctcaccaaacgttgaaaacagcctcactgggaaaaatgttttaaagaactttattgaaatataatttctataccataaaaatcacttattttaagtgtacagttgagtgatttttagtatttactgacttgtgcaaccatcaccatcatctagttttagaatgagtgcatcaccccgataagatccttcatggcttaccaggaaaatttaaaggtagaaataaagttaattctgtgtcttttgcctcttttattacccatgtatctgaactgcagtcctatagcgtgggagtatcctgtagcttggtacttgatctattccttagaaaaaagcctatttgggaaaaaaaaaaaaaaaggccaaaagcatagcagtcacagtgatcgacaaatgattactctctttctggaaatacgagcatccccaaggaaattaaggacttttcccttaagcactctttctctcaatagcctccatttgagtaatcggcaatgctgctcttgcagcagtttgtggcaaaagaggcctgcagtcattctccactctaaacattttctgcaagccaccgcaaatcctcagatctgccttgattcacctttccctgtgtttcccctaatccgctcagttctgtctttaactgggaattgtattagcttcctaatcacatccccacttctgcctcctggcttctgccttaaggcttctggattcctgtttcctgatcctggcccctcattcctgctttcggatccccacttccggatcctgggtttcagacccaggcctctcatccctgcttccggatttccacttctggatcccctcctttttagtcctctctcaacgcagccacctgagtgatccttctaaaatctgagccacttcccgacagttttttgctcaaagtgtcccagcagcttcccccatctgattcagagtagaagccatgttctttacaatggattttaagacccagttgaccccccctttctccttcctcttagacttcatcactaccctccctgttttcctgctcaacatgctaggctcctctgtgttctctgaatactataatctttcccttgcttcaggatattggcatttacctggtcctggaccggggatatgctcttccttcagattgttgaaaggctggctggctcaccttctttatacaaatatctctattccagcaaaaccatctttagccatgctacttatatgtgtaagcaaacaagcaaacaaatccacgttgcccgtgttgtatttttgttcttattttctgttatgactgtctaccctgccttagtattttgcttgttaatcttgtgcactgtttctccttgcactcaattaggatgaatgtgtgtgtctgtttctgtgtttcataagaccagatgtgttttcttttttacttcttattcccactgcctagaacagtacctgacacatagtagctgcccaacaaatccttgttcaatatatgaggaaatgaaacaagagtaataaaaagagaaggtaaagacagaaaatgttgtgttgttgtttctacctttaaattttctcagtaagggatgaagtatcaatctttttgggttgatggactcattctagaacccagtgatggtgatagttacacaacacagtaaatataagaatgtcagtgagcacttaagatgagacaattttatggtatggaagttacatatttcaaaaaagttgttaaagacattttttcgcagtgaggctcttttctacatttgatgagcttgagaaaggtagggaaagatgtggcagcatcttgttagtgtactggttaagtctcctttagacatatcctggagggagtgtcttccaccgttttactgatttgttaaactcccataattctgtgatgcatctttacggaaaacataatggaatctactatgaattcagtgcttacatttttggtttgtaagactgcaagaactaacatttgggatgcacctcaaattgagacatatggaaatgtaaattttgggtgttgtattagtctgttttcatgctgctgataaagacatacccaaaactgggaacaaaaaaggcttaattggacttagagttccacatggctggggaggcctcagaatcatggtgggaggcaaaagactcttcttacatggtggcagcaagagaaaatgaggaagaagcaaaagcagaaacccctgataaacccatcagatctcatgagacttattcactatcacgagaatagcacgagaaagacctgcccccatgattcaattacctccccctgggtccctcccacaacatgtgggaattctgggagatacaattcaagttgagatttcggtggggacacagccaaaccatatcaggtgtatttgtcaacgtgagagatagaacaacattttcataataactgcaatgaccgtggtgtttcaaaaaatggtgcattttcattcaataaatgcccatttatccctgtttgctccagaattgaaactgtgccagtcttccagtggtttaaaattacttttaaaaaacagtcaccacttccaaggtagtagtctgtgcaaggagtaagcaattatctagtgtatttggtttgggtagagagacagtgttgataacttaaggctgggtcaaggaaagcaggaagggtttttatttttatttttttcatctaccatgaatatctcagcaaataaaagtaaaattaaacagcaaaaataggtaaaatgagttccagttagtttaggctcactgcataggattcatggactataaaactgattttcatggaaaagccaaacttcttgtccttatcttctttatagttattttaaaacacaaaattagtccgtgtttggcaaaatggattgactactatttaatttcttcttaactcatttattttcccataacttagacctaactcaacattaactatttttatagaaaattctaagttattcatagattagtaaattagtttcatgcttttccttttcctggggaataccatttctgagtatttttattgctaactcttacccctcccagaaaaaatgcataaatataggatgggcaaaatcattaattttttaagagttttggataatttttatatttgcctacttaaatactgtatttcttcctggtacttgagatgggaaattggctttgaaattaaagatgcataatagtttaatagattaatgcctagtgctcatttctactttttgtctctttatttagaatgtgggactgcatctttgcacatagtaagttaccttcacaggtcattcctgggggtctacctaaagttttctatcccattccatttggaacaaacaacatgaaacctctgagcacgagatgttgatatgtctgcatattgctacataagttgatatttgctgctttgaaacacagatttcaacaaatagagattgcccatcaaagatcagacaccttcagaacctgatccaagtgaaggctttgagtgtgagcagtttacttaggaagtgatccaagaatgtggtaggtaggaagggaagtaggacagggtgtagaaggaatacagtaaagggtgaattatttaccataggcaacctaagcttcctctccacggggcactcagggagctagcgtgaagcacacacacctcagaactcctcgctggaggggggttaagggtgttcaagtcagtctttgtctgcagctgttcctagcgtatctggtctgcatgctggcggagcttgctctgagcccagacacagccttaggtgaggaggtgtgggagggcattcagaagttgagctggtgtgccctgaaacagcctagcacaagaaagtcagggtgggaccctgaaaacatctgttgtttacctcttgtttaactcaacatcagcgtgattcctgttacagagtggatctaatacattttgaattacggtttaaaataaatatattaatagtttcatgaataaaatgtgatgaaatcatgaaaggaattcccacattactaaatattcctaatcttcttcctctatggtacaaagttaataatcagacacaggcatccctttctagtttcttttattttcacctctctcatttcccaaaatctgacgagctttacattattgttcacttcttggaatgagaagaccactaatgtctaaccaacagagagcccagattttgggaatgaccaatttggagtcagggttacaaatataaaaacacctttgggttccatgttgcagttgcttatctttttcagtaarttggtgtttaacctttccttgatattgctgatatttatcaaatgagtaaaaatagttattttacaaataaacattcgtatttttacaaataaagtaaatacaaaattacaaaatacaaaaatacagaatattgcatgcttaggattggaaatatatattgctaagtagctactacctattacaaaatagtatttaccagtttgctgaatttgggaaataatgtgtttgtttctggctactgtgactacatctatgtgtcaatatgggtagtaaaagaaggaagagttctgattttgtggattgtataaggcaaaatccaaattcattttttttgatatgttgccaaaagcgggcaagcatgtttgttcatttgaaattagtcaatatcaatttgacatcacaaaataacacacttttaagggatcttatgaagaaacataaaaatccaacttaaattatccttaacctagcatattatcttttagtaattatattcatttccctctaaattccaagttcttcatccatctttttctccttatttctccatgtgcataggatacattacaaaggaaaaggaagcagacagcattgttttcacagcatataagtatcacactggatgttattccatgcatgcattacagagtgtcagtaaaactagagcagacatcactgatggtaataaagttccctgttgccccgtggggacccatgactttttactctgttccacagctgctcgggatgtgccatttccaatgggcaaaaggcttggctgtacatatgtcttgaaactatttaatagttggaaatttgcctgcagtgtagcttcagcagctttgctaagtttttttttttttttaagggagaaggaacactaccccaactgccaagtctggaaagaaaaaaaaaggtttaaatatyattagaagcaaacttctatttagttgaaaactttgtgacacagttatattattgtttttaaaatataactgcacttgaccaaagttacatcaagtatataccataagtataccttatgaggtgttcttangatgcgtttcagtgcgaagtttaatctatagacattattggtagaaatgaaataagtaaaatcaacattcattttcttgaaataggtattgttctccatgtgcacatgtgcatgtttctttatgatgatctataatcgttgctctctttatggcctcatgggtttctgtatttaacaaatagtgttgtcttaaacctagaggagcctgcctcagaaaaagtgatggcatttctgctgggacaagcagaagtggtcttttcccatgagattcatgtcagtgcaataataggcctgcatttctccaagggtgataagtgattttattgtcactttacccaacataggctcaaagtctttccattgtgtcaaaccttcgtgcttgttactttgcctgtttgtggcatgaaacacaagaggttaagtgatgaaacctgaaatttatctttctgaaatccaaatgttccatctttctctcctgaaagcaccacatgtgatcatcaataaaaggaactatttttccccaaggctgaaattgggtatacatgctaaatatttagcatattttacgttggtaatcacactaattgtatagcgtagaaggagctaatacagccttcctatttcagttatctctgaaaatgtgcttgctctctgcagtgtgtttctgcagataattgtgaagatcataaggagggagttggcatcaaacagaaagagaagtgagctgggggaaaatgcccagatttgagactcagaggaagggttaggagagcactggtcttgtggtgtgmctcccatcctctcacttgaagaggtagtaaatcaaactctgctcttgaagtagtgaatcaaactgtgatcctcaatttcmccatctctaaaatragracaataatgttaacatttaatagacaaaatgcagctgtatgtttgtaaaattagggataaacagtgctcatgtcgagtttcctaaacctaatggtttcacactttttgaaattctcccaactaggggagagcagtctgtggcccagggtccaaatttggcctgcaacctggttttgcaaataaagttttattggaacatagccacactcatttgtttacatattgtctgtggctgcttttgagctatgagggcagagttgagtgattgtaacggagaccatatggtccgcaaagcctaaaatctttactatctggccctttccagaaaaggcctatcaatgcctgcactagcctattgtaacagacacttttcccattaaaaggctttgaatttttacattctgtagggatattgtcccttattttgatggtggaatatatatgtagagtgtggcatgtagaggtgtgtattgttagaccttcaaccccgtttttctcctttcctttttgttctcacgctccttgttctgccatcaatgatgtgaatgaccttggacatatatctttacctctctgacccctaaaaccctccccagttaaaaaaaggtgaaataagttgtaaaattccttagggctttataataacgtatagagtttccctctctgactctctggctctcatcagccactgtctatttatgcatatgtacatctatatatgtgtgtgtgtgtgtgtgtgtgtgtgtatgtgtgtgtgtgtgtgtgtgtgtatatatatatataaatttcacatggaaatctccaactacatttcaaaattctaaaacaattaaaatatcatgcataatgaaagaaaacattctgtataattcagccgaatgaatacaccttgcttcataacgtagggaaccaattctcaaggcagagaatgacttagatatagaaacttgttaggactgagtaaaatgcttcagattagagaaactggattgaccctgtctcacctgaaccccatagtgaataaatggataaatgaatggctggtttacagaggagaatcacggcaacaaacaggtgatcgctgccactctcttttggttttgttttctttttgttcttgtttttttaagagccagaatctcactctgtcatccaggctggaatgcagtggtgcagtcgtacctcactgtagccttgaactcccagactaaagcagttctcctgcctcagcctcctgagtagctaggacaacaggcacacaacaccatgccccagctaatttaaaatttttttttctgtagagacagggtctttctctattgcctaggctggtcttgagctcctggcctcaaacaatcctcctgcctcagcttcccaaagcactaagattacagacgtgggtcmccatgtctgacctggttttacagttttatggtgattattttgggggagaaagagatgggagtaccttatcttggtaatggaagtttgccattttggtattgtaaattcaaaatgggccttccttttgagaaaaatgtaaagaaaatattattaattcatatcttttaatgcattgttttctcaaatgttgttttcataaattgtgttgtttcatgtttcataatgtttcataaaatagatgatgttattctagattattatgataacatctaagaaaaattttccagggcaggaaatgatgtaatgaataacataaactaaagaagatgatcaaattcagtgaccttcttaaatgttagagtttctttagaagaggagattattttgagcttttccttctgagcctagaatatctgcaatattcatgtgactacttattttcagcatatagacattcaggtgcattgccgagaacacgaacggctgttattttcacacattttaattcttctcttgccttgaagtgacgattcagttgtaaactaggttccctcccagaaaggttggtaactaccttttgtaggttaaggattgattcctacaccagaggaagaggtgttgctttaattattttatttcaaactgggaagaacactcctttgattttgcaattcactttaggatcttgtgatctagcaattctgattgacagagtttgaacctgaaactgaaatatcacattacaaatcaaagctaacgtttagaagcctgtccttcatttattcattcagcaattgcttactgagcacatactgtgtgctaggtgctcttctggactctggagatacagatgtgaaaaaacaagcaaacattcctcctctcagggagctttcattatcgtgagtagaagcagacagcaaacaaggtacctaataagtcagtttgtgtattagtcacggttctctagagggacagaactaataggatagatgtatatataaaggggagtttactaaggagtattgactcacacaatcccaagatgagttcccacaataggccatctgcaagctaaggagcaaggaagccagtccaagtccccaaaactccaaagtagggaagccgacagtgcagcccttcggtctgtgttcaaaggtctgagtcccaaagctgaagaacttggagtctgatgttcgagggcaggaagcatccagcacaggaggaagatgtaggccagaagactaaaccagtctaaaatttccacattcttctccctgcttttattctggctgcactggcagctgattggaatggtgcccacccagattgagggagggtctgccttttccagtccagtgactcaaatgttaatctccatggcagcaccctcacagacatacccaagatcaacactttgcatccttcaatccaatcaagttgacactcaatatttaccataacagttagtaataagggcttggagaataataaagcaaggcataatcatggtgactttttttttttttttttggtaaatggagcaaagcatatgtagctattttaaatagggtcaccacctgcagcaggaaaggagccagccgtggagacatcagggaaagcgtttaggcaaagggagaggaaaagcctcagtagcatcgcggttttcctctccaagaaacagcatgggaaccagtgtggctgggctgaggggtggaggtgataaaatgaaaggtgctctgggaggtaactgaggcacgggttgcaaggcattcaggagactcctgggtttttaccctaagtaaggagattctgtgcacaggagtgacatggtctggcagtatagaatcatcagactgctgtattcagaaaaacctctagggaggcagtggagagcccttggcacttggcccagggcattggaagtggtaaaaggcagttaaattcctgttacactttgaaggtagtgctaacacaatttgctcaagagatatgagtggaaaataaatgtatgacttcaagggttggggccagagcaactggaaagagcaattcccatgtactgagatgggggtgtcagtggtgggctgtgtgtggtaggatatgtgttggtggtgggctgtgcatagggatcatgattttkctttgggacacattagttttgaaatgcctctgagacctccaagtggagctactggaaggtattttttgagtattgatatttgaatgattggatctgcattcaggagcatagtctatgttaaagatatcaatttgaaagttatcagcacaaagatttttttaaaactgtgacacctgatgagatccctagagagtgagtgtagatgagaagagagaggcccctgaattcagatgcagaacactctcctgtctagagattatgagatgttaaggatcatggagcatggggctgaaaaatagcttctgttgaaactgaatgaaaatccagtagagaccaggcgtggtggctcacatctgtaatcccagcactttgggaggccaaggcgagtggatcacctgatgtcaggagttcaagaccagcctggcaaacatggtgaaaccccatctctacaaaaatacaaaaattagccaggcatgatggcaggtgcctgtaatgccagctacttgggaggccaaggtgggagaatctcttaaactaggcaggcgggcagaggttgcagcgagccaagatcacaccattgcactccagcctgggtgacagggtgagactctgtctcaaaaaaaaaaaaaaaaaaaaatccagtagagtagtgtcctgaacaccaaatgaagcctgcatttcttagagaaggaagtgatcagcagtgttgtgaatattgatgactgggggagtcctcacatggctctgccagacctccatattggggtgcttcccattccaataacgacaggaaaaatacatttcctccttacatatgtgatgttcagacctcataggagccacctgatgcagtacttttgacctgcaggtcatctacctcatattacctgtgtgtttcatataagatatacataatcctgggtcccacctgcactcagggaatcagcatatcccagtataagtcttggacattccagagattcctgatgttgattgagaatgacttgactcagaaataccatttgatccagcaatctcattactggttatatacccaaaggaatataaatcattctattataaagatgcatgcacacttgtgtacattgcagcactattcacaatagcaaagacatggaatgaacccaaatgcccatcaacagtagactggataaagaaaatgtggaacatatccaccatggaatactatgcagccatgaaaaggaacaagatcatgtcctttgcagggacatggatggagctggaagccattatcctcagcaaactaatgcaggaacagaaaacgaaagactgcatgctctcagttctaagtgggagccgaaggatgagaacacatggacacatggaggggagcaacacacaccagggcctgcttgggggaggtggggaggtagagcatcaggaagaacagctaaatggttgctgggcttaatacctaggtgatgggttgatttgtgcagcaaaccaccatggcacatatttacctctgtaacaagcctgcacatgtaccctggaactgaaaataaaagttaatttaaaaaaaaaatgacttgactagcagtatcacataatatgctttcaattagcctcttacctaaaaaatactatgaagctttcttattttagaaaataaaggaactaacctaactaaatgtccagacatgatatatcatagaggaaagcaagaaatttcaaaaaataagttatgtttccatcattccaaaaccacaaatgactgagaataaaaacaaggattttttttctccagtcttcttcatgtatatcaagttagatattacttttttgagcctccaacacagatggtgctataattagaattattgacagcatcttcccgtgatggcatcttgaaatgaaaccctctgtaaatcactggtggtgagcagcatctccacttgctcaatttgtaatagaaaatgaagtaaagaccctccagctttggtatatttaatcttcttcatatatgtattttcagtggagatttgtgaggtggtaattccagcacctcatctttctcttgacagctgagaaggtttttgttaataagacaaaccagaaatggtacaatcacaaaaatgaatgctatccataagtcatccagtgtgcaatgtggataaaaaatggtgcaggtttttatattttttttcttttctgatttccctttattgttcttaactgatgcaagaattgctagctacagggcacgaagatgaaaacaattgcttttatgagctgaatttctttttcttttcagagtgttaaaaggtgattctttgttgcttacctatttaatgtcaattcacccacattgaattgtactatattttactaaaatatgtcaatttcagcacagtaaaaatttggctgggttgccgtggtatggaaatgcctaaaacgatccttctgtattacaaatttggaccaaacaaatttatcttactgtttaatactctatcttttaatttgaggcttaacaaggagatcttacttaactgcttgttttcagctttgcctttcttttactttttttttttttttttgagacagtgtctcattctcttgcgcaggctggtatgcagtggtgctaatcgcggctcactgcagccttgacctcccgggttcaagcgctccttccgcctcagcttcctgagtagctgggaccacaggcatgcaccaccctgcccagctaattttttaaattttgtagagacagggtttcactatgttgcccaggctgtcctcaaactcctgagctcaagatatctgccagcctcagccttgcaaagtgctgggattgcagacatgagccaccatgcccctccacccccgttttcagcttttctatctataaaaagcaatgcttcacgtgttgaccatgtagtcattacatgtccaaagatgttagttttgtggagtcatatgatgtgtctttgtactgggatttcagatccatctgccccaccagcaccggctaacctccggctggccaactccaccgtcaacagtgatgggagtgtgaccgtcactatagtttgggatctccccgaggagccggacatccctgtgcatcattacaaggtcttttggagctggatggtcagcagtaagtctcttgtcccaacaaagaagaagcggagaaagactacggatggggtgagtgggaactggaggaaggattgttattcccacagagggtatttcaactcaaggcaactggcctgaaaagaggcctctgctaaactgagagatkccatggatgcaggaaagcttccctcccattyatttctaccgaggaagttcacagaatgcaggggcatgccggctgttttgccttttatattttaggcagaagcatttgcatttagaccattgacctactcctatctaaatgtcagtcagaactctggaaatcaaaggaacagtttaaatgatccccatcttacctgtctggccatagaaaatgatattatgcaaaatgtactttacttttaagttttttttttttttttttgagagagagagatccttgtaaatggaagagtggatgttcatggcttttctgttgcgaagtgtttccgtctgtaatctaatcactgagcagtaacagcttaggaaggccacgtctcacaatatgttcttctcattgattaaaaggatctggagtggtttatccgtcagatgccaagaaataaaatcttcattgaaccattttctgcaatgagattcttatgataacaagcatcttgtattatttgaaatgcttactgcataaaaatagttatttggattccttttagtatacattcctttatcttgtcataaaatttacataaataccttttcctatcacttataaagttgaattccataaataaatgtttagaaatgaaaagatagcaaggctaaagatttcaatatctgtgctcttcagaattataaaacatgcctcaaaaagttggtatcattgatatttagccattatactattttaactttatttatttatttttgagagggagtctcgctctgtctctcagactggagtgcagtggagcaatctcggctcactgcaagctccgcctcccgggttcacgccattctcctgcctcagcctcccgagtagctgggactacaggcgcccgccaccacacccagctaattttttgtatttttagtagagacagggtttcaccatgttagccaggatgatctctatctcctgacctcgtgatccgcccaccttggcctcccaaagtgctgggattacaggcgtgagccaccacgcccagccccactttatttttatgaaattttatgacagttccattttttatattgaaggattttgctacaaatgataatggtagtgcacacttattgcatgagctggaagagctgaaattggggaatcacttaggaatctagagcaaaaagtgacatgatgaaatgctgacaggtcccaccctccagccccctgcccaatacattatgacagaaaataatgaagcaccttgaagcattttgtcaagttaatttttcttttgtatagcttttggtggaaatttgctcctagaaaatttagaacagatatcaaagaattgcaattagtgccaattcataatttttccatgtatgtggcaacatagatctctgttactttattataaacagctccctttccttcgagaggtggtgtctcagagtggcgagggctcagaatgatttatttccatggtatctgagaccaataattggtttagaaacagtatttcaaaatacatttggcctttctatgaagtttatttttattttttatttcattatattttttgagacagggtctcactctgttgcccaggctggagtgcagtggtgcgatcacagctcactgcagccacaacctcctgggttcaatcttctcacctcagcctcctgagtagctggaactacaagtgcacaccaccatgcccaattaattttttttgtagagacagtcttgctatgttgcccaggtagtctcaaactcctgggctcaagcgatcctcccacctcgggctcccaaagtgctgggattgcagtcaggagccaccgcacctggcctgaagtttattttgatcagtagtaaaactgaattttcagatcccaaagatatagaaaagttggtaaaagaaatcagaagttggcatgcttcataatgacacacgagattttgcaatgaagatgagagacgtggaaggtttgtaacgcattttgggtatattctcttaatttctagtttcaaaattctgtgatcctggagaaactccagccagactgtgactatgttgtggaattgcaagccataacgtactggggacagacacggctgaagagtgcaaaggtgtcccttcacttcacatcgacacatgcaaccaacaacagtaagtgactgtgtcatgtttttcaagatgattgtgacatgatgggcgccatatcacaacaaggcacaatggagggagagtgagtttttgatttggaataattatatggcaaatcttcttacccacatgcatgtgactaaagtatttaaactacgacatacgaaacagtttgacttttgaattctttcttatggtttttatctattgtaggtgcaattttggtgttgtaatggaaatttaagaaaacttattgtgtctcattttaacagattgactgtttttatgtttacatgacgtgcacatatgcattctgcatacttgtttttcaggagattacgtacagttaaactgttataacttgatgttatttctgcttccactgtttctgtaattgttgttgttgttgttttgttttgttttgttttgtttggtatttttgagacagagtctagctctgtcacccaggctggagtgcaatggcgtgatctcagctcactgcaacctttgcctcccgggttcaagcggttctcctgcctcagtctcctgagtagctgggattacaggcgtgcaccaccatgcctggctaatttctgtatttttagtagagacagggtttcaccatgttggccaggctggcctcgagctcctgacctcaggtggtccacctgcctcggcctcccaaagtgctgggattacagtgtttctctagttctgtatacaatacacttatttttgtgcaattgttttacatatttatctcccaaatcaaagttgggcacttttgaaggcagagaccaaaataaatcatagtactgagaataatgtgtttgtatrtacgcgagtggatagggggcacaaaaagtggtgtggcatgcctgtttttcctagtactacacagtggtcataattactgcttgaaaggttacttaatactccattgagtgaagttactaaatcattctcatattgcttttccttgtttctttttttcttacctagtatgttagtatgtttgctgggaactgagcaaaacaatagaagagtctttcttatatgacactcatatcttagagaataagttacttgatgtttctggctttgttcaaacgtcgataccggttagaactgccatgcaggggctcctagcaaggtttcaggaaactgggacaaattaaatgagagtaggagggaggaggcgtttgtcgcaggggctcctccgatgttgattttttaggctagcaggaccccgtcatcatagctgcctttgatcaggacagtgggccttgttcagaaggagaagaagaatgtgttaaacatttgtctgaatttaggaaaggcaatgctggtcctgcagagtgagacacaggggttgctcataattaccttccacccctgggaaaacgtaggatccaaatgggcaggtttgtttgaaataatgcttcaaaaaatggtccagaaacagagatttctatctgtttgagaaatagtctctttggagattaaatggacttgaaatggtcaatttttatgtgagtctcggtacaatataaattttacctaaaagttctcatggaaatatgtttagtaacctcattcatttttaatccattcatccatctacccatcgcattgaaattgtgtgcctatgaattatgacatcactgtgtctaatgccaggaatactatattatatatacactatatactgtaatacactatatacactatatatacgtactgtatagcaatatgttccataattttctataaatagtatgcacataggtatatatgtacacatatgcatacatatacacatgtgtctacaaatatacacaaacacgcacataactatacacacatacatactcatacacacacacacacacacatatatacacacacatacattattcctagcacgatgatgtattttggtttctgccttaaaagtgcctaattttgaatttgggagataaatatgtaaaataataacaaagatctgtgtgttgcatacagacagaactacaggaaacagtggaagcagaaatgaccaacatggagttggggaatgagagtcacatcatccctcatgaagtcctgaagagtgagcgatctgcaggcccacaaggaatggacatcattccacacaaacgcagcagcgtggatgagtgtagagagttagagaagcgcattgcatgggcagagaactcagcgtgaggaaagaatgaaggtggatgggccactggtctctcccctggaggtctcattgagttgcaaggatttaaccaccatctgtgtgctaatgactccctgccctcccaccctgaccactctttgaactccagagtcctgcattcagccacccacttagcacctccccttggatggcttgcagatatttcaaataaaacgttcaaacacaagctctggattttcgcccatacctgttcctctcctgggctcgcctrtctcagtaaatggcaccaacattcacccttttgctcaagccaaacatgcagaagtcattcttcatttttctctgttttttctctccagaaattyaattcttcagaaagtccttttgtctctaattttaaattccatatggaatctgtccagttctttcgcttgttcacgctattgtcttttctttcctataaattgaaatagtctcctaattagtattatgtttctgctctttcttaaatatctattctttgtaaagagcagtcaaagttttctttagaaaatatcagcgtagttacagatctctctctttttggagttccactctcaagacagctacctagttatcttcaattctctctttccccaaaacttcatccttcactatattcttctatattccttaccaacccccttctcaggccaaaatcctttaaacttcagcttcatgcaagagctgtctttctctactggtggtggagatttcatctattgtataaaataagcatgtcttttagtctcctggttcttccaataaacaacattctttccccattagaaactggtatgggattgcaaattcccataatttaatatctgttaatttccagaaccaaaagcaaggagaaaaaaagtccgacttcaacttgtccttgttgaggttacattatctagagccttgtcatggtccagcccacagacaaaacttttatggaaccctggatctctgtagcatatccacagcttcttcacccttcctggggcatccccacacaaccctgtaactcagggagatattctttaattagcttcttctgctaccctctcaagtatgattataaacctttttctctcctttgagccacattgcacatggagtgcacagtccctaaatcccttcctstcagtaagccatgcggttccccataaatataaacatatctattacatggagtacacagtctagtctaaatcccttcctctcagtaagccatgcggttccccataaatataaacatatctattcttatgtccatgtttatcttctcctgtcttctgtattctaaggtggaggcacccttccttctgcatgtggtggacttcaccatgcagtttctagacccattcctccccaactcagatacctgcatccactgaagtcaaatctcatctacrtcagagaccatggattatctacatatgtggtcacagtatccgtcataatccctggcatataaacacggcaacaaaaatatttttgaaaccaagttaattagttattccctcatttgcctacaacctcagcctattcctctccactggcttgatctgctcagcttccagttctaaagcaaacctttcattgatgctggtttcattctagctaccatcttatctttctcctttccacattttttctcaagtttctgcaatctatttttcaatctcacttttccaccaaatctgcccctgctaatttctaagtctgatggatgttttccattgtaattttattgaccatttctgatgagtttgtccttgtttaactacactttccccattgttacatcttgacccttgtatgtttgactcccagatgtcttaatttttctcatacctcagtttccttgtaggatctcctgcctccatccggctcttggacattggagctctccagggttctaccttatctgctctgacaacttagtcactacctactcatggtccattctcaatgactcagctccagccttgatttctccactaataccagatgtctgtagcctgtcattccctgtatctgaatgtcacacaggcatctcaacctcaacatactccacattgaactcactccctccacttacaaagctcgatgttctcatgtatctctggtctccattgaggttactactgaccagaaacttgggagacttccttttaccactttctgttcacttcagtttgtttctaggtcctgcaattatttcaggacccacaggtttcttgaattttccaggaacatagtaagagctcagtaaattgactgcaactcagctgaatgcaactgtctttccattcaaccagctctgtgccacactctaacacgacagctttcttaagctttcatctgctacggtcataaatactaaaggggaagagagaaagaaatggcttttggtgtcatcttggaacaaccaaggttggacatcttttacaagccatttgcatattttaactgtgtcctccaagagtttgtgttttcacttggttgactattccaaaggaattatctttaccagtgagagtttttagccaggtggggagacactagaattatggcagttaaatgaacaaaacaggcagttaaatgaaagaaatctatttgaccggttgattccctgtgttaaggtcctttgctaattatcttttaaaactaggtaatactttagctgaccaattaaaagatagggtagttaattaagagatatggtagttaacctatcaaagaccactttattctcaggactgattcctcttacatagattagaaaaggaataaaagaaaagtaagaaaaaagaagtcatagtgcaaagtacctatagtaacacacattgtttgggtctcaggtgattccacagaagagattgacttttcaacggattatgtaggatacagttgaatgtttgtcaggattttatatcccagtgttgatatataatctcataaacactagtctgtgacttttataagaacattatatatttcatcatgaaccaactagaagtaaagaataattacaacgttacagtataagcaagggaaattacattttataggaaggagagtagtaaatgtcactatataaattactttttgaattatatttttccaggtctgcaggctgctaggtgttttaatgataaacatttctattcaagtgaaggctgaatgttcatgcagttttatgaaacaatcccttgaaggaagtatgatataacattgtctttaatggaaaggtagcttgcttctttgaaggcaggaggaatattttcaagtttgacaggttccaaatgttttatagttgcctcatggaactggaattattttctggctctccagaacaagaatagatgggagagaaaatactctgaatctcttgatgatctataaaattaatcaaaacttggatctttgaaaaatagtgtacatattttattttcttaatttctatgactatcgagtgtaaatcagacatcataactttttcagaatattgtagatatgatattattccatttttgcttattactgaaagtggaggagacattcttataaagtcagggtcatactgctagcattgtagtatgcaccttatctgttttttacccatggcgtgtgtcagcaacactaattgttggtggatttctcttcttgaatcattttaataaagcaacaatggttcaatcttaagatatataaaaatatgtttttacatctataattaaatactaaagtttgcctagggctgggcgcggtagctcacgcctgtaatcccagcactttgggaggccaagatgggcagatcacttgaggtcaggagttcaagaccagcctggccaacatggtaaaaccccatctctactaaaaatacaaaaattagccggccatggtgatgcgtgcctgtagtcccagctactcaggaggctgaggcacgagaatggcttgaacccgggaggcggaggttgcagtgagccgagatcatgccagtgcactccactacagcttgggcgacagagtgagactctgtttaaaaaacaaaaaaaagaaagaaagaaagaaaaagtttgcctaggatataaagcaagtaggaagacaagattgacattgagcttaaacctagtatctaaacacagtatctatctaaactgattatctgtcctagttatctgctggtgagttctcaatattatcacagattattagaaacataaatgggtttgtgaaactcttagatcctggctgggcacagtagctcatgcctataatcccagcaatttgggaggtcaaggtgggaggattgcttgaggccaggagttggaaaccagcctgggcaacatagtgagactgtgtctcttaaaaaaaattagccggctgggcgcggtggctcacgcctgtaatcccagcactttgggaggccgagtcgggtggatcacaaggtcaggagatcgagaccatcctggctaacatggtgaaaccccatctctactaaaaatacaaaaaaaaaaaaaaaaaaaaaattagccgggcatggtggtgagcgcctgtagtcccagctactctggaggctgaggcaggagaatggcatgaactcgggaggcagagcttgcagtgagccgagatcgcaccactgcactcgagcctgggtgacaaagcgagactccgtctcaaaaaaaattaaaataaaataaaataaaataaatgattctcagttatccacacattgatttgaactctttaagctaaaatagcctaaatgcgaatctaacaaatgtgcgtttttattttcctttcatctggtccgttggatagacaattcattgggcatgccagtgtcaggaaaaattgagttgatgtagattatcttctggggtccacagctttccttgactgatcttgtcttaccgcaggttgggcatgttctctccatctcatctttctgtcttcctctcacctgcccaagaatgcaaacctcactgcttttattagaagagtttcgataacacattgtttataggcataaaatcaacacagcttacccttttatctctcagagggctatttgaaattcagaaagcagaaaagtcttgcatcaaagggcagaatttctatgtatgcaacctctaaattcagtgagtggatgagggagaaatttggggcctaaggaaatttttggtgtcttaattattaaaccatataaatgggtgctctgtaagactcagtacatggtgatggaaacagaagtttggcatgggatggccctgggattaaatttcaccttcactctttgaattatgtgaaactggatacaattcttagtatttttgagcgctggttttttcgtcttcagtgtataccaattcctctttctcaggggtctgcaaactatggcccacaggccaaatccagccccctcctggttttgtaaataagactttattggcacagggtcacatttgcttacatgtcatttatatatcatgtccggctgtttggggggtacaacagtaattgagtagttgggagagagaccagtctgcaaaaccaaaatcatttaccatatgatgcacagaaccaaaaatatttactatctggccatttaagaaaagtttagtttactgacccctgcttaatttcataggatggctctatgaatataaattagtgtcaaaattcaccaccccaaccaagccccccaggaacacacctggagtcaaaagtgaggtttagtggcatgtacctatactgctaactacttagggggctcaggtgggaggatcacttgagccagaagtttgagaccaatctgggcaatggtgggaaaccctgtttccaaagaaaaacaaatattaggtttattgccctttctgcaacatgtttgaatctcatgttaaaggattactgtattgacgtaaataaaacaccccgaatagccccaggcaaatgagcatttggtaatatatttggtataaacagccatcaattcataattttatttatttcatttcatccaatacatattaggcagctaccatgtgcgtgtttctgagctaggcagttgccatccaaggaagattaggatgagctctgttttgtagaggacttctgggttgagtttgaggaacaaattaaagaagaaaaaaattacttaaaactgaaaaaatacaggaacacaaaagagtggtgtgttttgattcactctggaaaatcttcaccagggagagcctctgagaagttttcatgggcaaagaaggttgacagaaacaagtagtgctggtccattctgagctaaagcaatcagaattatagatacaaagaaaaccagcaggtttggggaattaggaatggcacaagagagaaagatacagctaaattaaaacaaaataataaaaagcaaactaaaactggagtcagatcatgactctacacaacaacacagtaagaaatgacctaggctaagaatgaaatcttgaactacctgattcaaagatatatttaatggtgttttgatttatagtagcatatctctatcttccactggatatgggatacgtagggcttggaatccttcttgttcagttttgtggtgtcctacgttgcaacgaatatgtgttgaatacacttttaaatggacaatagggaaaaaaaagttcatgcttttaataatgaacatgtgaacatactctcgcctcatctttcatgaagtgtcctggtttcttcacaaaataccacgtcacatggcaccagttatattcccatggctccattcctcagaaaacttgtggccactttttcgaagaacagaaacagtggctggtcagactgatgctcttctactgggcagatgcctttggtcaagctcactgccggtgcaccatcattagagcagatttgcctggtggtatttcaggagtccctcaggtacaaaaactttatctctgcaactcctagctcaatgcctggctcttgggaagtgctcagaattgctgacagaaagagctaattactgccagaaagagctaattactgaatgggttcttgtattccattacccaacctgatgtactgttgcctttgcatttcatttcatttactggatattttaaagtttcatttcaatgtctgtcagaatttggatgtctgtcactaatctgaatggcacacagattggttgctgagtgatgaagctgaagttggcattgtcaactgagtaggtgcaatttgctccttactatttatttgacaaagctgaaccgtatttccgtttagagccctgcaccaagtattgatgtataatgctcatacttccacattacgtataggttttccacgaaaacctatctacttttttcacgaaatggtattgtaatattattttattttcctcataactataaaaaatctataatgagaaatattattcatacttattatttacattggagcatctttcaagcctggtgaatatatgttacttaccaaattaaatactggggattatatgtaatatacttttagtattccagtggattttgaagggggggttcattaacttgaacatgaaagaacatgcggttacaccaccttttacttaaaaaaaaaacagacagttaatatgactaaataacaggatgaaatgaagtacactgggactaatatcaggttatataataatgaagttgtgggatacatgtgcagaacatgcaggtttgttaacataggtatacatgtgccatggtggtgtgctgcacccatcaactcgtcatctacattaggtatttctcctaacactgtccctccccttgccccccacccccaacaggccctggtgtgtgatgttcccctccctgtgctcatgtgttctcattgttcaactcccacttatgagtgagaacattcggtgtttagttttctgttcctgcgttagtttgctgagaattgtggtttccagcttcatccatgtccctgcaaaagacatgaactcattcctttatatggctacatagtattccatggtgtgtatgccacattttctttatccagtctatcattgatgggaatttgggttggcaccaagtctttgctattgtgaatagtgctgcaataaacatatgtgtgcatgtgttttatagtagaatgatttaaaatcctttgggtatacatccaataatgagattgctgggtcaaatggtatttctagttctagatccttgaggaattgccacactgtcttccacaatggttgaactaatttacactcccaccaacagtgcaaaagccttcctatttctccatatcctctccagcatctgttgtttcctgacttttgaatgatcgccattctaactggcatgagatggtatctaattgtggttttgatttgcatttctctaatgaccagtgatggtgagctttttttcatacgtttattggccgcataaatgtcttcttttgagaagtgtctgttcatatcctttgcccactttttgatggagttgtttgtttttttcttgtaaatttatttgtttcctgtagattctggatattattagccctttgacagatggatagattgcaaaaattttctcccattctgtagttgcctgttcactctgatgctagtttcttttgctgtgcagaagctctttagtttaattagatcccatttgtcaactttggcttttgttgcaattgcttttggtgttttagtcatgaagtctttgcccatgcctatgtcctgaatggtattgcctaggttttcttctagtgtttttatggttttaggtctaacatttaaatctttaatccatcttgagttaagttttgtataaggtgaaaggaagggacccagtttcagttttctgcatatggctagtcagttttcccagcaccgtttattaaatagggaatcctttccttattgcttttgtcaggtttgtcaaagatcagatggttgtagatgtgtggtgttatttctgaggcctctgttctgttccattggtctatatatctgttttgttaccagtaccatgctgtgttggttactgtagccttgtagtgtagtttgaaatcaggtagcatgatgcctccagctttgttctttttgcttaggattgtcttggctatatggactcttttttggttccatataaaatttaaagtagttttttctaattctgtaaagaaagtcaatggtagcttgatgggaatagcattgaatctataaattactttgggtagtatgtccattttcacgatattgattcttcctatccatgtgcatggaatgtttttccatttgtttgtgtcctctcttatttccttgagcagtggtttgtagttctccttgaagaggtccttcacagcccttgtaagttggattcctaggtattttattgtctttgtagcaactgtgaatgggagttcactcatgatttggctctctgtctgttattggtgtataggaatgcttgtgatttttgcacattgattttgtatcctgagactttgctgaagttgcttatcagcttaaggagattttgggctgagatgatagggttttctaaatatacaatcatgtcatctgcaaacagagacaatttgacttcctctcttcctatttgaatacctttatttctttctcttgcctgattgccctggccagaacttccaatactatgttgaataggagtggtgagagagggcatccttgtcttgtgccagttttcaaagggaatgcttctggcttttccccattcagtatgatattggctgtgggtttgtcatcaatagctcttattattttgagatacgttccatcaatacctagtttattgagagtttttaggcatgaagcggtgctgaattttattgaaggccttttctgcatctattgagataatcatgtgttttttgtcattggttctgtttatgtgatggattgtgtatgttgaaccagccttgcatcccagggatgaagccaacttgatcgtgatggataaactttctgatgtgctgctggattcggtttgccagtattttattgaggattttcacatcaatgttcatcagggatatcggcctgaaattttctttttttgttgtatctctgccaggttttggtatcagcatgatgctgacctcataaaatgagttagggaggagtccctctttttctattgtttggaatagttttagaaggaatgataccagctcctgtttgtatctctggtacaattcagctgtgaatctgtctggtcctgggctttttttggttggtaggctattattcagagattcaacttcttcctggtttagtcttgggagggtgtatgtgtccaggagtttatccatttcttctagattttctagtttatttgcatagaggtgtttgtagtattctctgatggtagtttgtacttctgtgggatcattagtgatatcccctttatcatttaatattgtgtctatttgattcttctctcttttcttctttattagtctggctagtagtctatctgttttgttaatgttttcaaaaaaccagcttctggattcattgatttttggaagggttttttgtgtctctatctccttcagttctcctctgatcttagttatttcttgtcttctgctggcttttgaatttgtttgctcttgcttctccagttcttttaattgtgatgttagggtgtcgattttagatcttccccgctttctcctgtgggcatttcgtgctataaatttccctctaaacgctgctttagctgtgtcccagtgattctggtacattgtgtctttgttctcattggtttcaaaaaacttatttatttctgcctgaatttcattatttacccagtagtcattcaggagcatattgttcagtttccatgtagttgtatggttttgagtggctttcttaatcctgagttctaatttgattgcactgtggtctgagagactgtttgttatgatttccattcttttgcatttgctgaggaatattttacttccaattacatggtcaattttagaataagtgctatatggtgctgagaagaatgtatattctgttgatttgtggtggagagttctgtagatgtctattaggtgcacttggtccagagctgagttcaagtcctgaatgttcttgttaattttctgtctcattgatctgtctaatattgacaatggagtgttaaaacctcccactattattgtgtgggagtctaagtgtctttgtaggtctctaagaacacgctttatgaatcgggatgctcctgtattggtggcatatatatttattttagctcttcttgttgcattgaaccctttaccattatatattccccttctttgtctcttttgatctttgttgggcgacagagcgagactccatctaaaacaacaacaacaacaaaaaaaaaaaaaaaaaaaaaaaaaaaactcctgtagccagctctgtgtctgcccaaatggcctcccagttttgcacttgaaactcaggggcctggcggtgtaggcacccgagggaatctcctggtctgccaattgcgaagacagtgggaaaagcgtagttatctgtgctggatagcactgtccctcactcacrgcttcccttggctaggggagggagttctccaaccacttgtgcttcctgggtgaggcaacgccccaccctgcttctgctcgccctccatgggctgcacccactgtctaaccagtcctaatgagatgagccggtacctccgttggaaatagagaaatcacccgccttctgtgttgttctcgctggaagctgcataatggagctgttcctatttggccatcttgcccaggaatctataattacttttaacaagtaacttagaatgttgtactttgttgtagaagaacagcttgtgaaaactagaaaaggtggaattcaaacacaactcccttttcaaagacgacgacccactcgcccgctggaagtcggagctcccttctatcaggatggccaactgcaagttaaagtctactggaagaagacagaaggtacataaacattacttacttatttcttacttgctttaaacagcacagtaatatagagatagttttgaagaagtaaatgtcaagccacagtatcaatactaaggcaaacggttgttgaacacaagtctgaatgagttgacggttatctcacatcttgaaatctacaacagtcaattgcttaaatattttcctttcagggatattagcttgtcttcatttctttcccagagggctgattggctgatgttatatccaaaacactcaaaatattcattattttgagctgtaatttttgttataaattattaattattattttttaaagatccataatacaaataatttagaaagtagggggggaaagtcacctattatctcaatatcatttcctgaaacagcactttggtgggtttcctttcagaaattttctatgcatctgtctttcactcagttagggtgtgtgtgtgtgagtgtgtttttaaaacatacacacatatttctgtgtaacattgtttgagctgctatattgtcatgcatttttcataacattctataaatgctactttgtatgggtatatcttaatatcataatacatgtcattattccagtacaatgaaacatttcagttctttagaatttctgttttctaattaaggctgcaatacatttatccttaggatagattcatttcatttgtttgaacatttatctttagcataaattctttttgtttatttttttttttagtcttagaatatttgtttttctgttatcaaggtggtacttttagaatttattcaacatacagtcttttatctttatcactcttatgcctcttaaaaacataagcagaatagattgtttcaagagttaggtttttaaaattctcctcactcctctgaaattcacttttactcaaggtattgatgggccatgtgccataagcaatattggtgttggagtggttcctattccaggattttctttcaagctgctgaaatcsattctgcaagtaaaataatattattattaatattaacatattttatttctataatgttaattaaagtttattcaacatttattgcattaagattatattatgtctatattacagttaataattttataaatattaaataagaaaagtatttgatctattatattgattaattaaaatatcaacatattcatatttaaaaaataacattttattaatattaaaattttaaacataatgtaataaaatgaaaatgtaaacatctactattgaaaaagtaaatatctcaagcatacaagagtaaccaccaccatcctgacttttaaaactcaatatttgttttgcctgtatttgaaatttatcagaatggaatcactcaatttctatttgtatttggcttcttgccatgagcattttatgagaaaccaatgcattctgttgcatgaaacaattcattcatttatattgctgcctggatgtccttagtatacatcaatctgtgtatcctttcagctgtggatggagatttacttattcagatgtggagctattaagaatagtaccagtgtgaatgccccacgaacacatgttgtttgacgcatattcttccatagaggtgggattcttaggccgtagagtatgtcaagctttagaaaacattaatagttttccaaaatggttgtaccaatttacattctcaccagtagggcatgattatggttccaggtgctccacattctctctgtcatgtggtattttccatctttgtaagtttaccctttctggtatgttcatagtgatacctcattgttatttgaattcgcatttttctgatgtccaagaagttgagcacctttttgtaattttactgacaattggatttctcttttttgaaggactctttcaactctttagctactctgtcctgcatgagtgcttttaatatagtatatacaagtcatttggtgtttgtttgttgagacacagtcttgatctgtcgcccagtctggggtgcagtggcacgatctcagctcactgcaacctccgcctcccaggttcaagcgattctcccgcctcagcctcctgaatagctgggattataggcgtgtgccaccatgcccagctaatttttgtatttttagtagatatggggtttcaccatgttggccaggctggtcttgaactcctgatctcaagtgatctgcctgccttggcctcccaaagtgctaggattataggcgtgagccactgtatccagccatcatttgttttcatgtaagtattttcttccactctgatccactcttgcatttttaactttcttcttagtgggtttttttttttttgatggagtttcactcttgttgcccaggctggtccgcatcctgggttcaagcgattctcctatcttagcctccagagtagctgcgattaaaggtggctgccgccatgcccggctaattttttgtattttcagtagagacagggtttcaccatgttgaccaggctggtcttgaactcctgacctcaggtgatctccctgcctcagcctcccaaaatgctgggattacaggcgcactgctcccagcccttagtggttcttaattttagagataagcaattcatcattttgtttcctttaggtttagtattctctatgtcctggttaggaaatcctttttcatacaaaggtcacaaagatattctcctttcttgtcttcttgtccactgtttcatcttttgtattagtccactttcatactgctatgaatacctgagactgggtaatttataaggaaaaagaggtttaatggacacacagttccacatggctggggagacctcacaatcattgcggaaggtgaaggaggagcaaaggcataccttacgtggtggtaggcaaaagagcatgtccaggagaactgcaatttataaaaccatcagatctcatgagacttactcactatcatgagaacaacatgggaaaacctcgtccccatgattcagttacctcccaccaggttcctcccatgacatgtggggattatgggagctacaattcaagatgagatttgggtggggacatagccaaatcatatcaccttttattcttaagctcttttacccagaattgatttttgttgtagagggtcagtgttcttttttttttttccttctgatctccttctctgatacatcatgatatattttttaaatgactattttccccaaagctctacagtgcctcatttgccctaaataatgcatatatgtgcaagttaatttttggactttctatagagtctttgacatatttttgcaatgttgtgacaataccttactgtcttaactactatagatttataaatatttctaatgatagtcctctagtttttatttctttatcaaattgtctcaactattcctggccttttgcatttttatatacatatttgaattaatttttcgatttccacaaaaacttcctgagatatttatggagattgaattcatccacgtgtcaatgattttgaagaattcgcatcttaaaaatactgagtgttccaatctacaaacatggtatgccactgtattcaggtttaaaatttttgtctcaacaatgttttataatatattggatagaaagtatgatactttttaatatgatttttccaaggtatttgtgtttatttttatcctattatagatggcatactttttcctcaattatactttctgatttttgttgttggtatattataaatatattttatattcatatattgactgtgaatccagcaatattgttttagcactttgttaattataacattttctctgatgatttgtttgcattttttctacaaaaaccatcatctagtttgtaaataatgagaattttatattttcctttccatatctttgatgttttagttttcccttgccttaaaactggctgagagtttcagtacaatggtgactaaaagtgatactattaggcatgatgtttaagtgtaaggtttttgaagacatccctggtcagattaatacaatcccctactcttcttacttgcaaagtttttgttgttaatggatactggtttttatcaaatattcttacttcatctagtgaaatgatcatacatttttcttctttgttctattaacatgatgaactagaggaaacattatagatcacctcctaggtctgttgtgtggaataaatgagattacacatccagattggttggaccggtgcctggcacaaaggagacaccttaggtgtttcagtgtgaggattcttacggcactgcttatagtgcagagagaggacaggatgtcaggacagacgtaaagagcctctgagcccagccttttaaggcttggtgttgctttaggactgactctcaatgttttctcctttgtgaacaacaaagagcagtgctttaagacatgatttaattgtccaatttgcaatacaagtgctacaaaacttaggcatcttattaaatttggcagaagaaaagagattcaccttcactgcactgtatcagcaagcagtaatatgaccaatattcccatacaataatgatttcagtgcatgacaaataggaaacatggttgttggcatagatatgtacacatatacacacatgtacacatatatacacacgtattactttgaataactcaaagttagaaataaatgtgaagaatatcagtggttttctcaaatactgaaatctttaaagaaaccataagcagagaattgtctcaatatttattaatcaatattagagtccatagtattatccagtttacgatgcatgaaattgtggacttgatgataaagggacaagatccaaaggcaaggagtgaccttgatttgggttccaaaagtgatgctgacttgattgatgtttagtgacttggaccctgggccacaaaggagaagctgggagtgatgagctcatgtgacggaggtaaactagcctctatttgtcagtaatgatttgtttcactaatggaaatgcctcgcagtcagttagtgttcaaactgttttcttcatacccatttccagcctctgaaatgagttaacctccaggaatgctacctactacagaccaacattaagccatcatctaataagtacatatccatgctggccagagaacactctttgtggctggccaaaaccttgattccaaagatakaactgatttcaaatatatttctaaaagagaatgttctgtgcagtggccttcaacagttgacagtgtagcctccagtcaaaactattgtggttacagtgttactgcttactcaagagacagagattcattctacatctttagtgacatgtcaggatttgttctgtggatttttttgtagaccatgcatctgctccttgccatttcaactcatgccctctctatatattcacgctaaaactttctttgaagtgacaggaagttcttgaaaacacttggtatggattcccttcaaaagaatggcaaaaatatggaatttggcattttgcttttaccttgtttaggaagatcctcccaaacagtttggaatctaaaaagaacattgtgtaaaaatatctagacagaatacttatgactctactgagtacgctaagccctttaccaaaataatagggtgtaaaaacaaatagagcttaattttcctacacaaatcctgtgtctgacagctggtggcagaatcttttcattttcaattaaagtgacaaaggaaatatagaaaaaaaagaacgggaagaaaggtctggttgttcttttaagttaatcctttagatatatagtaaacattgcaaacagtaataagagtctttagatgagtattttaatacatccaaaaatggtatgttcaactttcatttgaaaatgtgaagttttaaaactttgaattggccaggcgcggtggctcacgcctgtaatcccagcactttgggaggccaaggcgggcggatcatgaggttaggaatttgagaccagtctggccaatatggtgaaaccccgtctctactaaaaatacaaaaattagccgggcatgggggtgcatgcctgtagtcccagctacttgggagaccgaggcaggagattcgcttgaacccgggaggcagaggttgcagtgagccgagaccgcgccactgactccagcctgggtgacagagcgagacaccgtcaaaaaaaaacacctttgaattaacttagatatcaatgaatgcatttccattcactttttgtcttcttttgcaaatggacacaaattaccgactttatgccaggctgtgtgccacgtgatgggaatacaataacggataagagagatttcctacctttaaggaacctgcagttctgaggcttaggcagttaggcagttgccacataataagacattattcttcatagcagtctggataaacagctgaagtagttgagagcagagagattttgacgttgtgtgcagaggaattttcacagaggaggtaaagtttaaggtacattttaaaggctggattactttttttggccagggaagatgaacacttctggcccaggacatgaagaggtgcagctgggagaaagatcgggaatgtcaagtattggtgagattgaggaagtgactgtgtgaggctggagagacagatcaatgtcaagtgatggagaagcttatatggtatgccaggaagcttggattttgttctacatggaggagagggatgtgaagtagcaggggaaattctgagcaggacttagagatgttagcaaaagcaagtgtgcaaggaatatggattggaaaagttcagagagagcacgtcggttaatttcagtagccaagacaagaaataatcagatcatgaattagagacagcagtaggaggaggaaggttggcgagttatgtaagagtattacacaagtgaccacataatttattgtctgaactgggatttatttgagaataaaaggaggcatttgtaaacattattccccaccaacagacatagactgtaactctcccaggaaagccaggatgtatggccacttggatattaagacctgcctgaagagaaaaagagaaatggatctaaatggagtgtttatcttctagcttgaatgactaacagtacttcgactaacaaagattgtgagcagtagaattatgatatgtttcatgggatatgtctccatgatatggagaatttggttttggtgtgtcgaatttgagataactacatgattgccagaaaatgtcataggcagtcagaaatacatacttgtagctcaggaggcagctctgtgatagcatcgtggatttgactggagctatggtcaatccactgactatactgtcaggggatctgcaaatgttagttgatttccactggatcacacacacacttactattaggagctgagaacagctcatgctctaattagagtttcgtattttccaaaaagtcctttttcttaaattttatccattcccacttcccttgttattttaaatctgaaagccaaatgaacatataaattgtagcagagctcatgatgttgaacacatgatagaagggagtggtagaaagctttgggaagtccaaagaacaatgaagaggaaagtatgtgtttcaaacttattccacatttttcctccttacagaaaccttttatgtactcaccacatgatctacagaatcccaaaccaaagtttccccagacattcataaaacatgctcttattcataattatcacacatgtaggaaaggagacctttgaaatggactcagtattactagcataggagcactgtacggaatgtgaatatcagcacagtttctgtcatgggaaaggacactttggctggattttctggatttttttgactttgtaaaatgagaaattatctcctctgtatgaaactcaatagacccatctaaagtggtttcaaactccttgacaagtagctgaatatttttgaatgataatttatttccaattgtggacacactgagttgaaaacctaaaaagacttaatgcttttggcaaataagggaagaaaagaatcttgctcattaatcaaaactcaatcataaacagaaatgggttcttatgtcacatttcctaaaagtgatggtgggcaaaatattgcttttggacttggagttagggacctaaaagcccaaatctattcatttcactcaaaatttttcagagacagtttcagttattaggatgtagcatgtagtttcatagataaatgaattaaacgtcaaatattagctttctttacttaatacacatagtagttgggttataatagtgaatgctctgggagaaaataaatattttcaacattgcatttgtagaacaaacattattttaaaacaattccacttagctaattttgttagtaattttattactccattgatattagttcatttttactgtgtaataatagaataaacaattgttttaagctttctggcctgcctgcctgcctgcctgccttccttccttccttccttccttccttccctttcctttcctttcttcctccctccctccctctctctttcttctcctctcctcttttcctttcctttcccttcctttcctttcctttctctctctctctttctttctttctttttttttttttgtcatagagacagggtcttgctctgtcacccaggctggagtgcagtggcatgatcatggctcactgcaacttcaaactcctggcctcaagcaatcctcctgcctcagcctcacaagaagctggaactacagacatgcaccaccatgcccagctaattttcttttctcttcttttcttttttttttttttttttttttggagtttctctcttgttgcccaggctggagtgcaatgtcgcaatctcggctcaccacaacctctgccttccgggtttgagtgattctcctgtctcagcctcccaggtagctgggattacaggcaggcaccaccacgcttggctaattttgtatttttagtagagacggggtttctccatgttggtcaggccggtctcgaactcccaacctcaggagatccacccacctcagcctcccaaagtgctgggattacaggcgtgacccacagtgcctggccgcccagctaattttttaaaaaatatattttttgtagagatgcggtcttgctatgttgcccaggatggtctcaaactcctggcctcaggtgatccttcagcctcagactcccaaaacgctggggttgaaggcatgagccactgcatcttgatggttttctggctctagactttgtgtctctacaacgtaaatgtgaaaagttagctcagacatagaggaaacattcatgcttctattttaagtagaaatgcctatgtgatactcaaaaattcttattttagttgtacatcagaaagttctgtttcaccagatcatgtttacagatagagtatgaggcattgatccatgagaggacttcattcaactaacctttactgagcacctactgtatgcaatgcaccatttccgatgctaaaacactgcaaagaggcagacagaaatccctaccctgatggaattggcgttctgtgacacctctctaagtgtgtgcccccttccctagtgctgtgacttacaattctttttaaagcaattattattctggagaacccaaggattgcctctttctcagagctctaatgtcaataaccctatcattctttgtcattagacttttgcgaactgaggaattcacatttaatgaaaaattttagagccctttatttatgccagacactgtgagttacatctatttgaaaagaaaattagacccatctaatttttgaaccatagttgaagcatattacaggtaaattttttatcacttaaaaatacttttcaggtactttctttgtaatgtcatttgtttgtggaaggaattaagctaaggaaccagatcaattgggtatttagcacagaattttcagatacaccctttcaggaagtgtttggctatttattttattttattattatttttttaagacagagttttactgttgttgcccaggctggagtgcaatggcatgatctcagctcactgcaacatccacttcccgggttcaagcgattctcctgcctcagcctcccgagtagctgggattacaagcatgtgccaccatacctggctaatttttgtatttttagtagcgacagggtttcaccatgctggccaggctgctcttgagctcctgacctcagacaatccacccacctcagcctcccaaagtgctgggattacaggcatgagccaccacgcccggcctgaactatgctatttttaatattctagttacagattgagacctgcagtcataacctaaaatacaagctcttaggattttagtcattggcaagataaagctaaggacatgatgtttgtataaatgacttccatcaaagcaaatatctatgaattgatctgttaaaattgagctcaactcacataaatgagtgtgggcattgttagtccccatactggtcatttgggggtgccatttacaatactttcagggcatttttaatctaagtttaatttatattttactttctcagattgcttttaattaccttatgtaatatcatgtcttttcacactttcttccgtgtcttagattataaggaattattttcactgttgccagaatgagtagagaaataaaagtgaatttgaactggtatacctttgttcacttatttattcattaaatgtttactgtctgtttatcacctgccaggcaccatgctcatctttgtttatgcaacagtgacagcaaataggcattatctttatagttatggagctctaaccaaatggggttgacagggattcatgaagtaaccacagaatcaaacaaaacattgggaacgagaggagtgtctgcatgagatgaatatgtagaggcagtggagacctggaagccaggctgagtattagtgtctttattcagagggcagagaaaagccattcaatgactcaaagccaaccttgagatggggatattacccttaattatttgggtggaaacgaatacaatcacaaaagtccttaaaagtagaatagggaagcagagtgcaagaatcagagagatggcatggtgcgaaggactcagcccagtgttgttgactttgaagctggtggaagggcaccaccagccaaagaattccagaagcctctagaaacctgaaaagtcatgaaaatacattcttccctggagcctccagaaaggagtacaggcctgccttgattttagaccagtgacacccatttcagacctccagaagagaagacatttatattgttttaagcatctacactcaaggtaatttgtcacagcagctgtagaaaaccagtacatgaactgatttaaaacacaccaaacctattgcattggctgaattagtatccttattctcagatacagngaatgaggctcactgaggctgttggagttgcttgctgaagcccaccttcctcgaaggttatgtgtggggtcaaaattctgcatcctacagccagaaagaaaagtgtgaatgcaaggagcagttgaggtgcagaaatcaacatggtagctacagcaaagttgaatttggaaggcctccacatgggagaggaaggagggagcatcagctcttcaagggactagctcaggtgaaagtagatatttgggagctgtcagcagaaaaatttttcaaaccatgggaatcaatgaagtgattcatggaggtgacacagagagaagatgaaagtgcagtgaactcagacatggcaagatttagggctaacaaaagggagggaacccaaaaggagtgccccatgtgtcactcttgatgctgcctcctatgaaaatataattgcattgtaaaatatgtaaaggatttttaggatatggaggatccccagggcagccaagcctccttgtattgctgtaatgtagccaccccaagtcccctgactgctcttcaccaaagaccttcagtcatccgtcatgctccgttctcatgtcagcactttggcacgtgctgtgtattccctgctggtagagcatttaagctgcccaatattgtaaccatggccatcttcagctgtttaaatttaaattaattaaaatgaaacagaataaagaattaaattcctctgttaaacagaggacatgtgaaatgctttataggcacaggtgactagtgtttaccacagacagaacatttccatcacacccgccagttctgttggacaggrctggctgagaacaccctcccacaggtctctgcagtgccactacccactgctacaccttcttcaagtcctgactcagaattgaacacacgccagycgccttatataaaatcagcactttttgtcaatccaccctactgcccttaccttctggttttttttttgttttatttttttgtttttttgtttttgrgggggggtggtgggrgacggagttttgctcttrttgcccaggctggagtgcagtggcgtgatctcggctcactgaaacatccgccttccggtttcaagagattctctggcctcagcctcccgagtagctgggattacaggcgcctgccaccacgcctggctaatttttgtattgttagtagagagggggtttcaccatgttggccaggctggtctcaaactcctgacctagtgatctgcctgcctcggcctcccaaagtgctgggattacaggcgtgaaccaccgtgcccagccaccttctgtatttatatgtrgacttactacgttctaacataatatctatcttatctatgtattgtatttattctctgttattattggccccattactatgtaaaattcaggagggcagcagccactcctgtgtkattatttcattgctgttgaatggaagaacatgaacacactcagtgattgacttcagcgttgtgcatagcctataattctttttttaaaaaataaactcttgatgtctgctatgtaaaaattaaaacctctagtacatgatttctcttttagctaaatgcccggagtgcccacttttatatctgtttgctttctcggatttaaagttcttcttttctggttccaaagtgctcaaagcgaagttcccactagatcaacccaatttcatcaaagagttttctcctctgaaaacccccatcaaacacttggcatgatgttgggggacaagatgttaaatcacctgcaaaatggtgccatttggtgccatttcacactcctcggacacactygggtgattaataaacccgagactgtcaaggtctgctttcccacactcattgagttgcttgccgctattttatcttttttccccccactttattgtccaaagtaaagaaatgtacagaaaatattcctcttgccctgggaataaacgtgttcaaagggtcagtcttctggcctgtgtttgagaacaccaagtcatatttcagtagggatcagccatacagaaatgccacgatgcgcttggttaagggagagtgggaagcatacgtccctatcctttggacaaaagaacttctttatggcaatacataacaggaaataaacgtggatagccaattctgcaagtgtgaagggaatgtttttgttcttgtgtggattcaatagtatctcatctttatcaaaaaaaaaggtaggattgagaaacttctgatgattctcttttgcaacaggaattacgagagctgttgctaggtgttgcctttcattgtagggctttgcttactgtaaaaaccatggctaggttattctcaagacatctttggaatcattttgctatgaatttactaatttttttttctacttagtacttgcacttcaacacaggttttcccttggcagtatattacttttttcccttactttgttcttaatgattaagtattcagaattactaattattataattattaagtaatcagaatctcacctcctttggctcactgtgcatttattggtcacctgtagagtttcatttcctctccttttctcctctcaagttcaagaaccccaggctacctggaatgtaacatccagcctattatttttgtttgcgtgttttggcattatagatcccactgtcaaccgatatcatgtgcggtggtttcctgaagcgtgtgcccacaacagaacaaccggatcagaggcatcatctggcatgacccacgtaaggacatgatctctaggccaacttgatctgtgaacataattagacaggaggatgtacaaactagacaggtcaaacagataactcattcccacaaatcagctatggagtaatgacttgatgraagtggaaagcagaatggtcattatattcactcattcttttatccattcacaccattgcactgggagcttactctgttatccacatggagcaaaacctaaagtgcagagactaaagacacagttcttaaagaactcccatatttcagggggaaatatgtctgagtatgtgtgtgcttcatcttaactggacaaaagctttgaattattttctgaattttgacatgtcaccgtgatctaaaggtgtaatggtacaagtggatttctatgtgactctatcattgagcaccatgtccctaactgccatcagctcagttagtgaaataatctccctgtcctgtatagcatgcaccaatattttgactttcaactttaagagaacattaaactctctgaggatagcaactctgtcaatattgcccaaaatgttattccaaatattttggggttcattcatgaattatagattagaatcaacaaactaacacaaaatatttaagaggtcattttattatacagtgtataatacactttgatggcagtttatatgtgatacctcaggacagtttaaaaaatccaaaaacatggccccaaacatagaatgttttggtttgtgatatgtaactagaatatttttgttttgaacattttctaaagcaagcacgatattttaagaaccatacctgctggcataattttaagagagtgagataaaacaagtcactggattttcagaaatacacagattctttttcttttttactggacttaatttgtctcatgttcagcaatgtttctccttgtatttatccttaaattagctccaatgtttgtgaccttcagtaaaataattaaacagacattctaaataaggaagtcgatttgaaaagcggagaaagcaataaacagaagctggaattattaatatttttgtgggcagaggggtgaggtttttgttttacttatatgtgtgtgcctcagaaccttacagaactgggcttatgtcaatgcaattccccaatcctaggcttatcatctttaggaactctgaaagtggtaacaactatttgctgagcagatgtaatgtatctggtagaaataaaaatcaaactcctgaaaaattatccttctaggggtttagaacttatctgtatttagttttaaacctttagatccaattattataatttgtttttatgctacaatggagcatccactaattcacttactgctgcagatgtctgtctcctatgcaatatgaaaacaatcttgaaatatctgtgaaacaggatccttaatagctaaccttggattccagtatagtcccatgtaaagagcagatttatttccaaagaaaagcaattcagactcccaaagaaacatggtggccttggcttgggcttgggttgggcttgggttggtcttgcgttgtccagattgatttgtttcctattcactgtttgtgctaactggctgcagagttgggtgcaccccatctcctgtcaccatctggatgaagggccagcacacctggaggtcactcccggtctcttttgaacattcagtgctctgtcacctgcagccacttccactcctcacttaagtaaatcactcaagcctcagttttgattttaattcttgtctcatgtttttcccgtcaacgctgctgctttctagcaagatcccctacccatcatccaatgagtgccagagatattccatctgtactttttttcctctcttaaaaaataattaaacacacacacacacacacacacacacacacacacacgtaaaaaccatggagtctcactatgttgaccaagctggtcacaaactcctgagttcaagcgatcctcccacctcagcctctcgagtagctaggactatgacacgagtcaccatgcccagctatccatctgcacttttatacatatacattaagaattggtaaatacaaaacagaatggataagtgccatttagccaaatatgaaagaaacagagatacacacctgttatcacaggaaatgtcatcttttgacattatcataaagttatattcttagcccgtgactccttaccatttagcctctttcttttatttatatttaatcacaacattatggcagaaaacagtaacagcactccaaaaaagggaaaaattatattgctaaagaatatcatcattttttaacagaaaaacttacatataaactaattctatgtctcagagaagcctgcgttagttttttttaactgaaaaaagttagatttgtatttacagctttacaccactacctgcactgctaccaactcaaaaatgctgattgcgaccttagaagtagcctgctttgatgaggaattattatgatactgtttaattctagaaggcatatcccgcagccatggsagtgtttcacaattgtcattaatcaaaatgtggacagtatgtgctttgtactttttataaaagccatattgcacacactatataggaaaacatccttgttggatggaatatgatttcaattcttgccagtgttttttaatccctaatgagatttattgctagcataattctctttctcttgctctaggaaaattacataattcttcaagatctgtcattttcctgcaagtataaggtgactgtccaaccaatacggccaaaaagtcactccaaggcagaagctgttttcttcactactccaccatgctctgctcttaaggggaagagccacaagcctrttggctgcctgggcgaagcaggtacgttttcacctgaaggacttctacatctaggtctamggtgtcagcagcgctttgcaaaccttgtcaaactgcgtttcacaagaccgtgaaaaccaaaagtgcctctctttctaagttgtgttatgatggcccaatgtggagggaagagatgtaggaatgaatgtgttattttaaagcctaacaggcttggaaagatgtcctttgatagtaatgttatccctttggaaatgaaggcaaacatttagataccgcttgtgttttgggaaagtttgatataattatttcattattttcccacccctttgctgcgtgggttatactcacacactttccatgccaacctggcaaacctcacatctgtaccttccatcccatctccttgccaatgtccctgtcttgcagtgggaaaaagtcttttaaatgccctggatttggccaggcatggcggctcatgcctgaaatcccagtactttgggaggctgagatgagagaatcacttgagccctggagttccagaccaacatgggcaacatagcaagatctcmcctttwaaaaaaaaaaaaaaaaaaaaaaaaaaaaaaaaaaaaaagcttcggatttaataactcttctaacagctttaatatttaccttctcactgcagtcaatgctattctttaagaaatagttaagtcttgccagggtctaaactgctctcctgcctccatcttcaaaagagcattctaaaaatgatccccaaaagactggaagaagcatttagtacaaagttggagtgaggagattcctactcaacctatccccatatgtcaaaggggtgattgtctgaacccatgtttaaagaacaaggtcacattgcttctattaatatcatcccatagactggccgctgaaaattcctacaatggatcccttgggcacaccttctccagtcgcctaatcctggttttccttcttgcattgctgcaggtcatgttctttctaaggtgctagctaagcctgagaacctttctgcttcattcatcgtccaggatgtgaacatcaccggtcacttttcttggaagatggccaaggccaatctctatcagcccatgactgggtttcaagtgacttgggctgaggtcactacggaaagcagacagaacagcctacccaacagcattatttcacagtcccagattctgccttccgtaggtcccacctcttgtactatgtctgtgtcattggtatctactgctcctttttactgaccttcagaggtggctacctctgtcattctgtgtgctgcactattgagtcttatttttgcattttcttcttctgagtgtatcttttgcaagcattaacacatcacaaatgtgactgcatagctaagaagtagcataagctgccatctagataaagtttgatggctagagccaactcatgaaaagaccttaccctatcttgtatataagtgattgagccattttcttctatctttgttaacctcatgtctctctggtccaagtgaacatgccctgtttgaagtgttgaattgggragggcaggaatagctaaaagaagcttgttgtttgtccgtcttccccgcaacttcaaatttggctcgaggctgtaatgagttggcctgtcttccaggccacttaattccttggcttcaaaaaaaaaaaaaaaaaatcatgtgtgggattttaccctctctgaaaatgcccttagaatagccaactaccgttacaaaatccaaaaagaggggcagagagggaaagaaacacaacttaaatctcagaaggaaaaattccatggaattagagagtagttattctataaatgtactaggttttattgagttttgagaagaatatgttggcataaaaataaacattttcagttatgggcattgacagatactgtgttttaagaaaaacagttggctcattcactgaaatttggactatcaagagttcacatcacaagatgtgcagctgaagactttaaaccatgggaaagttttacgttaaggaattaaaaaaataaataaaatcccaggagtgagccctgagaactggcacctcagcatattttaactctgccaagtgtcttaggctgccaagaattgagtgaggtgctaagaaaccatatggcagagaacccccacaaatgagaaatagtctataaattaaactatgcctttacaaagcaaccaaacttgcctgtgtatgatattctccagtgggggaaaaactgttctaggctctctgtgcattgcatgttgtctctgaaaggttgtcggtgagcatgctcttttatgttgtccccttaggatcattatgtcctaacagtgcccaatctgagaccatctactctttaccgactggaagtgcaagtgctgaccccaggaggggaggggccggccaccatcaagacgttccggacgccggagctcccaccctcttcagcacacagtgagtggggtgccagggcattaagccatcctgtcaggtcttgtggacatagagaaaaatcttgctggaaaatgaaaacaaataaatacactagtacaggtttctatgagatagggaaattgtcatcatctgaaattctttctccctgtttgtaccgacttactagattctattccaggcacctgtagtatacattgcatagttgatgcttaattgttctttttctccctccctccctcttccccgcttttctccctttctttgctccttccttgtttcctttctccatcctctctccctccctccttcattcttccctctcttttctcctttcctctatccttcctttgttttttttttccttccttgcattttcccctatgtaatgcatgcttttttccttgtcttttaaaccataaatacatatgggaaaaaaatctgtagtctcatatctgaaatatttttaaatcaagattttcatatatcacaatataggaaataatattttgctaaggaacttatsttcttgttacatagatattactgtaataaatattatgaattttcttcatgatatgacccaagtccacctacttcatttattgctaaatcaagtaaaatttaaaaagaaaattgtcacctagattttcaaaacagcctcttgctgatttttaaattatgtacttcgtttactttattttctagcttaaattttttwaaaaagtgtctgatgactagtgtgtggacaaaacattgagaattagtcatagttttaactctgatttttttaaatgatagattggtatgcttataattgataacttggtatgcttataatttgaagaaaaacaaaaactatcacaatgggagagcttgatagcctctaaaatttttgtcagataaatgcttttctgatattccttcatagaaattccttttaacagaagtatttgataatttttaaacttctttgagcaaataaaaaaggattatggtttgattggataagtgtgagcttaaggaaaggagcttgtcttctttttcttgttattttatagtttggraagacatcaaagaggaagagaaaaacaggaaaaggagagaaagagtgtggttgtacattcagattcagaataggaaagacatggtcataggaaggaacatttgccagggtctcgtgctttttctacaaataaaggtaattctatcatttatttgatacatacaaatggatgtkactgacatattttgtcactttttaggatctcatcttaagcatcgtcatccacatcattacaagccttctccagaaagatactaaactgttcaaaaagattttgtgaaattgcacagatgtgtaagcttgttgaacttcggccacgagacatgcacacttccagaggcagtgggaactgctcagaggcccggactctcctatgtgactttagtgcaggaagaacttctgtcaatcatggacgcatctggagacaagtgagaaacagtagattggtgaagacagacaccagttccctacaagcatggagaaaatgaagaataggcctgtttaatgctaaattttgttttcatgtatggtgtcgctcatttctattgaattacaacagaactcagttttccctgaatttggagcaccaaactccgccccaaaaaggagagtaacaaatacacaattcacacataacactaagcgtaaatctaatcaataaaatatatttttgactaaattattgattcgatatgaaaaatcaactaagattacacagctttgtttttttgaatctttcctaagatcatttttatcctaggtgatttttaaatgaaaatgtgtaatctaaaatataccagcgaatttaaatctaaaaatgctcctactttaagtaccttgtgctgctctttatgcaaaggtaaatcaaagttccctctataaattatgatttacaaaagacacccaagccagaggaactcaatgaaataagctgctaatcagattttaccttggagaaatgaaaattatttcttggggatgccttttaatatttgatcctattatgtgagagattttcctgatatgttatcttatttatattttcccttattttcctcaatgcagataatagcttttggtgcacttttgtttcaccatctgaaaattcacaaaacttcttgcttcaaatgaaaaaatcccaactattgagcatgtttaaatctttgcagagatttgccttttcttaatcaaagaaaggtctttgtgtgctagaatattattggtaatgttttaaaaattcctttgattgatagagaaggacagttatttgcatttaattcacccatatgctttcaaatctagtatatcttactttttggaaatgttttatgctacaaattagtgccttgtagcatgaacttaagtcaaaacgtgttatcaatatagagwgttgcagtgtatattgtaacaacctaaaacgcagagaagtttaatttaatactgttttttttcttgaaggaatactcacatacatggtttgaaatgtgcatagatatgcatgtctatataattataaatgcatgtgtatatatatgcaaatatatgtacatatacatgtatatacacacagacacatgcatatacatgaatataccttgagcatgaatccctggagaaatcgttttcrtagctcaccaatggtgagtaaagatacagctcttttaaaggtcataaggataatatattttccccatcaatgctgattctgagaaaagagcaakttatcaaaattaaacactgtaaaagaaaggtgtccayatgtctttacctacctaagtaaaacaggaagaaaatcagtaacattatccttaggttttgacaatggtacttgcttcttgttgttttattgtttcctgaattcatgcagatgcctggccattcctgggaagagtggataactcagaagtcactgtactccacagagcctcactgcagtgtctaaaggtagatgcaaattaaaatgcagggaaaataacttttctgatgttgatgcatgtctttgggaaacacatttataaacatggatacctgataatagatattgaaacccatttcctgtgtgttaaaatatttaaaaagtggatattccaggaatgttttgcagctttgtacaagtaacataaattggacacctcagaatgaaagttcatgttggttctgaatggttcrctgcagctcctgtcacargctgggatggatttatcacattgagttatgaaattacctggttctaagaatttttgagtggcaaaaatagaaaacaatcttcatttgaaaacatccctaagcttgaataaatggataccatagatagyttctcttttttattctggtgtcattaccagcatctgaatttcaagttcttaaaatttcaaaaattaaaatttttcattattagctatccatttatcttttacaygaacttgtcatgaacaaattcaaatgtttatgccagcaaatttttgtactgttgcatagttaaaaatgctgggagtctctgcatagatacaaaatattattaaattattacataaatttaattttataaaatttaatcatgcttcttttgtctgggtaatagacattggacagatatttttagttcagatggtgattctgaagcttacatctcccttaaaaaaatctaaagcagctcttatgggcttctaattttaatataaataaataatttaaattttattggtgttattggaagaaaaatgctattaatgggctaataaaaaacatgtgtttctcttatggattttaataagctccagtattattcaaatgatcaaaaatatagttataattttttgaattttaaaaatgtgattgctctaataaagaataaaatctatgctttttaacaaacatagttttggtgcctaattctgtaatatgttttattgaaattagattcatttctctaatgtgagaaaaatatatccagtaatagtattgactgtttaaaaaattgagctcatcaaaaatattgtcatcaaatacaggtggttaatctgacatacattgcagttacatgcattatttttatttacaacatttgctccttaatgatgaatttatctgtgttaccctgtttttctacctggaactccatagaatgatgtttgcaaaccaacatgtgctcttttcagtcattcactgttttaatatgacatggtagagaagataaggtttatggcaggtaattttttgtaatgtgtattaaacgaagttcaaagattagaaatacatctgtgtcctgaaaaccttagatacatagccgaytgtatacagaggttcatctcaamctcaacactattgacttttggggctggatagttctctgttgtgggggtttgtcttgtgcactgtaggtttttagtagcatccacactttctcctcaccagatgccagttgcaccctcccccaagttgagacaaccaaaaatgtctccagatattgccagctaccccttgagggatggtacctctggttgagaaccattgctagagaatgatctttactgaatttgccctttataagaaacccagtgaatttctagagcaagtcccaaaaactaagggacagctaagaagttattatggttgacttcaaaggcctaaactgtgttttttatgtccactaaacaacttgattaaaagacggaattttgactcgtgtctgtatcatacaagtacaaatactaattttgccctatgtatccgtaaatgtcatttgtgattttgacttatttatttaatgccctttcttatgccgtgggttttcaagtttactcatttctatggttgcaaataactctaaaacttattatataaactttcatattataggcagaacacaatggctaaatatctgttgcatgtactttaaagtttattataaaatataaacagatatataaagatgttgactcttacctgtgattttgcatggtcagactcggtgtcaggtacggagaggattctcatgactgtcttacctctactgaatattctagtgagttatatgatttacggagtgattaacagaggtctatataaagttacttttcccctttacttaattatattgtagtgtgcagataacaaaactgctaccttctcatccaagtggtctgtagaattcatgtcccttacagtggtcatttaaagtcaatatttatttatgtatgtaataaaaaaagttggatttttgtgtatgtctgtcacattatttagagagaagtaatcttgtaaaaatgttttgtaaaaaacaaaaaagtattgtaaatagtcttgatattctgtgactcattattttcatgttagagtttgtacatactggttcaataataaagtatccttaaaccagaccaaggagtcgactcatttatttcttaaagaaacatttttgctgggcacagtggcatgcacctgtagtctcagctactcgggaggctgaatctgaaggatcacttgagtcctgaatgtttgagaccagcctgggcaacatagcaaggccctgtctccaaacttaaaaaaaagaaaagaaactttattgaatttaagaggaaaaatggacagttcctgctgccaaggagattcaaaaagtctctttccatgtcagtgttaatggaatttgaggtctggtaaatgttaacaagacagcacttcatcctaatgaaagtatcttggagtttgacaaccaacacttcagatttctatcatcatgtttacaattgtaactcctgatggttttagtggtatattaagtcaaggatatacaattttaagctgtttttcttttgccaccaatatttactcctaaaattgtagatatatgcaatgccaataagcattcacctgtatttcaatactactcaattgtttttcaatactacgtactatactataagcctttaaatctccattatctaagtagagttttgagaggcttgtacatccccactttgacatgcaatggacccataattgctgatgaattggaaaaaatgcctaagaaaaaaaagcataagaaataaaggcttttagggcattcaccaaaataatatatattgtacccattaagtaatttctctttactcccactctcccaccctctgaccctcccacccttccaagtgtttattgtcaattattctacattctatgtacatgtgtacacattatttagttcccaattataaatgagaatatgtggcatttgtctttttgtgtcagcgtcatttcaattaagataatggcctccattccatccatgttgctgcaaaagacatgattgcattcttgtttatggctgaataatactccattatgtacatagggaccacttatatgctgttggtcataatgtaaattaacatgacctctatgtaaaacagtatggagatttctcaaagcactaaaaatagaactaccatttgacctagcagtcccactactgggtatctacccagagaaaaagtaatcattatatgaaaaagatacatgtttatcacagcactattcacaatagtagaggtatggaaacagcctatcaaggctatcagtggaggattgcttgacgcttttatgccatcttgaagttacagaaagaatgggggctcggatcttggcaacacaatttatgggagggagagaagagaagtcctgactagcaaaggtggtcttgttacgcagatgaaacctcccaggtcgcagcctttagagagaatagatggtgactgtttctttcagaccttaaaggtgttaggcttttagttaatttttcctagatccagacacgggggcagggagtgggtgtcagagaaagcctggctgcagcaatgcatcaatgcagattttctctacatctacagatgccaatttcccccacaaaagacagctttgtagggctgttattttcaggccctctgaacagccatctctaaatatgtcaaagaagggttatttgggggtgaaatattttgatttctttcaatggctgctgccgccaccctacagcatgagcacccatgccagtggccccaggcttgaccctccccagtccctgaggcctgaatttcctgggagttttcctgggagttcttatccactcattctctgaggcttcacccagccaatcagctgcacagcttgggcacctcacactggtctccaacctccattcttcatcaaagatcagagaggctggggctactgacccagagatcgggcttgaaggctgcaataagaatccaacttccttcacattcttttacttcttgagctacaccacagggtaagcaggttcttagggccagtggagtgtcttggcagggaccgaaaacccaagaaatatttttagtattgtttccattggggaggtatttttttacacaaatgagtcctgagaatacagctttgttgtaaattggagacaacttctacatataccacccattgatggagcatggtatcaaaggagaaaaagctgtaggggatacaagaaaaaaaattttttttttttttttttgagacggagtctcgctctgtcgcccaggctggagtgcagtggcgcgatctcggttcactgcaagctccgcctaccaggttcacgccattctcctgcctcagcctcctgagtagctggggctacaggtgcctgccaccacrtccggctaatgttttgtatttttagtagagacggggtttcaccgtgttagccaggatggtctcgatctcccggcctcccaaagtgctgggattacaggcgtgagccaccacgcccggccaagaaaaatttttgaaaagagtaagaggccaggcatgatggctcacacctgcaatcccagcactttggaaggctgaggcgggaggatcacttggtccccgcctgggcaacataaaaagactccatgtctgcaaaaaaaaaatggaaaattagctggacatggtagtgcacacctgtagtcccagcgacttgggtggctgaggcaggagaatcgcttgaactcaccaggtattggctgcagtgagctatgatcacatgattgagctccagcctggatgacagaatgagaacctgtctaaaaaaaaataaaaataaaaattgtgccctctcttgtgcagaaacacagagagtgtgcctgcctatcctttctctgccttggtattcccacccaaagtaaggattttgccactcacttcatggttactgtgaagatggtcatgtaacagtgcttggaaaaatccacgtgtgtgtgtgtgtgtgtgtgtgtgtgtgtgtgtgtgtgtctaaaaatgtcagattgaagacaccaaaagcaatcacaacaaaagcaaaaattggcaaataggatctaattaaacttaagagcttcttcatagcaaaagaaactgtcaacagagtaaatagacaaactagagaatgggagaaaatatttgcaacttatgcatgtaacaaaggtcttacatccagcatccagcaccgataaggaacttaaacacatatacaagaaaaaaatatcattaaaatttgggcaaaggacatgaacagacacttttcaaaagaagacatacatgtggccaacaagcatataaaacaaagcccaatatcactgatcattagagaaatgcgaatcaaaaccacaatgaaatatcatctcacaccaggcagaatgggtatttcattaaaaagaaaaaaatagcaggtactggcaagattgcagacaaaagggaatacttatacactgttggtgggggtgtaaattagttcaaccattgtgaacagcagtgtggcaattcctcaaagagctgaaagcagaaataccatttgacccagcaatctcattactggatatatacccaaagaaatatacatcattctaccataaagacacatgcatgcaaatgttcattgcagcactattcacaatcacaaaaaacatagaatcaacctaaatgctcatcactggtagactgtataaagaaaatatggtacatacacaccatggaatactatacagccacaaaaaaggaaaaagataatctcctttgcgggaacatagatggagctggaagccatcatccttaggaaaccaacacaggaacagaaaagccaataccacatgttctcacttataagtgggagctaaatgatgagaacacatgaacacaaagaagggaacaacagatactgggacctacttgagggtggaaggtgggaggagggagaggatcaggaaaaaataactaatgagtactaggcttagtacctgggtgatggaataatctgtacaacaaacctctatgacaagagtttacccatataacaaacttgcaattgtacccctgagcctaaaataaaagttaaaagaagaaaaagaaaattgaattaatcatataaaaaaattaaaatgccaaatcactaaggtgggggtgggggtggaaggtttgtaatccctaaaacaatttagagcaactaatagaaaattgagttggttgtatttgtaccaacacttcttgatattcaatccctggcagtgacagaatgaaatttagaataagatgaggaaagtgagcagtttatgtaagatctgtgtaatagaaggttctaatctacacagaacacagtaagaagaatttggaaaagcaaaatctaagaatggaaacaaaatagaattaagagggcatttagaaagtaaggcaaagaaagactaagataagggtggggagagaaggagagaccgtgaaaccaaagacataagtactgaagactacagttcttttgcatcatgactaagggccagaggtctgatttagatgccacagcaaattttgaaatgggaacactgtagagtaaatgttactgagtaaattttacatatattctatgtatgaaattgaagtagttgggagaactagaactgataaggaacaatgtggagtccagggctccctgtgttttgtgaaatttaaattcaaatccaagccctatgtcatttgccaatcttctttaaaggagtctctccctctctctctctctctctctctttttttttttactttgtattttgagaaaattgtagattcacatgcaattgtaggaaataatagagattatgaactatcctgaacccttcatttagtttcccacaatggcgacatctttcaaaactacagtatagtatcacaaccaggaaattgacattgatacaaaccatatcctttattcagatctcatagatttgatatacacacagttctgtgtgtgtgggtgtttgtatgtacttggttctattcaattttacacacaaattatttgcaatctgtttacacaaatgagtcattgtgttttaagtagataaacatctaagggacacacaatgacttaaagaaattagttttaaggaggtatggcagatttttgcacatttccctagggctgagtgcaatgtactttgtgctgattttaactttaacattctaggaatgatcgactcaatatgcatgtgatgccatcttcaatttctgtcagtgaattgttttcataaagtggccgagcacataacaagtctgtttagaaaaatccatcttgtccaaggaaacaaaatgtttgagtacgtaaaaatctatagatttgaaaaatcatttcactgagagaaatcctggtgcacatttatagtctagacgtggatttgagaaaagaaaaagaacagtgaaatcctttattggctagaaaactaaagattgcccaaagtaggaagaataatcgagtttcagattaaggtaatacttaaagattgagttttgcacaattgactctgattattagcatgactctgaccctgggtcagaggctttcaaaactggctgcctattagaactcccaggggagcttttaagaagtccagtgtcctctggcacctaaagatcaggagagaagtatggacattgcacattagtgctagtttaaagggtccccaggtgattctaatatgtgcccagtgccgcaaaccactcttccagaccctgagaagctattgaatgataaatgttagaaacattcctgcttgcagagctgaagaagcaaaaagtcatattgaagcatcacatttttatctcagtgcatcagaatatactgaagtttttctcctcaaattccctggattaagttacatataaagatgtagatgcagacatgaaaatgcatgcaaatacatacacatgtagataaatataggtagagctatcacaggcgtcttcctttcgatcttcttttgagtataattcggaatttatcctgagaaatactgataaaatatagggctaggcaaatgtaatttgggatgctgtcgagtgttattagtgg

SEQ ID NO: 10746 - DNA, 38507 bp, Homo sapiens
cctgctgcggtggtgagtgctaatgtctttaagaacaccagacattcaaccactgacttcatctgtatgcatccaggatttttcagtttctttatgtctgtcttttaatgtcaaagaactcatactgtcagtactgaagattgtggcttctgtgaattagatggctggctggtagatattcgttctgatgactttatcttgcccaaattcctatctaaggggtctggggagccaggccctacaaaccataaattctcatcagatggattttctttaaccctgtgtatcgtgactttagaatctcaccctggcatatcattatgtgacaaggaggaaagtcaaaatattttaccccaaaacatgtttctttgctatattttgaaatggccctgcaaagttgtcctttgtgccggaaaatttgcatctgtaaagaatctctgttaacatagctagatcattttcttccaggctttcctaatcctgaagagattaactaagagtctagcaccttttaaaggtctgaataggaaacatttgtcatctgttttctctaaggcccgtcactacaagacttcaaaagaaccttggtctccacaatcttttatcttaacctgagcattttctttctatcgattttaagtctttaggcaaactcaaccaattatcaaccagaaaatgtctaaatttacctgtagcctgtagtcccacactttgagttgccccaactttttggaccaaatgaatgtatttcttaaatgtatttaattgatatctcatgcctccctaaaatgtataaaaccaagctgtaccccaactaccttgggcatatgttctcaggacctccttgagggcctgtgtcatgggccatggtcactcatatttggctaagaataaatttgttcaaacattttacagagttttactcttttcattgacaataatttggtgatcaaacatgtggcacctcagagaagactcaggacccggaaggagttgcccaaatatggagctatggtagtagcagggcccattgaagcctacatgacttcaagcttctcatctggtggaactggtaagtcctcctgagcccccgacttctctttggttgatggtctttgatttatcttagctggtttttctcctagaaagttgtagtttcaggattttaattatagtttggagatgattttcaaggaattctctctattgctttgtctcccaaaattaatcttaattcactttgcacatttgcatgaggaactgaattgttgatttcaccggttaatgagaaactgagttttctcaactttttttgaagagaaagggcatttgctcctcctagccaaaaggcacccctgggtatgtctgggggttgacccccttgtgacatgcagtagccctgtaggaaaatccccaacaaaaattaattataaaaatggcttgtccaggaaatgaatatcaggctgattacccagtgttttgagccctctcagagtttgtagaactctggagagagaaactgagacatgtacaagggtagacctgactcaatggtgacacactgtagagtcctgcccacgagcagtacaaatcgatccaccacacaaaaaccctaggccacagctcagtttctccttttaagaaaaaaaaaaaaaagcaggaaacaaataatctaagaatgagtagaaaacaaggaggaaaagcctattttgagcactttgtaggtttttttggcacctctacttgccagagcattgggggaaacccatccctgataattctttgtgggcacttatctatttccctaagtgtcggccagtctgagaaataaagggaaagagtacaaaagagagaaattttaaagctgggtgtccggggtagacatcacatgtcggcaggttccatgatgccccctgagccacaaaaccagcaagtttttgttagtgattttcaaaaggggagggagtgtacgaatagggtgtgggtcacagagatcacgtgcttcacaaggtagtaaaatatcacaaggcaaatggaggcagggtgagatcacagaaccagggtgaaattaaaattgctaatgaagctttgggcacgcattgtcattgataacatcttatcatgagacagggtttgagagcagacaaccagtctgaccaaaatttattaggtgggaatttcctcatcctaataagcctgggagcactataggagaccggggcttatttcattccttatgacaaccgtaaaagacagacatccctagagcagccattttagagacctccccctaggaacgcattctgttccttgctgagaaaaagaattcagcaatatttctcctatttgcttttgaaagaagagaaatacggctctgttccgcccagctctcaggcagccagacctaatggttatctcccttgttccctgaacgtcgctcttatcttgttcttttttcaaggtgcccagatttcatattgtttaaacaatttgtgcagttaacgcaattatcacagggtcctaaggcgacatacaccctcagcttacaaagatgatgggatgaagagattaaagtaaagacaggcataggaaatcacaagaatattgattggggaagtgataagtgtccatgaaatctccacaatttatgttcagagattgcagtaaagacaggcataagaaattataaaagtattaatttggggaactaataagtgtccatgaaatcttcacaatttatgttcttctgccatggctttagccggtccctctgttcggggtccctgacttcccacaacaccagagtttatgtgaaatggaagtaaatcatctttgtgcacatttacattaagaagaaagagcccaaaggttgaaccacaaactatagagttcctaggtcctattatcttttctgcctgctttaaatctaccattacttttcttctgagataaaaaccactctttgtctttgtttctgttagaccgcttttcatttctgtattgagtatcttaagtactgtagaaaagatgtcacttcttcctttaaggctgtcttgtaatatatataaggactggaattgtgtttctaaagaaaagcattcaagtatgacaatatactacctgtgttttcaccattaaaagtgctgtttagtagtttaaacttaaactatttaatgtcatttaataaagtgaccaaaatgtgttctttattgtattttcacagctttgaaaaaataaataattcaaccatatatccctaatatttcacagcctccttaagaatgtataacagtcaacaaacataaaagaaatagcagacagagtatgagatgctgaagaaacactacagtgcactgaatgcaaaattatgcacttgtgttgtgcaggggaaatagtttggggttaaatcagtcactcagtgatgtgaagattttgaagaactggaagaactacaaattcagttgcaatcatgagccttttctaatcccaaactcattaaaagtgaaggcgaatttctgacctcttgcaatccttcaatgttaagcttcatactgccattttattttaatatttttttaagttctggaatacatgtgcaggatgcgcagtttgttacataggtaaacgtgtgccatggtggtttgctgcacagatcaacccatcacctagttattaagccaagcatgcattatctcttttccttaatgctctctcacatcccccatcctcttatctggcctccatgtgtgttgttcccttccctgagtccatgtgttcttattgttcagctcccacttataagtgagaacatgcagtgtttggttttctgttcctgcattagtctgctgcggataacatcttccagcttcattcttgtccttgcaaaggacatgatctcattcatttttatggctgcattgtattccatggtgtatatgtgtcacattttctctatccagcctaccattgatgggcattttgattgatttcatgtctttgctattgtgaatagtgctgcaatgaacatatgcatgtatgtaatgtatctttataatagaatgatttatattcttctgggtgtatacccagtaatggtatttcttggtcaaatggtatttctgttctaaatgactcaccacacactcttccacaatcattgacctaatttacattctcaccaacagtgtctcttgaatacagcacactgatgagtcctgtctttttgtccagcttgccattgtgtgtcttttaattggggaatttggcccatttattttaaggttaatattggtatgtgtgaatttgattctgtcatcatgatgttgcctggttaattttgcagacttgttaatgtagttgcttcatagtgtcatgggcctgtgtattttagtgtgtttttatagtggctgctaacagattttcctttccatgactactgtttcctacaggatgtctttcaaggcaagcctggtggtgacaaaatccctcagcatttgcttgtctgaaaaggattttatttctccttcacttatgaagcttagtttggccagacattaaattctgggttggaaattattttctttattaatgttgaatattggtctccagtcttttctggcttgtaggatttctgctgagaattccactgctagtctgatgggcttccctctgtaggtgacctggcctctctctctggctgcccttaacattttttcctttcatttcaaccttggagaatctgatgattatgtgtcttgggattgatcttcttgtggagtatcttactgggactgtctgaatttcctgaatttgaatgttgacctgtcttgctaggttggggatgttctcctggatgatatcctgaagtgtgttttttgacttggctccattctccacatctctttcaggtacttcaatcagtcataggtttggtctttttacatagtcccatagttctggaaggtattgttcattgctttttatttttttctgtaatcttttctacctgccttattttagcaagatagtcttcaagctctgatactctttcttctgcctggttgatttggctattgatacttgtgtttgaatcatgaagctctcacgctgtgtttctcagctccatcatgtcatttgtattcctctctaaactggttattctaattaacagttcctgtaatcttttatcacggttcttagcttctttgccttgggttagaatataatcctttagctcagcaaagtttgtcattacacactttctgatacctacttctgtcagttcatccatctcagcttcagccctgttttgtgcccttgctggagaagtgttgaaatcatttgaggagaaaaggcattccagcttttggaattttcagcggttttgcgttggtttttcgtcatctttgtggatttatctacctttaatctttaaagctgttgacctttggatgggatttttgtagggtcttttttgttgatgctgtgttattgttgttttatttttttttgtttttcttccaacattcaggcccttcctctgcaggtctgctgcagtgtgctgaggatctactccagacactgttcacctatgtatcaccaatggaggctgcagaacagcaaagagtgctgcctcctccttcctccggaagcttcttcccagaggatcactgacctgacgcctgttggaactctcctgtatgaggtgtctggcaacccctgttgaatggtctaacccagtcaggaggcccaggatcaggaactcacttaaggaaagagtctggctatcccttagcagagatggtgcactgggctgggggaatcccccttgtctggatcgctgatactcttcagagccagcaggcaggaaagattaagttggctgaacctgagaccgcagctgcccctctccgcaggtgctctgtaccagggaaatgagagctctgtctgtaaactctaggtggagttgctgaaattcctgcaagcatttcttgccgggagaggagggatggatcccggtcccacctaaagaagcagtctggccatgatctgccacagcggctgtgctgcactgtgaagactgctgcccagtccaatctgcccagcctccctagcactggtagggaaaaaccgctgactagagctgcagtaatggcagtcgcccctcccctggggaactcggtcatctctggcgtactccaggctgctatgctggctagtggggattctaatccagcggatctaagcttgcaggcttctgtgagaatggacctgctgcaaggccattttgctccctggcttcagccccctttccatgggagtggacgggactcctgcctcactagagttccgggagctgctggactatgtaaaaactcctgcagctcagtgcctgcccaaaaagctggaaatatgaactattgggttaattcttatcaggaaatgaaaaasagttgttagattaaacttcttcagtcattgtcgttctttgtaatcagagaaagaaaaactgagagatcaggaagagaagagacagatggatagaagaagtttgggtggccacaggaaacaagaaaagaaacaagctgaggtgtcaacccacaggataatattttgtcattttcatttttttcccccaagtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgastctgaggctctttccaacgctgtaaaaaaggacagaggctgttccctatggcaggtgagtccttttctgactaggagyttgggagtaggaacttagaaaacacttgatttattgctctgaaataaacacaagaaaggaagtgagccgatagcacacatgttgaattccttttcttactgattgtgtgtagtttgaatcatgggacctggtgttagagatattgacggaggtcatatgttttccagatgtctttgagccagaaagaagttaattcctttctttcagcttctggtaatcaaagggagggtaaagaaagccagaggaagttatttgtgtgagacaattctagaagtttcgaaatgcactctgaaatctttcttttgattccaaattaattgcccagatcacaaacctttttcgcagaatcagatctgagagcctctgaattgttatcttcttcgacatctcttattgtgaattacattcttggtctgtttaaagtgattcaattttttcctctttctcgttggtcctgatactgactactttaatataatatttcatgggttaatatcacagttgttttgttttgccgttgttattgtttttaactggtatccttccctccaggacttaactctccaatccattctgcacacaacttttaggtcacctgtcttatacacagaagctgaaaaagcctaagggatagagttacttaggcagctagtattccagcaggtcataacgcttctttggcttcattctcctcacaggaaaaggaagaaattggactagatcagtgaattctaaaccttataacatatcrcagcaatctgtagtcatataaaaaaagtcagatgactacccccttcctcaccgcgaatagctcaatcttaaataccctgcaggcatttattacctttgaagatcgtcacataattcttatgaaactgacttgacataggtttgttctattaggaaagttgaccagttagttaacactctctgcttatctgctagtgatctattaatgtaattaactttgctcagggacatacagtggctccctattgccttttctyttttttactatctgaactttcagacaattttttctaccttttgaaacatgtgtatccagtttttccattaatctttgtaaagcatgatttcaacttcataaaaaaatactgtatttacttcactcatattaccttgttgttgtttctttactcctttgattctccctatagaacaattctctccggggtttatgtctaacttcacaacatttaacttaagctctggaatcaagggatcattagataaagatagggtaaattgaaagccactagtcaaaaacaagtcgtggtttgataattataaacaaccaaatgtagacagctattattaccttaaactcttgaggaattgtatcctgtaatgtgtttaagcattacatcactttgcctggaaccaaaactgtggtcctgataagttttttcctctaattgattcctgccatttttattatcactgcagctttcattcagtgattattataataacaaaaaataatctatagtaaccatttctttaaaaaatacttaccatatgatagctaattcatgcactctctctgatttaatatttaacatcaatcaatacagttgtgctattatttccatattgtagttgaaggggatacttagagaatgcctccaaaatatgctttaggtcaaaagtctgttgagaggagtggtctcaggttggcatgactctcaaactctgccattaatctaactttctgcaaacatcttcaaatacttgccctgtctctgatcactgccacttcagtcctggcctcacatttctattccttctaaagcccagctctcccagttttctggttacacgagacaccctcaagcctttgtgcttttttccttactgctctctgccaaaagaccagctcctagttttccaggggacaaattcctaccagtccttcaggtctcagtgccaagccctcccttctctggacagctgtacctgagacacactttgcttatgcttttcttgagcttctgctaattatttacattcttataatatttttcattttacttatttgcatatgtatttttccacttgactgcaaacttcaaagtgtacagacatgctgccaaagtggtacccccaataacagcagagtaagtttcaagaatttatgctcattaaatatacctgaatggataggggaatgaacatgccttccttctgttgaaatatccaacatgcaactatcatctattaaatgaaatcaaacttacctggtttgctattaagaatttgtaatcaccaggtgggttcaccttgcccactgcttagacagagccaatttatcaagacaggggaattgcaatggcgtaagagtaattcacgcagatccggctgttctggagagggtagtgttattattacttaaatcagtctccccgagcattcagaaataagaacgtttaaagataatttggcagctaggggcttgggaagtaggaagtgctgattactcaggtgggagatggaatcatagggtgtcaaagtgaggttttcttgctgtgttctcttcctgggtgtgatggcagaactggttgggttagattactggtttgggtggtgtcagctgatccattgagtgcagcgtctgaaaaatatcttaagtgctgatattagattttataaagtgatattatccctgggagcacaatggggacattccaattctaggagccagaggctgcatgtcccttacattgtaatttttagtcttgtagctaatttgttagtcctgcaaagggagactggaccccaggcaagaagagggtcttttcgagaaaaggctgttaccggttttgtttcagtcaaaccatgaactgaattccttcccaaagtcagttcggcctatgcccaggaatgaataagaacagcttaagggatagaagcaagatagagttggttaggtcttatttctttcactgtcgtaattacctcagttataatattgcaaaggcagtttcaatccctctgtttgggttttctaatagcttaatcttaaggtgtaggctatgaagatgggaaaaggctgtcgatcactctggcttcttcctgctgacaggagacatagtggaaattagagtgaaccccaaggtgagaagaatgtaaccactttgcaactgtctgagcatactcatgcaggactggctgggcttccaatgcttgcaatgcaaaaacattagtactctcctctgtagttttgctataatatttaagccaacagcctcctgtaaggtaaataacaaatcctaggatgaggagtacaattctcaattttaaaagcaaarattggaaagcattaatttggggacttctaatccacaaagaatttaggatttagtccaaactgtaggaaaaaactcaaacaaaactaacaatgggtatattatatgttttcttttgaagcataatttttctctccagaccctatttttattaaaagtaaattataatagaactaatctgtttaccaaaataagctttagtcttactgtacttggcctgattatttgcatgaagtgcaacaagaataattattttttatttaggctgttttttgtttaaattggctttgatggaactctgttccatgaggaatctcagataagactttttaagagccaatcccagccatgcatttgtacccttaaatacctatgagttgggtaaattcctctcctctcaaggtcccaagataacttggagctcatgaacctgttagaaagtgatattctttacttactacagatcaagaaccttgtacaaggactctgtgtagacaaggtatgaagccagattccccaaggggcttttattggctctgtaagtcaacttcgattctttaagggaagagtgccattccagtcaaagccttggtaaaataaccaatttctccaattgtgtcatgttacaaaagaaaacagatttttattgtgcttatggaattaaccatgctgccataaattgagaatacttacaaagagtttccaaattctggagaaatcaggtagagagaaacaaatatgcttcaaaattttttcacaggagtgtattttacctacttgttaaaagttgcaaatatctctaaagaaataagttatcttgactgtgaaaactgaaggattggtgacatttaagacatcagctcttcatgagagtcctggaagttttgtttttttcctctattccaatagcacaatttttaaagttatctgagacctgcactcagagtcctatacctgattataaactgccttttgaaaacgaccaaagcaagacaaaatgtctgtggatgacaaaagtctatagacactattaaagctataattgactaggaattttgcttacttctgtggcatccaacaattttgtataacaattataattactaataatgtacagtaaattttatcagaattatagaagtttatataaatacacagacagacagaaaattcagcacttgtaagattttttatttgccagttgttaactggactactggcttcagagtggagcccttggaggaacagggccaggaaagcatgcattttttttccaagctaaataagcaggcacagctgaaggcaaagacagatctccaaaatgaaggatgccattttatactggatcccagatccccaaaaggaaggaaatactactggagaagagagtgcagtgcttctaacctgcattttattgcaaggcaacctaaagccaatcaacccattttgaaatcagcccatcccccatggaagtctcatctctcagtcaggcatggggatgtttccrtatcttccwggtggcccagagcatgcttctctgacccaagtgtgcgaagagccaagtttccctctgaaaatactattagccatcccttaaagtatatttcctacctagttattacataccaaagctatctcataatgcaaagtaatttctgatatccccaaaattcaaactgtcagataacacaatgcaaaacagaacagagcctttgattttgagagtgatccatctacttttaattccttggttgtcatgaagaaaacagagggttttttgtttgtttcttgttgtttgtttttcccaaaatggggtctgtggtgcttcctctgtttttctcaaggagtctcaggctaccaaaagttatcttagtgcctcttatgtgtgcattaagagtggcaagacaaaaaatggagaaaaataattcagtttactaagaagaaaaaaccctcttttacagaaaaacgagatccaagaagagaaaaacataaaggtcttttaaatgtatccataacttgtttattcacttttaattaagctgacttttaaccttagtgctcttaacaaaatccttttaaatttcgtattacccaactttagccatgcggccaacatttctggcttttgaactttatcaaaagtaacttcccaggtgyttcaaaggtgtggtaagcagtttctttttacaagatttagaatttccccaaggtagtccagagaaaggaaaattcaagagaggaaatcagaagctatccatggggttgtgggggaacctcattaaatggcaaagttatgcaaatagcaaaccagaaggaaattgttccagaagccaagaatagagcctgagcctctatgtcaaaaggcaaagtcttagctactgaattacagcattgagcagtttctattgctattccaagaaggagactagagaagccacttttaaccttgccaaggcttttaactgctcaagaaaaatttttagggctggatggtataaaccaaaaggaagtatccacatatggtcacaagattaagctcttaaggaggccaaacaagacagagaaatttcatacagtattggtttcagggacccattataattggccagcctgctgagctggcttgaaaagcaggcttataggggtcctaaacccatgttctatcttgtgatacccctctttccattacagaacactgaaagacaaattcttagcaaaaatacaccagatttgctataggctaagactagtcttgtaaattcttttttctattaatcaaaactttacagagaaacatatagtgatgtttactgtttacacagatggagaaagagagagagaccagaaacctagctggtaagaatttcttacactttttgctggcataccagatttctgggtgccttttctctgtaacttccagaagaacggaacggcttctgatcagcctgctcacctcaccatagttgtggggttcaagccactttacaagaaaaaagtcaccattttctgttttatggaaacataggcaagattcttaaaatgcaagatgctgcccaaccagctgcatggggaaccatttaacattttctatcccagcagaattcacataacaaaacagacactagtcacctcgttcagcacccaatatcaacctggcaaagctcagacttttttctgttcgtccctgttgtctttgatccactccaggtggggagggacgacctcagaacagtaattcacaatggggtctctgggtaaggcaaagagcagatagtcaccatgagacaggcctattgaactttctccagggctcatcgaatgtaaccaaataagaagagtcctctgagttaggcctgctggacttccttcagcaattccttctgagattccctccacatatacaaacacacacgaagatgagacagacagaaggccttccaaatcagatgatccctaaacaggaactccaagagtatcccttccaaactatcctcctattctctgtctgagaaatctcaaaattgtcctgattgaggacaagtctcstgaaccaagactcttcctactagttagagccaaccaagaccccagtggagccgaacagataccccgtggtggagctacaaacagacaccctgcaatggggctacagacaccctgcaatggggctacagacaccccatcatagagctacagacaagtcgagagaaggaaggaggcattagcagtgcctagtagattcaccaatcctaacaccctgcaatggggctacagacagacaccccactatggggccacagaaccagtcaggagaaggaaggaggcattggcagcacctaggatactcaccaatccagacacccttcaatgcagctacagacggaaaccctgtgatagggccacagttagaggacatctctccaggattatttctccgttgcaattaaatgcatgcacattgggttggcagtgcctgccagtggagagagtaccagagccagcccccagtccaagagaactaggcggctacttgggctascttctggatccatcgctggagcgggggcaccaaaccacaagcaggtagccacaaaggctttcccagtctgatttcgttcattgttgtaatttcctcagttataattttgcaaaggtggtttcatattccttaagagttgagccacacataagttttattcatttgttcctacatggacttgactactgattcagtaaataattagtaaatattcagtaaataactagtaaaaagaatgccaaaaatagtgcagatgtagttcatggcccctgtcctcacagagcataaattctaacagtggatagagataagtaggctgggaatcacaattaaatggaaaaataaaaaaaaaggctggatgtggtggctcaggcctgtaatccaatagcagcaatttgggagaccaagatgggtggatcacctgaggtcaggagttcgagatcagcctggccaacatggtgaatccccatctctactaaaaatacaaaaattagccaggcgtggttgtgtgcacctgtagtcctagctactcagaaggctgaggcaggagaatcgcttgaatccgggaggcagagattgcagtgagccaagatagcaccactgcacttcagcctgggtgacagagtgagactctgtctcacaaaaatatataaatacataaataaataaatggaaaaaaaatgctactctaaggagatacaaggtgccctaggagcatatatctctgatgctgtctcctctggaagaatcagagaggattcccttaagaaaataccatctaatctgatacttgaaggatagacagatagmcagatagacagagaacagttcaaaaaccagaagaaattagaagcgggggtgctgaaactatacagatccctaagtagagacttgattccctgagaaaggtgccatctaatctgagacttgaaggttagacagacagcagtaggaaaacaagaatgaatgagaaggtaggggctggaaatacagagacccctaaatagaatctttctagaaattaaatgaaggcagaacgttttgaatgtaatgagcaaggtgggaacagtatcagaaaatgagtgaatgagaaggcctagattagaataggctgaaagttttcatggtcaaatctagatattggaacactcttcgttgcaaagagtagaatagagggacggagagtagattgataaagttcttatgaatttatttcttaagaaagaaaggatgttggcccgaatagaagtaatgaacaattagaattgagagaagtggtcagattctgaaaatgtttagcaaataaaatcgatgcaatgtgaattawgaagggaaataagacatagagaaggccaaagaggttgaatatcaccaggtattgctgctcttttgtacttggagtataggtattatttactagtatatggaaaagagaatgaaggatggaaatgaaaaaatgaacagttcatctttgtaagttgagttaaatgaggttgtgagatgtagttgagatatctcattgtctattgaatgtataggtttcaataccgacatccacatctgggctgaatccataaatttgagaatgatttatttattcttttaagcatataatggatgccatcagaatgtgtagattatacctcaggccatacttttaatttacttatttatttatttgacaaataaacattgtacatattttctatgtacaaccttctgcttttatgagtttaacctgtttagagtctatgtataagtgagataatgtgatattttgtgttttggtgcctggcctggcttattttacttaatataatgttcttcatgttcatcaatattgtcagaaacgataggatttacttccatttaaaagctgaatagtgttgcattttgtatataatccacattttcttcatctattaatctgtccacagacatttaggttgattttatatcttggctattgtgaataatgctgcaatggaaatagaagttcagatatctcctcgagacactgattttccaatttttgatatatacttaatagtgggattgcttgatcatatctttagctctatttttaactttcagaggtgtctccatataggtttccataaagaccatgctaatttactctttttttttttttttttttttttttttgagacagagtctcactctgttgcctaggctggagggcagtcatggaatctaggctcactgcaacctccgcctctagggttccagcaattctactgcctctgcctcatgagtagctaagattacaggcgcccaccaccacgctcggctaatttttgtatttttactagaagcagggttttaccatgttgtccagcctggtctagaactactgacctcaggtgatctgcccgccttaacctcacaaagtgctgggattacagtcgtgagccactgcgcagggcctaatttacgttttaccaacagtgtacaagagtttctttttttctacatcctctccaccayttgttatcttttgtctttttggtaatagccattccaacaggtgcaaagtgatatttcattgtgacttcaatttccctggtggctagagaggttgatcatttttcatatacatattctctgtatgtcttcttttgaaaagtgtttattctggtcctttgcttatttctaaatcagtttattttcyttctattgaattgtttgtgttctttgtattttgcatattaattctttatcagatgtatggtttgcaaatcttctctaccatactgttgattatctctttaatcttttgattgtttctttgactgtgtaaaagctttttagtttgatgtaatttcatttgcatattttagcttttgtttcctgtccttttctgtcatatccaaaaatcactgtctagaccaatgttatgaagctgttcccctctgttttcttctagtagtttcacagttttggttcttacatttacatatttaactcattttgagtttatttttgtatatgtttagagatttttattcttctgcatgtggttttacaattttcccaatatcatttattgaagaatttgttctttcccagttgtgtgttcatgaaacctttgttgaaaagtcaaattaatgtaaataattgggtttatttctgggttttctgtcctgttcatttgctctctgtttctatttttatgcaactattgtgctattttgatgactgtagtactttgtagtctattttgaactcagatagtgcgatgcctgcagctttgttccctttactcaaaattgctttgcctattcagggtttgtttttttktgtgtgattccatataaattttaggatttgtttctatttttgtaaaagctgccattagaattttgataggaattgcattgtatctttagatttctttgggtattagggacattttaataatagtaattttccagtccatcaactcaaaatacatttctacttatttttgtcttcttcagttttccctatcaatattttatagttttgagatttgttattattgctgwtatttttgagacaggatctcattctgtagccaagactggagtatagtgtcacaattatagctcactataatctcaaattcctgggcttaagcaatcctcctacctcagacttccaagaagcaaggactatagacacatgctactatggccagccaactttttaaatttcttgtagagacatagtctcaccatgttgatygggttgaagttttatacttttacgtgtacttgttttttacctactcggttaaattgatttctaagtatttttgcagcaattttaaatggaaatttatttattttttaaagatggtttattgttatacagaaacactacagatttttgtatgttgattttttttatcctgcaattttcttgaatctgtttatttgttctaaaagatttttggtggatcctttagggttttccgtatataagaccatttcatctttaaacaggcacaattaaacttcttcctttccaattttgatgccttttatttctttttgttggcgaattgctctggtcagaactacgttgaatggaagtggtaaatgtgaatatctttgtcttcttcctgatcttagagaaagggttttcaacttttcaccattgagtatgatgttagctgtgtgtttgtcatatgtgactttttttgttaaaaactcttcaattttattgcttattatatttcttcacatatcatttattcagtcaacactatattagtttactgagcacacaaataaataaaacagaagcccagaactcaggtagtttggatatcccacacactaatctgtgtactgtttgcaaatcacactgtgttgcaacatctgtacctgatgttgcaagactaacatttttgctacctcttctcagaagcctttgtgatctcacctgttggaatgcactaatgttttctgagccccttaaatatcttgtctacattcttttaagaagctcttcaccaactgtcaggtaatgtagtttgatgaattaagaatgggggctctggattctgaacccctagatttcaattcttgttcccagttactatatactcggtgttcttttacattatttgagtcaattacttattatcttccattttccatataagagaggttaatatatgttttatatggaatttttgtgaaatttcagtaatgcacttggcatgatgagggctcaatgaatattaactattttaactgaaccatatcatgattaactatatagactatggtgaaaaaaacaagatttgaatcctaattcatgtgatgtgacataagttattatttaaatggtgaatataaaatagggaatataataactaccccactggcttattgtgagggtccagtatattaacatttgtaaaacctttggtacagtgatatgtaaatgataatgatgattataataatgatttaaattgttttatatgcattcattttttatttataataagtacatgggagatattaccctttactaagttaatttatattatgtaacttttttcctggtttgtaatgtctaatgtttttctcataatagctgcccaataagcacgtatgaaaatattaattcaagataacccagacaatgaggctggtgcttctgtgccaaagcttttgtgcaatgtcctgacatgatttctttagatgtcattttstgtcagcactatccttacayctacatggattgtataattatctttgtagcattgattgagaattgataagatatccagcatttctgtgtacaatctgccgaaatcatatctgttgtattgaaacaaaggatgtattactttggtatctatatttccttataaatattcaaattactctaaggagtaatacattaacatggtgtcaaattaaactaatccaccacactggaagattaggaatcaggttactttcaattttaaattttcattgagaacaagatttgaaagaattataaatatggatgcactcatccatttattctttwtgtatttagcaagcatattaagtacttttaaacattttgaatacaaagatgtgggtataggatgtaagttaaaaaaatgcaaattcaaagatatagttctttcaccaagaaaactaaatacagaaaagagtaaaaatcatataggaagtaaaaatctagtaggaagaatttatattctagacaagagcattgactttcccgggaatatatattttaggcagatcattatcactatgggccgtgaaccagtaaaagagaaaaatgaatacagtggatgaccaggaagtttgcattaggtccaatgccacagaaggaagttgagaagctaaaagaaaagaaaagaaaaaagaacaaaaaagaaaataaaaagtatttagtggcaataaattgttaaacaacctggtaggaatatgatgaatgacagaactctataggtacaagaagacagatggtgaagtaggacatactttcagaagtatttcacattatagaactatatctaaagtgagggtgaaactctttaagctgtgcccatagttaaaggaatctttctatttctaacagaaggcaaccacagaaaaaagccacttaaggtgttggaatccctgggcaaagatttcctcactggtgttttggataacttrrtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaaggtaagactggattttttacaatgaatgtctcaattttccctaaatctgtttaactccaaggcctaagcagtgtcttctgtgattcccctatctttcccttcctaaactatcattttcactaaacctatctttgtccttttagagaccacttcccttttgtggggtggaatccagtttacaatcagctaaaaggctgagtccttgtgttcagactgtgtacaaaaatagttaatagttcacaccttgtagtaagggacacatagaactaaacctagattctgccacctgtgacctatgtgacatcctgtaagttgcttaacttccctagatccttagttattagtcttaccatctgtgaaatgaagacaattccagtactttctcacaagatcgtctaagcctagaaacattataatgacaggcaccacacgccaacaactctcaagatattagctctcatccggaactctctcctctgaactccaggatcatttagctctagcaacatattcaacaggtctacttgagtgttttgctggcatcacaatacaaatacagctaaaatatacactttgttccccagaacaaaactgttgcatttttattcccttttcatctcagtagaccgaaacaacatctaccaagtttctcccaccagaatgcaactggtttcttcaccaattaataacagtaatcagtagttttcttggcacatagcagatgcctaaataatgtaggatgagtaaataaataaagtatatgcattcaataaatactagttttcataattattatgtggatgctatgaactagacttttccagtgcttacttacttctgcgaattacaaaatatgataaggagaatctccataaaatgtctaaaattttaaaacttctttttggaacttttgacccagattgaattacgtattattaaaggttaaatattctcatattgaagttcaccagagacagactcaataccccccagaatttaagctgaaatcttgagccatgaagtattacagattaccaataatgataaatagtgataaacaaaaggaaatataaattgttgagacctcactatatcaaatgagctttttcaatcagcactcctctatgaagaaggggtgttcctaccaacagggagcacatgatagtatgatagttgtccaagattataagaaggtagcattctcattaatatttaaactggtccctttgcaggtttttagttttttctcaaacctggatggcatggaaacaatctccattttcaaaaagtcagtgatagtgcaactaatgggaattagaatagaagtaatagaggcttcagaatggttttagcaaacccagatatcacaatgagcattcaagtctaaactgaagtaatctatctgattagcagaggctgtggcaggaataaggcagcggcaacccctcacaggaggggtctagtgtctccctgggctctatctgcagttggagtctccagagcaatcccaggaaactttaggtacactgccagtgtacctagagtgtatccagctctctttgggcagcagtctgcagtataatatgtactatcttctaatgaaatgatttgctttcatgctaattttattattggatgtaagatagaaattctatctaatttctaattttacctgaaaacactgtatctcacacacacacataatgatcattaggagatgactaagttatgaagttctctaaacctgtaagtgaagtggaaacaggaaactttggattagaaaacataccctctgaccagggaatatccaggatccagcatgtcttcacattggcagaattttctgaaataggaccgaaggtcatatatcactgtgtaatctatgaaaagagatgctcagaaggtttgatattcatacacactcttacaacttgttacatctccagagctcagactggctggctttacaaatagctggctttacaatttgcacagggataattgaagttcatttcttctagaatcattaaaaattaacagtaaagttgctaaaaaaataatgccttgaaagtacaagattcaatattctgtgctttggtgtatgtatgtatttatctgtatgtgtagtggggattaggaggggacgattactccaaaataggattttgttccatcctgtatgggataactattaagcatttggcttgtggctaaaaatacatgttaaaataatactttttgtatgttatgttaaataaatgttattagaattaattttacctgtttaattttactttttacatgtgatagtagaaattaaatattggacatggaacacacattaaatttgtagtagatagtgttctgacaactatttactcagtatactcttgcacagacacaatagaaagtccacacagataaatgagtatcctggagtaaaacctttggaaaaatcaaattcttttgacggtataaggaaaggccaaatttaaccccaacatcattgacatgttttccccagaatgatcagaatatatgattacatgtttgggtggatctgcttttctatcttttccagtaacaatacatctcctgatgtagaatactagatatgagatacaactaaaacccctatatgtgaagaaatcttcccaggacgtcttctctctcgatcttcttaggtgataaattgggtcacagaggcagaaatcacaatttatgttctgcaatatcctgcagctcatccgaatatggaggctggaccacctgagtcaggagaatctacagatgccctcaagctttgtcctcatgaagaattcctgagactatgtaaagaaagagctgaagaggtgctatgctatctatatgaaatagaaaaaaaagaagagatatcattgctttccttcagtgcaccatttcttacagcactaaatgattgggggtggggatgacagtaaccattttcaataatgcttttactaagggaaagattatgtgacttcacaatgataccaatcctttctcaatccatgatgcagatcattttatcatgagttgaaagaaaattggtatttctattgctcctgtatttattcttgtaattatttggattttatggcaattgtagcattagccatggaataaacatatttggaggataatatagctgacttgtaattggttgcactctacttgaaaagtctagacatgaaggatacttgggaaatataattaaagcttgaaaaacattataaatttatgtgttaaaaatagtaacaaaatagctatgcttccraaggcaaagacttttgctgtattcatttttcactggagtcaacgacaacatctcgttttgtatgaaatttgacctgaactttgaatgctaagaaagattggagtaggtgaagaagaaaagggagaagaaaaggcataggaattayctagtttcctcaagattcttaataacaatttcagatatgtccggttctttccctgggttcttgagagagagaaagtcagtgtcttttgatacaagttagagcagagaggagctgcatgaagacttgaaaaagcaacactgataggcataaggaggctgaaaggagacttgagtaaattaaatttattgcatctccatatcctgcagatctatccaataaaggagagaaacaaccgcacacgcctggctctcatcatatgcaatacagagtttgaccatctgcctccgaggaatggagctgactttgacatcacagggatgaagragctacttgagggtctggactatagtgtagatgtagaagagaatctgacagccagggtaagaatccctcagccrccacaaacacatacatattcaagacacatccttctaataactacctagcttcaaagagctcaacaaggtttaacaacctttgggtgtgtgtgtgtgtgtgtgtgtgtgtgtgtgtgtatacaaaataagagtactagactggtaaatctatgtctctttggtcctccaaatatcctcaattctggaaaactagactaaacatgattgacacgtgttttcacatttcttattgaattccaaaatcatgtgattgggatgcagccccgagaatccccagaaaattgtagagtaatgaatgttaaatggcagtatacttataaaacaaatattgaatcctaaacttggtgctaagagctattcctaacgttgggaataggtctgtaaatgagacaggaagttcccagccagcattcatctaggttacagtagagagaaacagtgaaattgtaagaaaaaagacaacttcaagcaccaggtgtgcatatgtgtgtctacaaaacagcgacaagacagccaaaagtaagtaaaaagaaaataaaaaggaaatatgagacagaattgtagggtggggagcaacgtttttgggttggttggagatggctctggaaagacatgaatgcagcgccttcaaagtaggagacgccacctgtgaaagagctgagctgaaaatgaacctggcacatgagaagcacaaagagaagaccagtgtgactagaggttgaaggagaaggaacatagtatgagggtggtgtatggtcaggccagaagtttgattctattctaagcatagtgggatggattttacaaagaacatggtgtgttgcatttataacacatgacttgctaggtaaggagatagaagattgagatggaaaagaaaaagtaacatgagtaacacatagcaatatacaatatactaagaagacagtatgtcagcaggaagagaaaatgggaatccacggccccataaagaaggaaaaataaaaccattaaacagctgtcatgactgagtaagcactaagtgaagcaccacgacctggatgttacatatgtttcttgtttcgctcatggtaaatctaggagtcccctttaattgtgatgcttctctgactgaagttagacattgctcttttacaggatatggagtcagcgctgagggcatttgctaccagaccagagcacaagtcctctgacagcacattcttggtmctcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtggtgagtgctgagactgaacatctaacagttatgaaggtgtatgcagaggattgtgatgtttggtttatatttaggggcaacattcttaaacctcatccagtgtaaagaaagtacattgaattctaaagaaactctacctaagggtctggtataacaagaaattgtctcatcaaaattagtggagaaatttctgttcaattttatccacagtaagtggtgaaggagatcatcagaatccctaaatcaaagttaaacagaaatactcaaactttggaatggaatcattttcatgatagcttgatttgtaaatgttttacagaaattttgacattgtgtggtttgagaagaatttcatttgaaactggggccattatgtaaaacagcatccctttttcttataattattgagggggaaattagtaaagagatcaggggactgtagaatgttgcagtgccactttgctccaaagattcaattgcctcatggctggctgaggatggtggctcatgcctataatcccaacactttgggaggccaagacaggaggatggcttgaggccaggaatttgagaccaattgtctgatagctcttgggagctatttttcaaaagaaaacagattttttttctagaaaatggtaaattcaagatgatttcactatcagtaggcacattgttgaatgacactggagagaaagaaaagtggtgtgtgtgtgtgtgtgtgtgtgkstgtttctctgtgtgtgtttgtatgtgtgtgggtctgtatgtatgaaactagtaagaatgaacattcaaaaagaacaaggtgggcaactgtgacagccattctgtgggaggcacagcagtgtgcagaaagttaatgtctccatagcaaaccgtggggaactgtgggtcagagactctccagcatccttggaagtggcctcttcacagtcatctgakaacctrgaggaagatgctgtttacaagacccacgtggagaaggacttcattgctttctgctcttcaacgccacgtatgtatctttcagtggcagtaagggatttgtgggcctgaggccatctttgaatgaatctagaaaatcaagaatccctatgaaacaatgatctgatagaatgttgtgtgctctccacatattttacatgatcttatgtgtgccgtgagaacagattcctaaagcaacccgatacatggaaacccattcaccactcaccatttaaacagatgatgaattctgttttttttattaagcccatttaacattttacatagtgtttttatggattccaggaatggcttctctttctcaaatgatcaacttcaagtcttctttccatatttcacatctgattatacaatgagcagtgccattgcatgccctgctagaactgtggataccctttaaaacaagtagaaaatgatagggtggggctgattaggtctaatctcagggaacactggttagtatttcatgtctaggtaattatcttaaggagcgtacatttaactgtttttgatttgtatatttttaaatcttattttttaaaaccactttattgaggtatgattgacatacataatgttacatatttaatgtatacaacttaatgagtttggagatttctatgtactcctgaaatcatcaccactatctatgccataaacatatctctcttctccaaaagattcttacacttctctgtttattattatcatcattccgtgactgcgtgtgagaagtatacttagcataaaatctactctcttaacaaatttcaagtacataacacaatgttggttactactggcaccaycctgtacaatagatttttatcacttttttcagcttctatcactgaaacttgtcatgtgttcatctatttctattatacggtgaaagacagtgtggcataatctgcaaacaactttggagcctggtggcaattttttgttgcttactcactgtgtgaacatggggaagytccttcatctttctgtgcttctatttcttcctctgtaaagtgggataattctagttatttctcaagcccctataaaagctgagagaatgaacatgagttttgtagtagaaagccaatcccaagaatcaaaatttcttcaatacacaatctcttgcaatgcttaccaactgcaacttttgatcaccttttgctaggttttctgtttacgttctgtggaaagtaggtaaatgtcaggttgtaagtgcttcctacaaatctgtaaagataattcccaagctatgcttttctttttaaaaacattctcaaaacaaaaatatgaacaaaaacatagtgaaagtcatagcccaaggcatacccatctgtatcattatagacaacgtgtcctggagagacagcacaatgggctctatcttcatcacacaactcatcacatgcttccagaaatattcttggtgctgccacctagaggaagtatttcggaaggtaagtgtctcttttctagttactcatttatttcttcaggaagaatttgtcatgattcactttttacttcacaatgacaatttttgtcagggaagtgaaagtagagaggtacccagtttctgtcattcagttgtttaaaatatggctaaggaaaagacaattccaatatatcccagcagaagatcaaagtaaaataaaataatatcaaccataagctttatgttatggagcgtaagttcttaagttttagagaaggaaaaatattttgaaataatttttatttcttaatttattaaatgaataaaatctggrtggtctgctaggtcatggatttcctcctggtgacagaggggtaaatgaggcctacatgacgtaatcctatctaggactcacattttcgtgggagatatggatactgaaaatgtgggttaacaaacaaatatgtgcttacagattgtgataggatccataaagacatgtgagagggaacaaaaaagaagtcattctttcaataaaaaagtgcagaaggaaaggtttgctacttcttgcccaacttgggacattccttattcccactacttcctatgttatttttctccatagctcgtacatctacccactcagcaaatattaatagtttatttatgtgtctggttttttacttgtatttactcactaacatgcaaacttcgtgatggcagggatttgctcagcaattcaacaaacctggcacgtagcagatattcaattaataattattgaataaatacatgcataaatacacagataaatgcaccctcttgtttaaagagaaaatgggattggtattaacacagaatagtataattattaataaagtaaaaattgtagagaacagtaaaactcctgcgggaaaagaaagatacacctctggcgtttatagaagaaagccatccagaaccagcacagtcactcattcctgtaatcccagcactctgggagtccgaaggagggtggagtggcttgaacccaggaatttgaggccaacctgggcaacatggcaaaacccatctctacaaaaaatacaaaaattagccgggcatattgactggaacctgtaatccgagctacctgagagctgagatgggagaatcgcttgagctcaggaagcggaggttgcaatgagctgagatttcaccactaccctctagcctggatgacagagtaagaccctgtcttaaaaaaagaaaaaaaaagaaaagtagtgaaataagaagaaggaggaggagaaggaggaggaaatgcagcataaattgagacagagctcctgtgaatagagatctgggaagttaaatcttttaaatcttcttggataagtgggagttagacattgtactttcaaggatgttcatagaaaaaggaactaaaaattctggatttaggataagtagacttaccaattagttgatgcaaaaaaactacaagatcagcttggtggtggagatatgaaagttgttcagtgtttgggtcttaaagataagatactggggctgggcayggtggctcacgcctgtaatcccagcactttgggaggcagaggcaggaggatcatgaggtcaggagtttgagaccagcctggacaacatagtgaaaccacgtctctactaaaaatacaaaaaaccaattagctaggcgtggtggtgggcacctgtaacctcagctacttgggaggctgaggcaggagaattgcttgaactctggaggcggaggttgcagtgagccgaggttgcaccattgcactccagcctagrcaacagtgcaagactccatcttaaaaaaaaaaaaaaagaaagataagatactgggattaaattctccttcaattgaggaatcagccttggtgagtgttgaaagtacagagtccttccttatctggttttcatgaatagttttcaagggataacttattgtcagatctgtaggtcagaaatggaaaatagaggaaatgaatgttgaaagaccttggattagacatgaggtgtttattttgatgtaaagcgtacagtctgacatggagtggcaattctaagaggtagggtacaatgttgaggagttagaatgcccatgggcttggttctatgaaacctgcaagctcacttcattccaggtgttgtctggtacatggtgaaagatgctttctgagacttgaaaagagtcgtatctcatctacagcctattttctttttcaggtacagcaatcatttgaaactccaagggccaaagctcaaatgcccaccatagaacgactgtccatgacaagatatttctacctctttcctggcaattgaaaatggttaagtattgagagttgttggtggtatgtgaaataaataagagagtgatattggtggttaagttcaatgacaaatgacagctgagtacttggatggtcaaattggtgtttttgttgatatagtctggtgattatctgctacttctttccgacttacatgtatttggattcctccaactctacaattaatcaggcaatcaatcaatcaatcaaggaggtaaggaaaaccgcagcagaatgtgatgatgaaaaaccaaggatagtaattattaaaatagaaacatgctcatgcttccattactatttatattcatttatctctcatagtctttctcttttattcccctttcttacacacacacacacacacacacacacagagagagagagagagagagagacactaagtagccaaacattgcatcaaaccctaaacaaaacagagtaaacaaaggagctaactctggagaaagcagcattttgatcctctgagtgaggatgtcacagcaaataccacattactgacatccagataccattaccagatggtacagaatacatcctacactgtagagtttgtgttgatccaggctctggttctcagactgttctcacaatgcagatcaccaatcactcagggttggcttttgaatcttcaatcacagtccagaagttccttcaagctcccatgtaacttttgttattattttgaccaaaatattatagaatgggtacattgagtctggactaaatgatkactttcttcactcataatagctttatttaacactagactataagactattatcaatctccctctaagatacatacttaaaattatattttatagtgaaatgtataaagttgttctcaatacttccaacatttaccacataatttttactcttggtttctgacacttcagtcacaatattgcatcatttcagcataacagctttcagtgcctaatccatccagtggggctgcatttggacattgaattgtttgttgactaatatttgccaacactaactgtgcaccaggttttgttctagatgcttggaatatgccaattaacaacgtaaatagatttcttacactctgaaagcttatattctagtgagtagaaacagactctgaagacataaagtggtaaatatatcacaggccrgagagcaaaaaaagrtaaaaggaaaaataaaggaagacaaaggaaaacacagaatgatggatgctgtactcctatagatatttcactcaaaagcttttcttgaaataatgaaatcagaacaaagaatggacagagttggggagtgaataatgtggttcttatgcaggaaaagtgttccagcacagaatacagccagtgcaaatgccctgggatagcaatgcactaaacatgtttaaagaactgcaatgagacagtgtgaccaaaagagaacgtgagtggagaaaatggcagagacaaattaggagaagcagtgagaagccagatcgcgtggttctatgttatcacatggtaaacctttaaaaattattatctgagygagacaggaagcctttctagtgctttagaaaaaagaartaatatgctttaaattaggttttacaaagatcacattttggtgaatagactaagatgtcacagatggaagtcaagggaagtggcaagagcacatggaagaggatgcaagaagaatcatgatgagggatgggatgaaggcagcaaggggtaaccatcttgaccttctgttttttctctcccctgcaggaagccacaagcagcccagccctccttaatcaacttcaaggagcaccttcattagtacagcttgcatatttaacattttgtatttcaataaaagtgaagacaaacgaactgtgtctttttctaatagagaatataatctcaatgaaaatggtgggtgagtggaaatgaagtggaggaagctaactggattttcgagctttatggctcatgaaatatctatacttggctgatgaagaaaactgactgatttatccccaacaataggatgaaagatgttgccgaaaactatagtgagatactgcctcatacccatttgaatgactcccaccaaaaaaagccccaaaaaacagaaaataacaagggtttgaagggatgtagaataattggaatcctgtgctctattggtgagaatttcaaatggtacagccaccttggaaaacagtatggtattgcctcataaaattagaagtagacttaccatatgctccagaaactccacctatgggtacataactaaagtaattgaaagcagggtctcaaagatatatttatacacccacatttatagcagcattgttcacaatatctaaaatgtggaactatctgataactgataaatggataagcaaaatgtggtgtatacacataatggaattttattcagcctttaacgagaaggaagttctgacatttgttacaatatggatgaaccttgacattatgctatgtgaaataaggcagcaatagaaaaacacatactgcatgatttcacttacatgaggtacctagggtataaaattcatagagacagaatgtagaatggtgatggccagggactgwggggaggaggaaatggggagttattagttaatgatatagaatttgagctttgccagacaaagaggaattctgaaggtaaatgggggtgacacttatatgactttatgaatggatttagtatcaaacactacatttaaaaatgttaagatggtcaattttgtggtatgtatttttaccacaataagacattggggacaaaagggataactggagatgagaaaagatggagtaaattgcacccgggaaactctgatcaacttacacagaagagaattaagctactgtgcaaaactgatgaaagaagaaatgagagtaaagtatattacttattatttcaaaatgaatcaaggaaataatcggaaatctcaccaccatcaaatattatgtagaacaagagagagatctggcagtgtgaatgagctatatttcatttttcatataagacagttaaccacttttctactgtgataaatcttagcaaaactaggggtccaagcatatacgtctttttctcccccatatggttcatcaaactgagttaggcaactttactttcacacacctgtgatgcctcaggagccaccttgacatacacatgtcaagaaaattattaattctatatctgatgatgtcttgattccactttcaccatacaaagcagagaccaaaggtgtcactcacagatactcatctattctgccttagttgttaaataactgtctagtcattcatgtgaagaccctcttgtttcccaagtgatgtgcatggtttcaggtgacttacatctttaacaggacttattatcaatcagtcaagcatgtggaaaaaaaattcagtaaagagtatccaacacattggggtaaagttctccagagaaggtgaggctttttcaatgtccatctttctttaggttcactatttggaagttaccttaacacagaagactctcaagcagtgtattctcccttcctaggtaacagtgcttctaaaaaaatagcattgtttgaatcccatcttccttggtattaattacataggataaacccagggtgggagggctatgggtaattctcatagattattaaatctatgagagtatatataatagagtaacctatgagtgtatatataatatatatacactgaattagtaatcattgaattcctctatagtacaaaacattttccttaaactgtgagcaataatagagaattcagtggaaaatgatctatgctggagtacattagaatttgactccacatagaaaaggtctgcaatgttgggatcattcagcagtccaatttgcccagacatcaagtatttatagaatagtggaagcagagggcagagaagcagaaaaacaagcaaggcacatttgggtcctaccttaaagtgggttttacctagaagtatgaagtacataaaacagaatatatctgaataattgtaaatgtaagctttggtgtaagatccttgcttttatagactgacacagccacttagtacttggtaaattaatttcatttatttagcttctctgggctttctttgagttccttactaatagatgtgaatataaatatcattgttctaaggatgtaatgagttaatataggcaaaatatttagcatagtccagaataaagaaggtgttaaacaactgctatcattaaagatatttctactttgtaacttaactcagttaacttccttatcaaggtttaaataaaagtcatttgaatcttttcattcaccatgtttggcagtttcctgggacttgcattctcttggtcacctatggcctgaaggtcttggctctgctcatatagttaaattacatattgtctataatgagatgccctccctcaggagacagactggttccacattgtgctgaccatatcctaaggtagaattaactttttccatgatcaaaaacgatgataccacacaaaagacccaaacatttctagcttcagtgtaattagtagactttaatattagatggaattgttctttaaaatcatttgatcccagccttctgcatgacttttgcctctgtctttgcagccctttgtcggtccactgttttctcaacatcagtcttgctggtttctgtctctttcttttctttcactactttttactcctcctttccagatgactatcagaaactccaatttagttatctatgactccaatattacacctagctccacattccactgtgtaaattccaatcacatcatggtgctctcctgaagaaaaataaccatctacttccttaatttcacaaaatatttgcagagacacctgtctccatctcatctcttacctactttatttaactggaacaagacttagttaaaaaccttcctttaattgtgatagacatggttctatatagaattttaatttattattcaatatattttattaccattaccattgactaaaagattggattaaagaaagtgtccatggttatatacagagctatttccattatttttccctcacaccttcctttgtataatatttatatgtcttcattacttctgtgtcaactatgtaataaattaattcttcttcaatatttctgttgtccataagaaatttttcctccaatattatgtatttcttccgtaatcaaacctttctagattttcacttttgttctgttgtaccatttttgtatttagttaaaattttgtgtaaatatttttggtgaatattgtttaattctaattaaaattatttttgaagttgataaattgagaagctattaatagaattatactgtagagattgagtattacatatcctatattattccatacacttgtgatgcttcagatatcttttgtgtatgaattattatcctcccctttatagatgaggcaattgcatttcagagctcatgattaacttaaatcagttagtaaatatcactcttgaaatgcacatataggtatgtcttttccatggaccagtcactttcctctgccccattttacctttctcttactctctactaaattgatgacttcttgaactcagggaatacgctactctaatatctgcaccacatacagcacacttgtcaaatatcagtaacaatatactcactgaattttgaatatattcactagaaatataatccagtgtatagaaaacaaagtgaattccattgcatgccttagctgacttagaaaaaaaacaatatttcttctttttcttcaggcaagagccagtcttgggatttgtgaggtggtttattcacagatgtttcttgccaacatttcacaagtggctttttactctgacacttatcaaacattggcaagaatatcccttatccagtgaaaaggaggatattttctgaaaggtgggctaaagatgcttctaccacttgactaccctggatgctagactattgcagttggaaacatagaaagcagatctggcctgccctgaagagatggaatgaatggactcgaatttacctgtatccttcatggctatcagatccagagcagattttaaaaaccccggggagggtcattcaatgcttagatatgcatgttgctatgcttgttgcaggtgaaagtacttttttatttttgttattcatttcgctgtatttgtcgcagtttttctggctaaagattctacatcagagcaaaggtctacagactttctctttttaggtctgattttcatttgagcttccagattatagggcacagatgctcatcactgagtgacattgacaagatgtttttatctcttcctaggacattaaaagaagtaggctgtatgaatgcctgtgggccgatgtgtatgtgtgttgcggggttgaagaggttggagaggagtactgaaactccattctggtcaaggtatctagccctaaatgtggttattcctcatccaaaaattcaaaatccaaaattctcccaaacctaaattttttcccattacctcccacatttttaaattgaaaagttacattaagaggtacatgtgcacttttgtgacctaagaatattgcatgatgctggggttttggtgacaattggtcctgtcatccaagtcgtgagcatagtacacaataggtagtttttcaacccttgtctttctatctccttccttcctctagtagaacccagtgtccattgtttcccatctttctatccacgtgtacctagcgtttagctcccacttataaatgagaatacacagtatttggttttctgtttctgagtaaatttgcttaggataatgtcctccagaagcattcatgccactccaaaggatatgatttcgttctttttataactgtgtagtattccatgtcgtatatgcaccacattttcttatccaatccacccttaatgacacctagattgattcactgtctttgctattatgaatagtgctgtgatgaatatatgagtgcatgtgtctttttgaaagaatgagttattttcttttggatatatgttccataagaggattcctagattaaatgatagtccagtttgtttttactctctttctttaattttcaattttaggtatatatttatgtgtatacacataacatatttatgggttacatgagatatgttgatacaggcatgcaatacataataattacattgtgaaaagtgaggcatccatacctcaagtatttctcttttgtattacaaataattcagttatgctcttttagttatttttaaatgtacaattaaattattattgactttagtcaccctgttttgctagaaaatactaggtcttaatccttctttttaacagtttttgggggaaataaccctccccaatttccctgcaccccacagtatgcttcctagcctctggtaaccattcttcttctctatatttcactgagttcaattattttaattttcagttcctacaaataagtgagaacacgtgatcttagtccttcggtgcctcacatattttacttaacctaatgacttctagttctatccatgttgttgccaatgactgaatctcattttttttatggctgaatagtattccactatgaataagtaccacattttctttattcatttatctgttcatgaacacttagttggcttccaaatcttggctattgtgaatagtgctgcaatattcataggaatgcagatatctctttgatatactgatttcctttcttttgagtgtatgcccagcagtggaattgctagatcacatggcagctt

SEQ ID NO: 10747 - DNA, 93784 bp, Homo sapiens
  misc_feature (1)...(93784): n = A,T,C or G, or insertion/deletion polymorphism (see Tables 1-2)
cactgaggagtacacagggctcccttgctgattaagtttatcttatttttaagacccctagcaagagacttaaggttcgaacactcatgacccaatgctgcaataattatgtatctatctgtggtttgtttttgtttttgagacagggcctcactctgttgccaaggctagagtgcagtggcacaatctcagctcactgcaacctccgcctcccaggctccagtgatccttccacctcagactcctgagtagctgagactataggcatgcgccaccattcccagctaatttcaaaatttttttgtagagacaaggtctcactatattgccctggctggtctcaaagtcctggactcaagcgatccttggcctcccaaagtgctggaattacaggtatgagccaccatgcctgctcaattatgtgtctatcttaaaagtaaataaataaaaaatgtgatcaaagcttgcaattttcctatccttcagaaaataaatgttccttagcacctaatacatgggtatagagtgaatatagtaaataataaaatgctgaaagcatccagtaatgatttaacatgggtatctcataacatcacactgtatttcttaaatatacataataaaatttattaaaaattaaaattaagaaattgaattggatgtatatagacttattataacacaagtactgacacactacattgaggacttcagaaataaacgtctgtgcaattcttgcccttttctagcactgtttggaccactaattcctgcctagaatataaggtaaaaatctgcgacctcacagatttgtttcagggttagtttacatcaaaatgtacaaaagtcccctccttctatccaagaggcttcccaatacacccaacactgagccgctggggtggctgaataagacagaaatcctttaaaatgaccccaaatgtgatctgaacctaaaaattataggcactaaaaagttacaaatcagtggggccatttgaggagacaaactagaaatcttgctggtcaagtgttgcaggttgggttcacctagaaacagaccctgaacaagtgatttttttttttttttgagacagagtcgctctgttgcccaggctggagtgcagtggcgtgatctcggctcactgcaacctctgcctcccgggttcaagccattctcctgcctcagcctcccgagtagctgggattacaggtgcccgccaccatgcccggctaattttttgtattttagtagagacagggtttcaccgtgttgcccaggctggtctcaaactcctgagctcaggcaatctgcccacctcggcctcccaaagtgctgggattacaggtgtgagccaccgcgcctggcctgatttttttaagtgctctcctgggagaaagtagtaaagagggcagggaagtagacatgaaagggcaggcagctaaggaaggatgcctttgcaggtgaagtcccagacttggcctaatccaacagggactctgggggcatcaatcgcactgcagactttgtcctgcttcttgcactagctactggctgtctggccggatgtgaatttcaggcacttctggctctccatactgggcaggtagttccagcgcacagaggtgatagcttgagtagcaaatcaggcggaagctgggagatgagtgcccagagctagcaaaaaggtctgggcaggcactgacagcaccactgcagagtcgctagatttttcagttaattctgaaagtacctcaactctgtactgtgcatgcagaccatagtggctgaggttccctatctgtcagccatggagaggtcactctctggagtagggaggaactactctctgggtgatagaaatattcccacacagaacccagctcacaggctggatgtgccctctttctcctctctgctgcctaactcaggaaataactccaaagacctgggtcagttcagatggggactgaagaaagcacatgtgaggatacgcctataaggtaatatcttcaggaaccctctcctgagcccagggcctcctcagcatttcttggaggctgccaggaagcaactatcctccatgcatctaaatgccgggggagcaaatctcagctacagaaatgacttattcaagggcagtatggcagcgtgggatgatctgctcatccgagaaaactgcctcgatgggaattaacacagggaggaggaaacttccaaagccttccgctgggaaatctttgcctttaatgggaggcaggatgggggtgggggaagaacgaggcggcatgtggtaaccagacgtcacagcgtttcacttttcaccatcaacttccaggacgcacgcaggtgtgtctggcgtggccttcgtccctgccggggatcctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcaggtgggtagcaaccgcctccaccgccgcgtcccgcgtcgccatggagacgcggccggtcccgcctccctcccagcccggaagatggggagcggggacaggcgacgcggacgaagcgggaggagccactggcagcctttgcgtactgtcatagcaacgggaagggcacctcgaccaatcaccgcccgggaatacggaggggcggggcggaagggacgaggtggagccagtggcagcactctggtgccgtcatagcaacgaggggccgcttcggccaatcactgctcgggaagcgagggggcggggactgggcagggcctgagcgggttctgtgcctggctgcccaccggctctctgacctggacctcgccgtcgctggcccctgaaatccatcacttttgtcggctgttctgtgacgccacaacgaggagccacctgggtactgggccctcaagaggaaggacgcgggaaacgcgtccgggccaactctcgagagggtttcacccctgcccagtgcgggcactgcccgctcccttccgcccccaggcctcgcaggcccctccggggatgctgcccacccccacttacctttctaggctctgctgacccttcgggattcgcggctagctgtgatgtgtccgccaagatctcttctcttgtctgtaaacaacttcactctcaaggaggcagctctggcctctcagcaggtgcggcctacagtgatgtccgtccgggttttacatccttccccgacctcgacatgagtcccagccccctcgggcctctgactctcaggtgtcccctacgatcgccgtcctctcctctcgctcctggctcccctacactgtcacacacccacacaatcacagacgcacacgcatgtacacgtgcaggcttggaaatctgctttacctgacgcactccgcctgccgaaggcccctcacatctcccatttcctctgccatcatcccagactgcaaagctgtgttatttgttgttgctgcaggagctggggaggagtgactgaataactataggatttggtcttgatgggagaatcccagaagccaaatccacgcggtgaataagctgctgatcttccagagcacacatcccctagagattcttcccaatgctaatatgaaaggttacaaccataacccatcatcaggcccaaatatattacttactgaataaatacacaagttacaacaacacacgagattccaaaattatgtcgttttttagatgcaaagataaaaatgttgtaaacaccaaaatttaacagcttttcttatggggaaaagtggggagttagggataacagatgattattattttcttctctacatattggcagttacccagttactacaattaagcatgtcctatttttataataaaatgccagaagcattttaaatgttagaaatctagaatggtaacataagtatatgcaaataaatactcgttttttacatttaaaatgtcagaaatttagctttcaaatttgtcctaacaatgacagtaaccagtgtttactaagttctgacactgtgtgtgggcactgttttaagaattttatgagttatcttattaaatcctcactatcattcctccattgaacatctaaggaaagggagttatagggggttataaactaaaaataacctcctaagccccaccacagccaactgaatggacccctcttggccaagagggccccagaaaccttaaaaactgcgttctcagccatgatgggaagggaggtcgaacatgcctcactaatacccttgtgcagtttagacacaacaactaacaagcattaatgttaaaatagagatcataagactgacagaatggacgctgtggcagtaagataccaacttacaaacaggacctaaggccatgccaggcatgagttaagtcatgcatccctacacttaaaagaataaactatattttaactacctggagaaggtcttatgactcgtgttttacatcctgtacttgagcaaacaatcttactgtgaatctctcaaatcgtatcatgagttcctcagactgttgatgtactaattaatacgtaaactactgacactgaaaaggatactgatttgtttctgaatcatgacgtttcactgattgtcttgtgcatatgcagaaaacattttagcctgtatgttgtcatctgtagccaatgantgtaacctctatattgtccctccaatgaaaaaagacaactgcaatatgaggagtccccttcccattcctcaactttcttataaaagcactgcaacttgtaacagactttggaacacacccaactttgttggtgtgtcttccccattcaatcttcaaatttggctttcaataagcctttatcaatttccgcctcaacagccttaactttggtcgacagcagttaagatccttacccaagatcatacagctagtgggattcaaatcaagccagctgacccaagagcaactgttgcccatcactatactgcctcccagatctgtgatataaagaaataactatagttttctggcagtgactaaaccatctaccaagcagaggaccactagttcaaatgccttggattgcaaacaccagagagtggcttaagcaaaccacatggttaagcaaaccctgttctggatcacatcattagcagctagacgtctagctatagctattaaatcctaaggtttacaatttgatttctatcccatacgaattagccagggtcttccctcccaaatctttcagtcaatctatagtaatttcaccacactgtgggtttggcaattatccaaataattgacaccaaaggcaagaaggggtgaacaacaggatgggcctcccggcatctcctgcagcagcacctggactggattctaaattcctccttccagaaagaagctgcatcccagcccagatccagctgagagccacagctgccaagaggcagtcggagctctgggcacctctctgtgcacccaggaagccccaggaggacttcatcaagccaagtcgatgcctcactcagagccccaggatccctgactcctaaccccacagtgacctggaaatgcctggtgatgccagaagcagcgctttccaattctgaaggccctcaaaatgcttgttcagcccaccttcctcctttcctggggcgtgggagtggtggggagatgagaggcagaaagatgaggacatcatcaggaggtttttccttactggaaaatgagaggaaatcctctttcactacttaaaaatcaaaaggggctgtccatattcctctggcaggggtctcccatcatcccccgcgaggcattcccattatcccctgcggagctttcccatcatccacagaggcccttcccataacccccaagtgggaagttcgcgcaagtgcggctctgcagggaggagggagggccgaggggaaggccctcgagagagtggagggcaacagtggccacggttcctctgtacttcgtttcttccgtaagaaatgatcttcttgtccttcttaagtataaatggagcgatccatttccttttacccattaaccccttcaaaaagaagaaaaacagtcccaggctggccatggttgatctctgcaggggcgctggtcagggtgccttctgcttcctggtgggatggcctaggccggggaaactgttgaaaccaccctggggctgccttctgtattttccacaaccttccaggcccacctcccagctggaggccctgcagcttggcagttgycatggcgactgagtccctaagtgtgtctcttctgagctctcctggacagtgtggagaaaaggccttaagaactgaggggcttcagtaaaatgcaaacagattttttttttgtaggcactgttcagataaaaagcagggactttcaacaaaatgagttcaggtccatcttaactatagaactatgaggttgtttattagaataattgtactctggtaaatttaccaatttcatatatatgcatatttataaacaaacatattagagtatatagatagaaaaagttctatctacatgtagaatcgaaaactttttaaaatagtgttggtagtatcacacattgccatttagtggatagagacagacccgagattgsagccctagctccgtatacttctttctgaagtcagtctactcatctgtaaaatgggctgttgtgaggtcaaaattagatattcataatgagagtagcatagtgcctagcacaaagtaaagcacttagtaaatgggagctattactattaattgtactgctgttaatcttacaataggttaagcaccttttgtctatcagtatgtttgggggggaattttaactcaagtttatcttaatcgttttcagtcgtgtttttttcttgaaaagaatcaaactgccaaagatgattctgtcagttgtttgtgacaatcagaagttagtctgtgacgaacagattagttttaatgctcatattcattagcactaatatacataagggtggggagagactgaagcttctggaaatatatagacaggtagattcttaagcgtaagtaggtatttgaactgtttgtggattatgtctcataaaattggcacccagcaaggaggaaaatgccagatacacacacgcccatacctgaggtatgtaggtcaatggaaggctattgaaacacagttgtcaagagagaaatgtaaagtatttttcacccaggaagtgagattattcagtgatgcatcaaaaccagtagggaaaacagtttagtggacaccagtgtggagacgagatgtcagaaaattggatagactcgaatttcacgttgggtagcaactcaaggacatagctcagtgcttggcacatagtaagtgctcaaccaacacaggtttatcaaattaaatgttagatattattttgcaacagagctgtgctttatgcagcagtaggaaaagagaaaaattgacgtgaaattttttctttttcttgtttttttattcttaaatcacactccattttccgagggctctctcaggatatcagttgcttaactacgtctgagtgtcttctaggtcgagtactaggggattacaaggaaatgagaaagaaattacagacccattggggggcaaattctacattaatctacactgttaaaaaaatttaccagggccgggagcggtggctcacgcctgtaatcccagcactttgggaggccaaggtgggtggattgcctgagctcaggagttcaagaccagcttggccaacatggtgaaaccctgtctctactaaaaatacaaaaaattagctgggcatggtggcgggcgcctgtaatcccagccactcaggaggttgaggcaggagaatcgcttgaacccgggaggcagaggttgcagtgagccgagattgcaccattgcactctggcctgggcgacaagagacaagagtgaaactctatctcaaaaaacaaaaacaaaaacaaaactattatgccttctggctacatgttaatccttcattccaaagtggaggtcactctttcctactggtggatatgtaaggctggttctagttttgatgctgcagatagcctcactctaaccagcagttgtggtgggagatcctgtgctacatggggctgtacttttcaaggtctaagggtggatcagattttctagaaaagggacagggaaaaaggtggcatgctgaaccacgtgtccatgattttcccagaataaggctccccctacccaacttacaggaaggtcatgatcaaataagataacgaggatgaaatgatttggaagtgctatagaaatgtaacgtgtatatttagctcaggttttaaaatcttttaattatgtaacatttgatgcatgcaaaagaacacatattcacgtatgccagcaaagtaatacagtgaacacctgtgaacccctgcccaaagtaaatagatgaatgagtaaatgaaataaatattaacatctgaatgcatagatctttgtccacatctcaaattcagctctttggattgcagctttatagaattgagagattgctgagcctaaatacatgttgctgcattgcctccgagaatggccggacctatccccactctcaccaaaacagagtgtgggactcactgctccctcgcctactgtaagtcctatttttcttctttgctaatctgatggacaggcagtgtctcatagtgactttagtttgtattcatattttctcgattatttgagaagataagcatttttccccaaatgtttattcttcacctatgataacccttgttaattatttagattagttttttgcaggccactttcatatatctgtatatgttgttttctctttctgaaatgtgatgcccatgtttctctacctggtgaacaatttgtcaactttaatatcttaccagatgtaaccttcctagggatgctgtttctaactgctgccggccccttcttaccatctctctggttgtgcttctgacgcattccctacacaactggaacgtgtttccaggtcagcctccctaagcacctcccaaggcctccaccccacagtgtcgcacagaacttgacacataccagatgctccaattattaaatattacngagtacttttagaaaattgggaacatacaataaagtataatgaagaaaataaagaaaaccaataatctcacttcccaaagataataactactgccattttggtgtgaatcctttcatgcttttaaaatgcatatatatgtctatttaattgaaatcattctatttgtcacttacattatcacatgtcattatatggtgcacatgtcaaaaaaaatttccaaagtgttttaaagacaatagtatttcaccttaaggatataccaaaattattatgtcacaaatgttggataagagaatgaatgaaaatctttaatatgaagttgaacaaggtaaggggtattacttaaggaaattatactcctttttttttttttttttttgagacaaggtctggctctgtcatccaggctggagtgcagtggcatgatcacagctcactgcagcctagacctcccaggttcacgtgatcctcctgcctcagcctcccgagtacctgggaatacaggtgcctaccaccacacctggctgattttttgtattttttttgtagagacagggttttgccatgtcgcccaggctcaacaacatgtgratcaagagatccactcacctcagcctcccaaagtgctggaattacaggtgtgagccaccacacccagcctccattttgtttttaagaaaacaatgtgtcgggtgtcttttctcagtatgtcattcactcatgtttcttgggtgactaccagaagttcctcagctctgggtactgttgctgtcctcctctcgtggcgctggcatacctgcttgtttgaattgcctttctcctctcctcaagcccatttttaattatctagttactaggacaagcatctaaatagttgtggagcaaatacagttatcggaagagctaaatgaaccatttccctctccctctacaaacaggaaagccagaaaggttttaaactggactggtaattttaggttccccagagctggctttgtgctatctgaccactgaggccctgcactgggaggaaccagacggggcccctggcaaccacatccgggtggtactagaacatctcagtgctgttatctatgaccccagaacagagtctcagttcaggggccctaaaagagtttccccactgaacaagcatggaaatgtgaaaatacgtatttattaaacaagataagtgaagattgtttcatttagaatgtgattcactaatgcatttctttgattacttagttatcttggtatgttcaaaatattgtggctttctttttagcagttctttatattaatacatttaaagagggtcccagaagggcaccaggctttaggatggctagaaatggggacatggcctggtcattttgggtcatcttggccctggtctcagttccaaggatgtgttggagagagtataggggtgatagcttaggaaaactctccggagtgaagaggcagcttggctttattaggttgttttcttcaccttaatcctgaaaaccttttcaagctaactggcagcaagttggacatcgaggtatgtgtttagttctagaaacttctctatgtgtgtcatgatattttcttttgttactatcttaagtcatgcacatatatgatatgtattacaatgtagtagaaaaagtaaaatttatacagtaaagggagaaaaaggacccagaaagcaagaactcattagcctgcctgtgcccagcatgaccctgcaagacaggcgtcttactcccaagttcactaccagaataaatgaattaattgactctaaaagggttttgagaacagtttcaagttattattgcttatgcttcctcccctacattccagatcccacaaagaagccacttcttgggctgacctttttatcatccacctcaaactcaacaagggcaaaactgaacttcttctctccgctttatttccttatcttaatgaagggcccacttgctaccggtttactaagccagaatctgaacatcatcaatgtcagggaccagttctttccttcccccttccccaaccaatctccaaatcctggagagtcttccttccaaattattccaaatccatctacttttttccattcccactgcttcttccttagtcaggacaccatcattttctgccaagaagacgccaacagcccaggtggtctccctgcccttagtctcactgtcttctaatctatttgccacactgaccagaataatcttttaaaaccacacatctaatcacgttgttcttcagtttaaaatctttcagtagtgaagtccagactccctcattcgattattaggctctgaatgatgtggccactaagtccctccccagcctcttctcttgccttatgttcacacaccacactctctgctgtggccataatgactttcagttccccaaacccaactttctgtaggattgctgggcctttgcctatgctgtttgttctctgcttggaacaccttccactcttcttttgggtaactcgatgccttctccaggtctcagctcagctgtcacttacacaaccccataggcaggctttatccccaacccttgtccacagtatcctccaggtgactgtgtctcccaggtgggtagcccctgaagtaaccctctacactccatcactgtcagagagttggaaggctggagaggcatgacccctcagagtcaacctagatccttgtggcttcagcccccagcaggtagggagcccaccaagcttcaactctacagcagagacacagccaaggctactggtatgtgcaaaacattggcttgtgaaaattacagtatccaaaacatgattttttttctaaaagagctttttaaattttgttttctaaaagttaaaaccagaaaatttctgatttctgacaggttaaggatttaggggaatttttaagttatgtgatgtgaggttctctgtagttttgtaccaactagattgttcatttcctaagaatgaggacctctcctattcatctttgtaatagggacagtgtcttacagatgaaaacattcaatgaccctacattagaggagaagaaactggagcacaaattggttgaatgttcccccatgtgacacatttaataaggctaatgttgttgaagtggaggctgggcaggcagtaagaggattcccttgtatacttgcacggtgaacatgagtactggcatcgcaggcctcgttcaatgttgatactcttgaatttaaagtggcatttccatgtactcttacagatgttccttcatttgccatcagaaggatagctgtgaagtgatatataggaactttgtaggcatatttgatttttaaacctctattaactttgtgtcaaataatcaaagcttaacaggatttatattaaggatggtgagagggaatcaaacttcatttttagagaaaaatagcaaatcaaaataagctgatgaaagggactttgtggttctctccttccttcagctcctgatatgaatcctagactttttacatattcatactaattagctgtgctttccaataattagagtagccataagcatttgtacactaattcacagttcctaaagcattcttaggaatattagcataaatgtttattgaatgtctcctgtgtgccaggcatgattctatacatgataaggattcactgatgaataaaaccggttaaaaaatctctgctttcatggtgcctacattctaacaccttactttccccattcatccatacatcaaccccacagaatcacactaggaaaactggagttcaggagagtaaagtgactttcacagggtcccaaaaatagtaagtttggggtcacaatttgaacttgtcactccagattccaagtcccatgcctttttttttgctaggtcagtattcactgtggaatcataactgatactcaaaaacatgatcttgagtaatattcaggaaagaatatcatattcaataagttgctttttttttctttttgagacagactctcactctgtcaccaaggctggagtgcagtggtgcgatctcagctcactgccacctctgcctcctgggttcaaacaattctcctgtctcagcctcccaagtagctgggattacaggcacatgccaccacacccagctaattttttgtatttcagtagagacgggatttcatcgtgttgcccaggctggtcttgaactcgtgagctcaggcaatccacttgccttggcctccgaaagtgctgggattacagtcatgagccaccacacccagcccaataagttgcttttattattgagttacataagtcttttttagaaaagatttaagatacaagagttaaatactaatggtcttaaccataagagttaaaactataaattaactggaaaggagcagctgcctagaggaacccagggcatgcgccttctgatggccacagtgagtgctgaggtcttcagtgtaggctgtgagggggactggctgcctaaactgtcagcctstggtaagtagggtagattaagctgatggagcagaaagcctcaccatccaaagccatcctttcccagactccatgtctggtgggaatagataggcaacccgggaaagagtactaaagtgtgtgtcttagtccttttgggttgctataaaggaatcctcgaggctgggtaatttataaagaaaagaggtttatttagttcatggttctgcatgctgaacaagaagcatggcaccagcacgtacttcttacgaaggcctcaggaagcttccattcctgatgaaaggtgaagtggagcaggcctcacatagtgagaggggaaggaagagagagagcatggagggaggtgccaggctccttctaatcagtgctcacagggactgatacagtgagaactcacttactactgagaggatagcaccaaaccattcctgagagatctcccccgatgacccagacacctcccactaggtcccacctccaacagtgggggtcaagtttcaacatgagatttggaggggacaaatacccaaacaatatcagtttgataaagaggatatgagtaatttcattctcccatcagacagtgtttgtttagaagaaaagtaccatgtccataaatcatcaaatgctggcccagagggaactttaaagaacagccccttgatttaagccacacagtttaccaaactataactggactgaagagtacgctcttttttttttttttttttttttttgaggcggagtctcgctctgttgcccaggctggagtgcaatggcgcaatctcagctcactgcaaactctgcctcccgggttcaagcaattcttctgccgcagcctcccccgtagctatgattacaggtgcccgccaccatgcctggctaatttttgtatttttagtagagacagggtttcaccatgttggccaagctggtctcgaattcctgacctcaggtgatccacctgcctcagcctcccagagtgctgggattacaggcatgagccaccgtgcctggcctaagagtatgtctttttgcagaccccataaaaattttccaacttgcttatctcatgtatttgcactagctcaactgcaagaatgactccttagttgatgggtcagtttcctatttccacatacctgacctcattctacctataggcataaactcaagaggaatttacaacagatgggctcaggcaacaagttagccccagagtggagctcagctacagaggaatgcttcactgaaagaaatgtgagtccctgaatctgattcaagcctttatcaagtcctacttcagttagaatccagtttactccccaaatacccgtgagcactctctcagttactatttcccttgctacacatatagaagaaaagcaagaaagttactctgctgggaaacactgccaaggggtcttagaagcaagaaaatttgcctattttatacaggtagtttaaagagaaccacccttataaatgggtgtttgtccccttattatttcaggacacttgaaagctcctctcctccaatatgtctctaattcaagtatcacagtgtctaaaattctaccactaaaatgccattacctaaattaagcacagccttctgtctttatgttgatatttctttaaatatcatgccaatagttttaaaatcaaatgatactaaaggtatataacaacaaacagtcgggcctggctttatcccttcaactcctctgtctcattcccctaccattttctactcttttacccatttcttctggtagttccctatatttctaaataatatgagtaaactatgatttttatgtccaattttaaagcttttctatggacctctggttttagagacaacatctagttctcttacatcccttgccacttcccctgatgctgtaggacagacaggtctgtcccacccacggtgactcagtcattgttgttcatggccgctgcccgttcttcacgatcaaggaggagaawtctttggaggaaacagagctttcatacgtgaatcgactgggaagcgagtcaaaagtactgcaactggaagtgtggcatggggagggggccgtggccagtctcctcactgggctcctgtaggactgggaacgcctactccttcacacctaattatgtttgctggattgggttatagttcttcagtgtgtggactcttgtcagttttatatccgtaggccgagcacaatgcctggaatacagagcatgcttaataatcagaggcttttcattgtatttcttatcaacaacactagtaactgaatataaatcacccttcctcgccagtcagtgcaccatancattagaattcttgctttttgatcagtggagataaaatgagtttcttttctccatgttaagtaatcaggttctgattttcccttttctttctctctaatagtgtttaatgctctaatgctttctaagcatgaggtattttcttgagctctgaagcccagtatcytcaaagcccccttcagggaaacctcagttccctgtcagtcaaggcctgtcactggctttgccttggccttctctgggagaatgtctgctccttaagttgatggcatacaagttgaggtggggaaaaattaaagtgtaggatttctgtaggcagctaatgttttattactggagtgcagtgatgcgatctcagctcactgcaacctctgcctcctgggttcaagcaattcccctgcctcagcctcctgagtagctgggactacaggcacacactaccacgcccagctaattttttgtattttagtagagatggggtttcaccatgttggccaggatagtctcgatctcctgactgcatgatctgcccgtctcagcctcccaaagtgctgggattacaggcgagagccatagcgcctggcctaaaatgtattatataagcatcatagtgaccacaaaacaaaaacctgcagcagatatacaaaatgtaaagagaaaggaatcaaagcataccattacaaaaatcatcacattagaaaggaagatagtaagggagtaacaaagcaacaaaggaactacaaaccgccagaaagcaattttttaaatggcagtagtaagtccttathaataattaatgtaaatggattaaattctgcaatcaaaagatagaagtggctgaatggatattaaaaaaaaaaaatctaggtgctgcctgcaggagactcagctttaaggatacacataggctgaaagtaaaggcatgggaaaagatattccatgcaaatggttaccaaatagagagcaaaaaagatacttatatcagacaaaacagactttaagtcaaaaacttcataagagacaaagtcactatatcatgataaagagataaattcatcaagaggatataacaattataaatgtatatgcacccaacatcagagtacctaaatatatattaacggaactcaagagagaaatagcaatacagtaatagcagggtacttcagtaccccattttcaacaatgaatagatgatccagacagaagatgaataaggaaacagtgaacctgaataacattctagagcaaatggacctaacagacatacagaacactccttcccccagcagctgaatgcacatttaaatgtacacagaacattctctaggatagatcatatgttaggccacaaaacaagttttaacaaatttaagaagattaaaatcatatcaagtatcttttctgaccacaataacatgaactagaaatcagtaacaggaggaaaattggaaaattcacaaatatgcagaaattaaatacacacctgaacaaccagtggggtcaaagaagatatcaaaagggaaatcagaaaattccttaagacaaattaaaatggaaacaacataccaaaacgtatgggatgcagcaaaagcagtactagagggaagtttataaagaaaatgtggtgtatagctgtatctacacaatggaatactatttagccttaaaaaagaaggatttcctgtcatttgcaacaacatggatgaacccggagtacattacactaggtgaaataagccaggtacagaaaaacaaatataggccaggcatggtagctcacttctctaatcccagcactttgggaggctaaggcaggaagactgcttgaacctgggagttcaagaccagctttggcaacatatcaagaccctgtgtctacaaaatttaaaaaattagctgggcatggtggcatgggcctgtattctcagatactcaggaggctgagggggaggatcacttgggcctgggaaatcaaggctgcagtgagccttgaccattgcactcacgccactgccctccaacttgggcaacagaacaagaccctgtctcaaaacaaaccaacaaacaaacaaaaaagaaaaatatgcatgacctcacttatttttggaatctgaaaaacttgaactcagagaagcagagcatataataatggtggttaccaggggcagtaggtgggagaaatggggagtcgctggccaaagagtacaaagtttcacttaggaaagatgagtaagttctggagggctaatgtacagctctaatgtatagttagtaataatacattgtatacttgaaatttgcaagaagaatagatcttaaatattctcaccaccaaaaaaaaaaaaataatgtgaggtgattggatatactagcttgactgtggcaataattttacaatgtattcatatatcaaaacatcacatcctatactacaaattatgtaatttttatttgtcagttatacgtcagtacaactgggtgggggggagggggggtgggaagaagctgtctccatatgaggccgaggtgtcctatatatcctgagcttgtattatcgcctttcaagtgtaaaacctgtaggtgatgggatgcccgaaaggtttgaaaatcaggaatgacaagatcagattttgctttaggagggcaacttgaggcagcttaaagagtggattgcaggaggtagaacttggaagtgagaacgctgttgcacaagtgcagtgagagaggggtagcctcgagccgaaccaatggcaagggccagggctggggagaccattggagagaggggtgggagccacactgggctatcaccgggaatggagagctagaaaagagaggagaaagcactggcacagggggcctgcggagagaaagaaggtctgaagaaaacctggccaaaaggagaagactggagccctgggccatcccgcttgcggaatgaggggccggcgggcttcctggggctgaaccctgcgtggcaaagaagtgggcaggttttctttctgcctgcagaaggcttctcaaatgcctaacaaagtgatggatttcacgcagcccagctcagcaaagagagacacagacatcagagtgttctagaaacaaagcagggccccagggggaaactgcgaggcctagcagggcaggggagccaaacacagggaagaatgccttctccattctccagagggaagctcaacgtgcctggggaagggtgcgaggggcactggcctgttgggacatttacagccaggcctcgggttggttttatccttaaacattgttttatccgggggcaggctttttccccggaaaatttccgctctgcctcactttgctcttccccgaggagtgggctgggagccccctctgctctgaagccatcctgggggtccactgtgggtgttcggcagtagcttctaggggactggccaggcccctccctggggctgcctaaggagaagagttgtttctggggtgacgtgggagcctgtgtgccagggcactggcccgcaagggtaagaacccggcgggctcccgcagcctaacagggagctgcctctgtcacgtgcctgcgaggtgggacacaagttggcttacaagttggttcgacatagccaaatccgcgtgccgcatttccacgctatggagtgctagtcttcatgattgtgccccttgacatgacacaataggaatagaagccgggaggccaagcaaaggccctctttgggggtgggggcgcggcggcatgtgaccctcgccgcctgtggggaagacctgccttgaggacagagcgccaggggtgcagaggccgcctgggactgcccggaggccggtggggagcgcgccagcgaaagcccgtgcgccctcggagccggggaaggcgcgggccatgacccgggttcgcccgcaaaggccgggcagtgccgcaaggcgtgggggcgcccccgcccggtggccccggggctggtgcgaccctgggcacgccggggccggggccggagccgggggtcgcggcggccggggagggggaggagccgcgcggctccgccggcgccccgcgggccagggaaagtgaaagggcggcggggcctcccgcgcgccgctccaggaagtcgcgagcaggaagcgcccgcggcggccgggccgggctgggctgcggagcgcgggcctcggcggcgcaggtgaggcgcggggccggggccggaccgggaggcggggaccccccgcccccccgcccgcacctgcggggcagccggcgctcaggcgccgcagccgctcagcacctgcggcgccctcagggagccgggcgcggggccctgcgcactcggagctcggctcctctccttccttttcttttttttcggggggaggtgggggctggtttggatgttttccgagagccggggacggtctcaagctattttcgcggagggaagtctttgaaatacgacatctagaagagtggccctcggcgacaatgccgggcgttcccggaccggggcaacgctgggattccggggaagtggaggcagagggagcgggcacggggccggcagccgctccacggagtccccggcaggggcgagcttagctgtccagccgggtcccctgcccaccccggcccgggccgcggtgacagctgagggtccagagagccggcaggaggggaccctgcgcattgtctgccgcgatggggacgtgggcgtgcccgcggaattcacctcctccggggaccagccgcccagggaggagccggcacagaacgctggctcggagcgccggcaccctgggcctttgcgttgtttgtcggctgagcagctggttcccggagcccgtgggcctcctggccaatgcgagtgacagcgaccttctgggtttataataaagggcttgacgcgccggaaagtcccctcgccgctggccaccagccttccagcccttacggcccacgccgtaatcctggtgaccgagaaggtacgtwcagtctaaggatttgcatttgaacgaaggatactggccaagccccttaccacccccactccccgctaacaccccagcccgcggccccaggtttgaatttccaaaggaggaattgctaaagcctgccctttccgggtctcccttagctctttgcctggaaggtgcctgcctgcctgcctgccggcccttgaacttaaatcgtctgaagttgtgtaagtggataaatattttagacttcccccgttgtttttttattaatcccctttgagagcaagcttgaaaacacctggccccagacctgtgattcaccaagtcattttggamctgcatttacacgttctgtttcatgcagcccacctgtgatgttctctttgttgggggttggaggcaggtaagggaggtggtgcaaatggaattcaggttccttgtacttcagccaaggggaaagagatagtgaccattttcattcatctttaatatggaaagcgcctttaaaagcaaaaagccatagaaagagcacactctggacaggaagttgtattctatctcgtaatttaaaaaaaagaaaagaaaaaatgcatgaaaacttttggaggagaattgcatttctcacccatctttgcctgtaaagtgagacccagttaaaaaaaaatgtcataaagtagattatttaaaatatctgtggggccgctttgattatgtgtaatgccacctcagccctaaaaagactgaggaaccttactcctgctattgctcacttcctatccccattatttgagtctctgcagattacttggaaccttctaggcagcgcagatcacatgtgggtgggtctgggagtggagcttgtgaatgtttctttcctcagcttattctgttttacagttgcctagggtgggttttttgaagaaataggtataaaaccatgtgtctttcagagtctgtttgtttttttaacttttagtttcaggggtacatgtgcaggttttacaggttgtaataaagatgctctaatgggctgtttcctaagttactatctttttatatttttttaagacagggtctcgctctgtcrcccaggctggagtgtagtggtgcaatctcagctcactgcaacctccgcttcccaggttcaagtgattttcatgcctcagccacccgagtagctggaattacaggtgtgcaccaccacgcccagctcttttgtgtatttttggtagagatgggattttgccatattggccatgctggtctcgaactcctggcctcaagtgatctgcctgcctctgcctcccaaagtgctgggattgcaggcatgagccaccatgcctggcctaagttgctgtgtttgacagtgcaatgaaactggacattctgccgcttttcctccctggaatggtaagttccaggggggcctgtagagagtgactttttaaaaaagtatctcttctttttatgtacttgggcagtgtgccaaaaactgggtttaaaccaagtgatttgctcccattctgctgccctttctctgcaggggatgggcaggaagaagagtggctggagggaggaggtggctcagagaaacaggacaaactggaatctgccccacttatccagctgacccaggcgagccgcctagcctcatttttctcccttgtgaaaagarcgccctgcctcttcagggtggtcacggggctcaaatgagagcatgtcagtcatggttcgtgcttccagaggtcttgacccactcaaaatgaagtggtctttagtggtgctgcacaggctagggaggaagggcctcattagttgagctcttaacatcccaaatgtaaaatcactgtctttgcacatcttaactgcactcactatgagaatttatagcacttttctttcacccattttacagggaaaagaatccatcattgttttaaaaagaaatcaaagaggttttttttcccttcttgatttgtcagtgccttctgggcctttgatgttgttgtcacaggttttatcagagttggaggtttttgatttatttagtagatggcaatggaatgtttccagacacgctggacatggagaagcagcacttgagaggaagacgtttgcttctgaccatccgtttccagacactgttgaaccaaattctttactctgaagttgtcatcacaaagtcatttcccagagtagatccagacccattctggagcccacccattttgagcaaaatattgcttaaatctagaggtttgagcagacgtggttttgaagtatttgtggctgttcattcaacgtgagtttcttgagcacgtggtctgtgctaggttctggacaaggagatggaagtaggaccttgccctgcagtcccgggccttcctcttttgaatttacaatgaggataatatcagctagtgtttgttgcgcatttactacgtaccaggccacttatcaagtgcttcccataggttatctcattgcatgtttataacaacatggatgctatcatccccattgtttagccttgaaggagagggagcagaaaggttaagtgacttgcctcggcttacacagcccagggtcagccttggaaggaggaggtattggagtggggtgaatcccacctattcaggccctgtaggacctaggagaaaggtgtagttctggctggagcagatagaagagatgaggggcggctcctgggacgaaagctcagcagggattttgaatctttttgtaaaaggtggtataagggaaaaatccttggagaatgtgcatttttggaagctcactttcgagggaggcaaaagtgaatgtggggaactgattggctttggaggacgcagtgactcaggaatgtcatgagtttgacattgggatgggagaccaggcctgcctgctgtgctgggccccttctcagttctcnggcctccctccccattccttcctatattgctctgccttcagccctgacttcataatcaggtcattttctgtgacctctgaggtgaccacaggagatgaaaaatgaagaggcagacgaggcaaattcattcctcctttggattcaaatggcaaagtcacaattaaatgattggtttgatctgccctcttgtctaggcccacatttctctgtcactacggttcaaaggtggcctggtccataggggtggaactgaggcagtccagtgccctggcatgccttgatatctgggcacatagcgtggctgctggacacatacttggttttgtgaatgggttgatctctagatgcctcccagatagagatgagttccttggttcctttttatccaccatcagaacattatttgaaattcatttccaggttctcagaacaaaccgcctcaagggtagatactccacctcaytccccctcttcctagtaacactsctggngggggcccctgcttgtatcagacgtgcagctttgatcaggactgggtactgctactgtacgtgtgtggttacttctgccagtaacgctgaaggtgtgaatgtcacgacactggactctgaatgcctctcctcctccttgtagagagcagagccactgccagaaggaaggggacaagacccagcaggacaccttctttccacgctttccagcctgtgggagyggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtgagtcctggtggggcaggcccttggcatggagctgtgtataggtgagggcractgtgcaggtagttgtgttgccccagtttcattataaaacacataaaacttgaatcactgacctcacccataaccgttgaattgctttttggtggtggaagccgtgacccagaacagtgctgaggtgtcctttgtccttggtactggcattgtcagatagtgtttgggctcccgcgtggtctccagtggtttctctaagaaccatggtccctacagaaaaatgaccactgactaccagcagggttagcaaatggctgtggtgaaataagcacataacttatatataagttacacaactctgagatcagatgagtggccttgccggggcagaactttcagagagaaaatgaaatgttctggtgcagcccagaatgctgctttccgttcagagagtgcctcgccttgcatattctgagaatccttctcttaggtggcctcattaattccattctccttgaaggaaacagttgacaagcccagagtctgaagctgggctccctggcctctaacttgtcctgctgacctcttctgggagaggaaaaactttgcttctaccctcgtaggttctgttttgggggacctgggaattaaactgacaaaagacagactagcaagagaaaagacagatttcaccacttatgtacgagaggtcatagaaaagtgtccctcaaaggggcatttagaattctgggcttatgcaccgtccgtccttcacaggggaaggggagtgagagaaaggtacctgtgggcaaacgaatggctttttggaaagacaagtgggccctcaagagaacagagaacagatgggcgatgtggtagttttgtgatcattcctgtttcagtgcagtgtggaggcttctcatctccagtggtaagagtcctgtttccctggcccctcctaagggacaggatttatagcagatggattcttttgacttcttttggggaactctgcttttcagtagctaagagaattcaggaacgcaaatgccttctgctcaaaatgattttgatgccacagcggcagattctgggcccattcatctcctccacgccaaccccctggcagcccccagccctgtgcagcttctcagccctgctggttggtggagcatccacagggtgtctcaggtttgatttgagggcatctgtgttcttcaaccagattgcttctcttcttgacttatttcatgtctgctgtgagtctagccacaagtgcctgaacacttaggttttatttagtgaatgtctagcttcttcattttgtaagtttattttgatataatttcaaactcacgtaacttactaacatctgtaagaatgttcctgtagaaccgctgtatgtcaaagattaacatttagcctcatctgcttctctccctgcccctccacagtgtgtktgtgtgtgtgtgtgtgtgtgcatgtgtgtagatgtatgtttgtacacacacacttttctgaaccacttgagagtaagttgcagacatcataccctcttatttgtaaatacttccgtgtgtatttcctatgaataagacattctcttataaaaccacagcaaaaagatcaaaatcaggaaatttaacaccgataagatactgttatctaacccacagtccatgttaaaaacratatcaaatgtcaaatatctgtgatagcatttcttcttctgttcaggatctagttcgggttcatacattgcgtttaattatcctatgggtctcgtctcttcatctagcactgttcctcggccttttttcatcttttctgaccttggctttttttccttcttcttctgagacaatggccttgttgtgtttgaagagttcaagccacttattttatagaatgtgccacattttaactttgttatttcctcatcctcatgattagattcagattatgcatttttgacagaaatcccatagaaatgaggcagctttctctttaatggagaaggagctataggcatgggaagagggaggggaactggaaggaactgagtgaggttggattggaatgaaagttctcgggataaactggtgatggtcgatatagaaatagagaagggtgtgtgtgtgcgtgtgtgtgggtgtgtgtgtgtaaaatgcaccccgctaggaggtcctgggaacagtaagagcactaaagtgagcacactttggtccgggatcttggtttctgcatggcatctcccactaaaaggagccaggagtccttggagacctggccaatgccaggactggggcagggcaaggaatagatgagcccagaacatcttgtgccagaaaataaggaagtacttacaaacaaagggactctgacttgtcaaatctaggacaatctgagatttacaataaatgagactcatgaatgatagcccattgaatagcgtaagattcggcgagtcctactgatataactaaagaagtaggagaaatgcacgctcgccgtacagtggaagctggccgctaggtggagcggggatgtggagccgctgcagggtacccagcgcaggcacagaacgccatggatgcaccccgtggggcggcagcttgaggaacaggatatctacattatctcaaagcaggttcccagaaattccatattcattacttagagggaaacgtagtggtttcactgaggaactatgaggcagacagcactttaaccaatgaccaacgtcagtgtcactgccctcctgcaccttctgacgggatactctgaacaggacatggcatcgcttctctgtctcagaaaacatagacagaattacaaaataaaaaaggattttgggagggctgtttggcttctgggggtttgagcccatccatgctgcagagtgaagcagaggatgtctttggactaatttctgcaccaaatcatatcactcagtaattctcaaaagtgtttctttattccttatttgcatgtgattgaggtaataacagtcaaacaaggagacagatattttgcatggagcctctcaccctaagcaggctgccattcacctgagaacacgtggtcttccagaacatctctgaggaggcccagaggggcacccccatctggtgctgtcattgctgagacctgcttttttgctagaaatgtgggatttttcatattggtggaagccaagcatgctataagtagtcataactgcaaaaagtaagcagaacactgaggagcagatagattagatcatttatttttttattgtatttgttttatattcataagtctaaacataacacaaaacaaaaatgaaaggattatattagcctcctggggctgctgtaacatggtaccacaagctgggtgtcttgaaacaacaggaatttaccctctcacatccctggaggtcagaagtccaaagtcaaagtgtcagcagggccacacttcctctgcaggctccggggacagacccttccttgcctcttccagctcctgctgctgccgcngttcttggctggtggctgcatcacaccagtctctgcctgtgtggccacgtggcctcccttcctgtctctgagtctttgcgtggccttctggtgaggacgccagtcattggaatnagggctcactctatctaatatgacctcacctgagctaatcatgtctacatgaccctatttccaaataaggtcacgttctgaggttttgggnggacatgaaattatgggggangatattcaacccagtacaaaatgaacaaaaggaaacatatcatccaaaacatctgctttataaatgataaagaaaacgtagatagaattacgaaataagaaaggacttcgggagggctgtttggcttctgggggtttgagcccatccatgctgcagagtgaagcgtctgcctacccagaggccaggcgtatcggggtgacaaccagcaaggcagcggcccgagtgtggctgccgcggtttagcaatagtcacgggagctgaagtcagacctttcaaagaggaaagtctagcctccagccactgcgtcccccatccccaagccccaagtcctaagtacagaagatgaagaaatgagagaggaaagacgaatttggaaatagaagtagagttggcctgacaccagctaaataaatacagcgttttcctcttcagtctttaggnacattccagtttgctgtgtaaatggacccttcacccaattctacagganggcttctgtcagcctggctacaccgtggcagtgactcttcccaaagggtctcattcattaaggtgtctccctccacacaaggctgaactaaaggttccagaggcatgtgctgccccttgtgtgctcctcagtgttctcagggcatctctaggcgtgtgctgtgagcaccagccgggagtcaccccgcagaggaaggcaggagcccagaacgcatcaccagggcctgatcacccaagcagccctgaccattgggaacgcggtgtgtgtcggggcctcagcactcttcagacctcagcccgacaaagggagacagccttccttctgggctgtctgggtggagagtggagatgtgaacccacagcccataggacagagctnctcttctcaaaatccttcctagctgggtgataacacctgtagaactggcactgtggwtggagaatcctcctgcatggagcaggagagatggtccatggacttgtctgagactggggaggtgctggaggcaacttggcctgagaactttgttcacctgttttgaggagattggagaaggaaaccctgtactccagtgagggccgatcagggtcacccatcagccttacttgccctagtcagctccagcaggtggggtggaagtgaccagtttgtcaagctgtgggctggacaagtgagcattgagggccggtgaagcccagtggcctggaatcttcctgcaccagcagtcgaaggcgtgagaagcagtggtggcctaacagagagcttcatccaaagcgctgagactttctttccttgccagaaaggatrgttttcagaaacacgaggacagaggccggggcttctggagcaaatccactgtacccacatagcctttgttctttgggctttgggataaatgataggctcgccttttagggtttcgcttttttcccatttggcccttgccatgggcttggagaggaagaattggagaaaggccattggaagatagttccctgatgaagaagagagcactggggaatttctgtcttcagtcagcaggtattctgcgagttggtttggtttggttccttccccaaaggcacaggcattccaaaggttgtagttttgtgtcacacggagccaccaacctttctttcccacctgaaatatggccttttttttttttaagaaaaatctggaaatatttatttgacccctactttagctggtgaccagagaagaaggcagctctgggatcctaggattttagttacttgtggaaagcttccctcggagtaaatcacaacattaaaaatgtagatgcgcagctgggagaagcaaccccttatcccagggactctcggaaacgctgcctttctttgtcctgtgtaggacgccnccttaggtaattattgattcaggttgttggtggcgccatttgaagtctcttcccaggccacaagcaggacaggttctccagggtagggagatgtgcctaggacacagaagagctgcccctcgccttccactcctgtcaaatacttctttctcccaacccattttgttgccccaaaaagtatttttctatgcggtggttgagactcttagactggagttgccctttgtcttctttctaaggcaccttcttttcttctttcttcctcacactcatgctgactctttcggctgcttttctcccagccaaactgagcgaggggctttgtaccagtgtttctgtcaytggcctattgagagcctgccagcgtcactgcctttttctctttgagggccgtgaaatatttatatgtctgccttgcttgtgtgcttctgaaaagttgcatagaaaccaaagagccaaaaataaatatgatcttaattgcccaggatagcaggctacgccagaaacttgtggttagttttgttgtaaactaaacatttcatcgtgcttgttctgctttgtaaactcaagtgtgcatctcgagtcccaggtttccctttggttacggtttctttaaatagatgaatgcttttgatattgtgacgtaataataagaaacatgcttttggtctctggccctggttctgggcacacagctcctacaacctttagtgctgagtgtctttttgtttgctaatgaggtgactgtggcgggccccaggacaacctcctgggggactggttgccagggcaaccgaccacgtgattagaggttgggactccacccgtggacctctggggaggggagggagcccgcagaggtggagtggatcaccagtggccggtgttctgctcgatcgtgcctgtgtaatgaggcctccacagactccctcaacgacagcgtttgggggcttgcaggctgctgagcacggggaggttcccggagggtggagccctggcgagggcacagcagctccgagctccctgccccatacctcgccctgtgcatctcttcatctgtatgtattctttgtaacatcgtttataataaagcagtaaatgtgtttccctgagttctacgagctgctctggcaaattaatcgaacctgagaaggggttcttgggaaccaccctgagagccagttggtcagaggagcaggtcacaacctggggcttgttgccattggcatgtgaagcggggcagcctcggccggagccccgccctgtgggggctgatgctgactcctggaagacagtgtgagaattgaattcacttagaggacatccagtgtcagctggagaattgcttggtatatggggaaaacccctacacacgtagtgttagaagtatggtatgttgtgtgttgtgcatgagggtaggaaaagcagtctggtttttcctgtctcttacagtgttcagtttccatttgganaaagcaaacgtggcaatattttttaatgttccaatattatagtgacataagtaatattgataatggctgtagaactgaatgaataatacacagcataagaacgtttcagaacacagtgatatgtattcctaacataacttctgttatttcatatcatcctctcccactgttttgtgtttcaggtacagagccttcatttttattttgacatttctgctgtatgcaagttttcacttatctcgaaagcctatcagcatagttaaggtaagaatcatggaaagcactgcctgtcgtctctgtgaggagttcgtcacttgaaaagcttgtggggcagaggatggggatggtagcaggtacatggggaaacagattatgtagaaacaagttattctgctgctttggcttttcggtttccctttgctaaaattaaagtcttttaaatgttttttggatttatactttcagaggtagtagacttttagttttattagttgacatttccagaatttgaaagcttagctaaatatttattttatcttgtgtgactgttccttccaaatgtatccagtcttaagtggttccccaaattccagctcttcgtgcgatccaaccctaggtctggctgcggaggtggctctccattgttcttggaacgctgcatttttgtctgagtgatgggtgggcaggaagttgttaagcaggtgttctactagactttgagaaaagaagattaaagcagacaagcctacataatcaccagttataacctggagaaaagcaggaataattttcttaccctcattgggattacgtcacccggcctgtagaccatcaggggcctgagaggcattagagtctctatcgtagaagaacgaggaaatcatccactgccagagacagtgcattcacagcccagtggcccctcgctcactctccgggagttggcagggacccagctccaggactgcaattctgtgacctttggagctgtgcttcctccactcctgccggtggctgagccctgggtggctgccctctgcagccctggtcggcagaggcaatgcagaggctggctgttttgtgacggtcctaggttccccactctccagcagctttcaggggatgttaaacattcatttacccaaaagattctaaaattcccccttggcccctgataagcaagaaacttccatgcctctcaagttgttgactgtggaaaacgtttgcagacctttgaaaatgtggtttttaagagagaagaatatgaaaagaggtggtgggccttaaacactcatccgcttgacaagaaactctcaaatcagtaccagtaaccagtcattataaatctgaatactactacttcttgtctttctggttagagaaatatacaaacagctcaagaaaatggtaaattataaagatggaagtgactattgaagagacttggtgagcgtgttggagttgaaggatctggtgtagttggggagcttgtgtggggtttcaggattgacctagaaaggttgggtgtggattgtaggggaagaaaaacagctttacaggtgggagaactgccttgagtgctacgtgcagggatgggcatctccatgaaggcaccacctgttgggctggggggctgttggggcagatgtagcgtgtaaggtgggctggcctttgggggaatctttgtcaggccacagctgttggggtccacctgatgactatgagggcccctgtgagccaggagcaagtgggagccctgtcccggtccctctcccggctttcctggtggtccatctcaaagcccccgcccctgactctcgtgtgtagtggtgtccaggccactcaagacttagggcttctgaggaggcggcgtcagggtcagctcttagttcagtgtcataagtaacaatataaataactgccgcttacagagccctggggtatgacaaastgccacatacattacccctgtgatcctcacagcaaccctgcgagtgcccctgtgaggaaattgaggctcgggtcttcgttccccaggcagggctgccacacactcgagaattccctgtgggtcaggctgcctccagggcccctactcatcctctctgtgcctcagggtttgtccgggtttaattacctgagtacagtcccagcatcaccctcagagcctcctaaacgcacagatttcctgacctagcagctgcgatgtgcctgggcatggattggcttgacgctgaatcctgtgggtttctttacctttcaagatagatcagaacatcacaccacatcaaaactaaactttatagtgccttctgaagcgcccgtgtgcttgagctcatgatataaatggcatcaacgaaactgaaagtagtagtgattctgttgacccacaaaacagttgagtgattatttatagcctgcatttcccagaatattgtaagcaaaaccaaagcaaaatgtatttgcttacttgaaattgaaccagaggctgtgaattagaaagtgagtcttattctgttatgtcatttatagaatgacacggcacaccaggtcacatttaagttagttaaatggaatgtttagacttacctttgatcactgctgattaattgtatttttctcgatgatgatgataaaaccagggctgggaggatagtggtgttataagtgcaaccctgtcccttctatctgctgctccagctgtggcctagcctcaggactcaaggcaagcgtctgcccaagctggtagacaggtgagtctgactcccagcagagatcttagtgcgagctcttttcacctggactgggccagaaaagaaacctgaaagcagaggcttcccggagaagcttaaactgcaggggtccctggagccagggggatggcagcattgatttgaatgtgagtgtgcccacccctctctggacacacaggacttaaaaggagaaaactggctaggcgcagtggctcacgcctgtaatcccagcactttgggaggccgaggtgggcggatcacctgaggtcaggagttcaagaccaaactggccaacatagtgaaaccctatctatactaaaaatacaaaaaaaattaaccaggcatggtgacaggcgcctgtaatcccagctactggggaggctgaggcaggagaatagcttgaatccgggaggcgaagtttgcagtgagccgagagcgcaccattgccctccagcctgggcgacaaagtgaaactccatctaaaaaaaaatgaaataaaataatcctcagtggcagacagaaaacaaagtctgaaaagctggaagtatgtactatgggtgggaaacttgttatttggaaagttccaattctcccagtgttaatatttaaataaaatgcaactccagtgaaaatcttagcagggttttttttaattgaataaaataatcttaaagtttgtatgaaagaatgtccaggaattatcaagaaaagtgtaaagataacattttatgatatgaaaatatgcaaaagattaacatattttaataccataatcaaattatgatattacatgagaatagacaaaaaagtcagtagaatagattagaaaatatggaatatttgacagagcttatttaataaatttaataaatggtgtcggcacaactggttattcgtcaggaagaaataaatgttgaatccctattttataaaaacaaatggcccgggcactgtggctcacacctgtaatcccagcactttgggaggccgaggcaggtggattacctgaggtcagcagttcgagaccagcctgaccatctctactaaatgtacaaaagtgagctgggcatggtggcgggcacctgtaatcccagctacttgggagactgacgcatgagaatcgcttgaacctgggaggcgaatgttgcagtgagccgagaccacaccaccgcactccagcctgggtgacatgagtgagactccatctcaaaaaagtaaaataaaataaatggattaaagacatgaatgtaaaatacaaaaagtacaaatccaagaagaaaattatgtttatcgtaggagtgagtgtgaagttaggaaacccaaagaaacaacgggcaagggggatgaacaagcagtttacagacacggaattcagatcgccaggaaatatgtgaatggtgttcgagtctgccggtattccatatgcaaattakggcaacactgtgctcagtggctggcacagcattgcccagggcagtaagcgctattcactggtcgtgaggggagaggagttttcatgcgttcttgatgggatgtcaagcgttagcgccttttggtgacacccagtgaaataaaaaacactacagccttcagacatacttctgggaatttcaccctaaaaataaaagcaccttacttaggaatatcttcataagcatctttatggcagctttgtagtgaccaaaaaaagcaaaaaggaaaaaaaaacaatgctggatatcaagggaacctaataagtaggtaaaagtttgaataaattatcacaagtccgtattatgaaatgtgcaggtccctaaaagaattcatcacaggcaaaccagttgactcagaaacatttccaggaggtattttgagtaagaagttaacatgtgcataaggatgtatagaatgattccatttttgagaagtaaacaatgaccaagaagctcctccatctatttctgtatccttcatgagtggagcatttgcgtgtctgtccctgggtgtgtataatgcatttcacgtggcacctgtgactcatcgcaggaggctggccgtgggcaggtgctgttgtctgtgggggagagcctggctggtcgctcctacttttggtaccaaaactgtaattgctcttccaggacttagataatgctttggagaattcttgtagccttataaaaggaatgtgaaggactggttagaatcagtgcacccacacagcctaatgagccacgtaaagttgactagacagatcgtcaaatgcagatgatacacacacacacacacacacacacacacacacacacacacacacacacacacaccccctctgtgttggctgaaggtggagtgaaactggcctaaccccactgtcctccagggggattcagtgaggcctgaatcccctgctcctgtcctgtcctctcactgttgcctttcagtggctcctgcaccctccagactgcctgataatctcctctattggaggccacgtacctgctgcagagaatgtgtcgcgtggctgtagtcttaggcaacttaggtggggctgagaacccagggccacttctgtctgcgaagtggctcaaattcagcatggaaagaacggagccttcatggaatgcaggcgaatacagtgaatgtttgtgcctaaatgactgcgtggggctctgcaggtgtaggatgagggaggagtccagtcttttctagtgtcatgaaattcccaccgcagctgcctgctgctccccggacgggatttcctctcgctgccagtgggaggggtggggagggctggatgtggcgagggagtctgtagacagaagacattgccagctcccagccccaccgccttccccgcacactcgtcgcgctgtgactcccggccccgccgccttcccngcacactcgtcgcgctgtgactcctggcggttttctgtgttcttccagaagattggcacctttcttctcccacccccaccctccacccgcgatggcatctgctgtttatttttgttgctgttctgtgtgttgcatggacgctttagcagccgtgacgcccgcgtcttcacagggcccactcagcctcccgcctcacataagtgtggagttcagttgctgcagaggcttttgcctgatcagtttttaatatctacctgatgtcacaggttgattttgtatgtaacttgttgaaaggcacttgtgtaaaaaggtgtaaagaaagctgcttttatgaaagcagacgtttcccaaaggacttgaccccctccccaagtatttccgcagggatggtgtrgctatgcagaggtgagggtgcttccctgaagtgctttggtgagaatttgctcacctggcgaggggtttgcttaccagttcatcttaacctaattaagtttgcattgtctctggaacgccacgtttgggggataaaactcatagaaatactgaaatatagcaatgttgttgaaaacctgtggttatgtaaatatcctcagaactstttgtgctggagtaatatgaaatctcgatggctttggcagcagccttccaayaggtctgcggggtgcgggtgaaggtgacctttccaacatcaaggagaagggccagagaggcgcccggactcacagtggccctttcctggacccttcccaggggcggagggccagagaggcacactccgattatggtccatctttatagtaangctgggacacaggcattgtcatgccaactccataactgatggccagggagtgtaagtgatgtcaccaaggccagaagccacagagaggcaccaagatcccagcttaggcctgtctgctgccgaagcctatatccctaaccaggatgtgagacccccactcattacataacaaaactaggaaaacttttctgcttatttatgaaaaaaagggaacatttctaatcggatatgttttccacaggtggttcctccccagaaatattaaatcacaaaggatataaaattctgttttaagyggcggcctgcagaatctctttttcctttcttctgcaccaggttaatgttagaaacttcagcttctccctgcacatgattctccctcagccggggaatgtcctgtattcctgccctagctgtggctttcttyagtcagaggtgaattgtagtggcgatgcttaggccctttgggcgtggccagattgacttccatgggaggcagcagggaaaggtgggcagaaacacctggcttctgaaggtgccaaggagaagtgttcaacaaggcggcgggtgaacagagaaaggccacagataccagcttgatacagagaggaagggctgcaggcacccgccctgggtctcacgatcacactcccagcccctcacgtccaccttgggtggagaacttaaaacacaagcaggagcagccagggggacccaagcagttggggagcaaatgaaagcactctcttcctgagatgccaggaggtcagcatggcgcctccagggaggaccagctctgccaagggagctgctgggcagatgatgactttgcattgtaaagtagagcccttggctagtttttggggacagtgtttaattatagcagaacagcccagtgatgacggcagagtcacgtgaccgtggagcagctgcatckcgtgtgacatgccgggactcagtgacgtggcccacgtgctgccagctgtaaatcagggtgtctagctccgattcaaaagccctggccttttgaaagtggccagccttgttggccactccctcctgaagagggggggcaggacttccggctgctgcctgcctgggcactggggtggctccctgcccagcgttctgtgccctgacctggagccagctttgtgcactgccctccagacccctggcctctctcaggttccagctcacgaggacacccctctggtatcacgggcactgaatgggcactcgatccccctaagggacacccctctgaccacaaggacttcacttgccgccatcactcacgcttgatggggcaactcctttgaatcttgaatagtgcagaatgatcactacagagacccctgagaagagaagcatgggagcgacagaggccaccagggagggacacacagtcacagagcacattctgtcttcctcagtttcccccgcaacaagacgagcccctgccacatgtggcgctgtcctggaagtgttgttcctcttcccaaggaatgcsctgaggaagagcccacttaggcccctctgcctcccaacgagaagcacccactcaggcccctctgcctcccaacragaagcacccactcaggcccctctgcctcccgacacatgagctttcctctctgcccagggtttgtttcacaagggccgtgtcatcctaagctctgtgcaaaaagcctggtgttcagcgtcacrggtcccagtgacttctgtaactgggcagcagccttgtctgcagagggggagaccgaggcaggggcagcaagtaacatgctcacacagccagtcaccaaactccagggcgatggctttcccctcctcccacctcccagacaagtgtctccaaccctggccctgcttgctggttctgtggacagtttggtgggtgggtggtcccctgccccagggatatttttaaattgaggtatgatttacacttactaagtatacaaatcttcagtgtacagtttggcagatctgtacatgcccataggggtagtcatcctctaggttaagggatggaccctttctggctcccagacagctccccatcccctgtcccacattgtccccctttaggtaaccgtgactctcacctctagccgcrtggattcgttgcccatgcttggacttcctatgagtggaatgctgcagtctgtactctttcatgtctgcctccttctgcttcatgttatgtttgtgaggttcatcctcattgttgcctggacctgtaacttgttctttttcacgggtgtgtagcattcagttgtgtgaatctaggaaaatgtaccccttcttccttgtggacaggtggtcaaggatgacaggcagtcggctttcagcttggagctcttagaactaaaactgctcccgaggctcgtcttcyggtggcatatgaagatggcttatgttcgtcacgtgctcaggagtggggttgctggagagtcctgctgaaacgtcaccagcaggcattcttgtgggtcctgcagacacaccgccagcagcgccttgtgtccctcttagaatgcagggtgcaggtgccctgggcaggctgctgggagaggaggggtgactgttcctctctgtgccccatgctgagcctcactgagggcacttcctctccctgcttctgccctcccatcacgtcccagggtgagctccacaagtactgcactgcttgggatgaagctgacgtcaggttcagcagccagaacaggaagtctgggtccgctgccccccaccagctccctgacaatgagaccgactgtggctgggcaccgtttggtaagtcgattatcggtccgtccaggagccgaagcggctgtccttccagccttgctattaatcactttagcagcagtaatgctgttcccagatgtaactgcatttccatgacagccctctcctaccaaaaagcacatgacttcaccgccacggtgtccacagtgcctgtgcgcagagctgttcctcctgaaagaaggttctctttatggggaaatgtgctgaagatcatttgcattttgtattttggacttgcagggcatagttctgtgggtgagaagaagagagagacacgaggcgctggtgtgggtgctggcctaggcaggtgtgctgcagaaaagccagtggacacgtaaaagaaaaggcatcaatcaaatgtgcagccaccatgcacaatggggattttatctcatctgaatgacgcctgtattatatttagtgattatttgaaactgcggtgacttcattttcctttgcaagaaactgaacygaaaatgcaccgccttgttttctatgtggaaaaccacgcgtttcactaagtacaccccgatttcgggaacagatgctttgtgttttatagccgtgctctagaacataaactaaacaatactgagcttgtcctgctggttttcaaattcatatagataagaacaactatcagcagctgcttggggccctggactactccttcctgtgcgcctatgccgtggggatgtacctcaggtaggtctccttcagttttccagacccttcctggttacctggcccctccgtgcagagaagacatccgctatgctgaagtgcacaggcgcgcgggattgaggcccccgcttgccactggcttccctgctgttcccttcccaaagacgaggccaagcttaggagagagcaagtgcgtgtgctgtgcccacaacacaggacctcgaggcagaggatttccgtgtcccgggcactgtgccaattgacacaggctgccctcagctttcctggccctgaagtttaggacctaccatgaatcctgccaatcctgggacgtggtcattcaggaacagaggactagtttcctgttcagcagagcccaacctctcctgtggttcagaggttgccatctgtttanatgccccaaataacgaatttcacctgatgatcgaaacagttgacacaggatgtgctgaacagctctacctggatgcccagcttggccccagaactctgagcacagcagaggcagccatgcatggcgggtggggaactccagagagagaccggctcggatctgagtcccagctctgagtacagcagaggcagctctgcgtggtgggcagggaactccagagagacaccagctgggatctgaaccccagctctaccacctgctaggatgtggccttgagcaagttactatacctctttgggcctcagtttcccctttgcaacatggaggaaataatagttcttatgtcataggattggggcaaagattgagttaatgtatgtagaagctcacaacggtgcctggcctgtgctgccagcccagcccattcttgatcccactttgaactgaccaaggcaggtggtgaatattatatgggtcataggacgtgtgattggctgattaaaaactgctattgtgtcagtccagccaggtttttttttaaaggcagtatagggatgttctagcccattttctgttgctattagcacaatatctgagcttgagtaatttataatgaaaaaaggtgtatttagcttttatctaactgggaagttcaagattgggcagctgcatctggcaagagcctcgtgccacattgtaatgtggtggagggcgtcacctagcagaggcccctgtgagatgggttagcagtgagcagggcatacaaaacagacacagcacaggggtgacgttgctttatagcaaccagctctcacctctcacaatagctcatcagtcctgagagmgcggccactcactcctgcggattcattccttcgtcaaggcggatccctcatgacccaaatgcccttcaaagctccctgtacctctcaacacagttatactggggaccaagcctcaacacaagttttgatggagaccaaccatagtcacaccacagccagagactgaggcatgtggtcccaagaggcttttgttcagagacagaggtctttaccgcctggagaaacccagggatccccataaatgtttagctgcttccctgagacctgcccagagtgtaggatcatcaagacctgggcccccctaccccgctcagagccctggtgggtggttggtgcccaggcaggcagtgtctgctrttggaggagagtgcatagctctccctttattgaacgtgtgtatttgcctcctgctgcagaacttgtctnagtgaacaaatgaataataaagatttggaatcccagagtgtgtggtgtgcagcagaccaggagcctagctggagagtgtggtgtgtacctggggcttccttagcgcttgggtctcagccaggctgccagaccttctccactttgaggtcaaatgtttatattccccacactgcagtcttactgaacacaaataatctgtggtataaaaagacccaaagtgggantgtgtttttctcagttactggaaaactgcatttaaatctggttctcagctgggggcagttttgtctcctaggggacatttagtaatgtctagagacatttgtgggtgtcacagccagggaagggatgttgctggcatctagtggctagaaaccagggtgctgctaaacatcctacaacacacaggacagcccctaacaccacagaattaccggagccaaagtatcaatagtgctgrggttcagaaagcctgctttaagtaaataaactggtttcttgttgcttatttacggtaaagataattcttatgcaacttgtcagtaaggttattaaaacaaaatttggtctaatgtgacatctacacagtaaactcatgactgaaaacaagggcacatgctgctgcattgaaggggcctttttgtgtgacagtccctacctgaggtctcagtgatgggtgctgttttgttcgctatgtcagatgaaatcagatctgatagggtacagccattcagcccaggtactgcctggtgggttcaagcaggtgcagcgtggacttgaatccctgtatgagtcccatgtaatgtgaaatggtgtttgttcaattagaccttttctttaaaatttttcagtagagatcaaagtaggcccaaatcatatagcaagattagagaatacttctaagcctagccagcagcacccagctctcaggagcccatctggttgtgccagctgtgctgtgacctgggcaggtcagccagcctctcagggacctatctcctggtctctgaagtgggcaggttgaagtcagtaactctctagctctacaatgctcttgagtctgtgtgtggtgaggttttagctgaaattttcacctggatgttgtctataattttaagttactttcttctgctttagtgtttaaaaggtcatttgcatgatccaaggtagatcttttttacttggtgaattcggaaggaaaatctctctggcgtaggtttttgagatgaaagctgagaacattggagctgactcccggagtggggttcatggcaggcaggtgtcactgtgtgttaggtttcctgtttatctgactcctagaatgaccctacagaagaaagtgagacccatagagtctctaatgcttgtgaagggctcacgtccatccgtgatactctacagcttttctgtttacttaataagtcacaatgttaagttggtccatagtgacatttcccataaaacagtaagggatgttttggatggcattaggtattgtgctgtgatggcggctaaagactgttaagtctgttccctgctgtgaagctggagactttttaccacccccctcgaggctgttttagtgaggcrctaagcatcccttatgccaccaggtccccagacagctctagaagataagacaccaaagagggtagctgtttagtgaatcgcattgctgttcagaaggatcagagagatgccaccccagcatttcagaccttaccatagagcaaatcttctgcctttaaatcaggtcaaagtggtgtggcaggaggcggtagtggcaaagcagctgaaagccacttccccactgagcccagccagccaggtgtattaacacaggtgacttaattacagctcgtggggccgaatgacttgctcagggtcataagtgatctcatgacatttggtgtagtttgacaactggaattttaagacactatatacatttactggatatggtttatgtgaaagcaggattaactagcaagacgagttcctgtttcctttcattggcagctatcatagataagtcctagtgtttgaattttattatttgacagataggacttctactagaaataaaatcttctaagatgttgccagtctctggtttctggtgagtaagcgctccatagggaaataagtgtatgaaatcttcctggaaattgtaaggcttgagagttccccaagctcagagaacagcatgaaagcatccggcaagaaacagccacgaggttgctaacattcgggcgtgtttgttattcctatttgtctttccttctctccacctcagtggcatcattggggagcgcctgccgattaggtattacctaactttcgggatgctcgccagcggagccttcaccgccctgttcggcttagggtatttctacaacatccacagtttcggattctacgtggtaactcaggtaagggtttggatccgtggctcaccatgtacggggtttccttggtgaatagggtggagtgtttatgtcacgtcacctctgtcaaggtgttgggaaggggcagaagtgcgtcctgtcggaagtcagggtcagctgacgtaacaaagtccttccctttctcttctgcttagaaattccagcaaccaggaggttttccttaatttcaggagttgcctcgtaaaraatgctgtctgtcagtgccccggcagggaractgacatgcagagcccttgggagtcactctgtcttcatgtggataagtttgaratgttttatcttgmgaaagatttgaccacttaggggttggagggtgtgtcctccagctgaagccccagctgcagtcaccctaacagcggtggcagggagttcccaccagggagcgccccaaaccatcccaagatggggctggttgggattccaamgaacaaagcactaaatgctgrgtgatcaatttaaagcatgtattaggggaacttacatactgagggctgcagtgtatggtcgcaacacacagcgggacagggcgttccacctaggtctgtccacagtgaggggttggcatatggagtttatttgagggtttaaggaatttggctcagggccagggttagtttctttccatgttttgggtcaacaactgaaacacctttatcagtgcctaggagtgttcagggaccaacttgggtccaagcctacaaaggaaaacctgcagctggttgggtcncagtgagaggaaaaagggggagacctgaggagtctacagagggatgcaagggcggaaggaagggccgactttggagttgggcagcaggagggggtgtgaggcagtcagtggagagaacaggagagatcatgaaggtgctagaaggggagaaggcctgaggacagcgcgcgctggctttgcccttggagctggagcccttccngaatctcctggcttctgcccttcccagcagtcctgtggatcaatattcagcagccgagggaagctgctgaaataatgatgctcatctcgggctttgtgatgcttctggggctccccagataggtcaggggaatgctataaaaccatcaagcagattgtatttaattttgcttttcaagattttgccataacacttgaaaaagtttggctattttaattacaaaagcaattcacacttgtgtagtaatatagaaaattagaagggaggagaaaacaattttccagagtcccagcatgtttctggagtgaaggcccagcccggtcagcccagaggcagcaacagttagaccagcggctcccaggcgtcttctagagcagcagtttccaacctttttggcaccagggaccagttttgtggaagacagtctttccactggggaccagggttggggagaggaggatggtttggggatgaaactgttccccctcaggtcatcaggcattcgattctcataaggagcgcacaacctggatccctcacatgtgcagttcacagtagggttcgcgctcctatgagaatctaacgccccgctgatctgacaggaggtggagctcaggcggcaatgcttgctctcccactactcacctcctgctgtgtggcccggttcctaataggccacggatcaggactagtctgtgcctggggttggggaccctgctctagagagctggcttactgcagtgaggtggtcagagctgccaggctggcccagggttggggaccctgctctagagagctggcttactgcagtgaggtagtcggagctgccaggctggccctggtttcgtgcagtcttgtagagccacccccgagtctcaagaygctagagcgtcctcagcaatacattccccaagtcccttcatgaaactcaagtcagggattcttcaaaagtgcagagatactttgtccaggcgcgaagtcaagttcgtgttcattccagagaatgattaacaacagtaccttctccatggcatggtaagggaaacatgcaattcacaagccatgtttatcatacaattctataaacagttcataaagagaagaaaggttttctctctttaaaaagtttgtatttgtttattttttgagatggggtcttactgtgttgcccaggctggagtgcagtgatgcaatcacagctcactacagccttgacctcccaggctcaagcaatcctcccatctcagcttcttgagtagcttggaccacaggtgtgcaccaccacacctggctaatttttaattttttgtagacaagggggtctctctatattgcccaggctggtctcaaattcctgaactcaagagaccctcctgcattggtctcccaaagtgctagaattacaggcatgagccgctgcacctagcctctttctatgaagtttttggattcaaaagagaccgggaagcttggccccacactgttatgaggtgtgatctgctggtggtggggttctggctgggttttttttcctygcttttctctgcttattctaaaatttccacaataggcatgcattgcttttattttgaaaaatatatagatacctgtatacatggttttaaaatatatatgtagtttaaactgtatataaatataaaattgacagtccatctctggctgtcgtgccccctgctttgtgtaagtggagcaagctctgtgcacctccctgcagcgctgtcccgggcctgcttcccacaggtcagtctctcctttggcctctcctgcaggtcatcaacgggctggtgcagaccaccggctggcccagcgtcgtcacctgcctcggcaactggtttggaaaaggaaggtgagaaaaagcagccctgtttccaatagcagatgaaaactagaccattttacttttagtttttctgtagactgattacagcaaaaacactttagtatcctctttaaaataagatggctgaaacctctggggcttgaattgctgaaattcagatggcctgtgtcccacgagacaggggagctccgccctcccactgtgggcctggtgaagtccgtgtcactcggcggctcctctgacagctgcatctggcctcccaggtgttgtgggagatgcagagtccaggaccctgccccaggccttttgaagccaaagctacatgttaacatgggagtttgggaagtcccgacctgggtcacccagcgcacagcaccaaagtagcagagctgggacccagcctggcgagtccagatttatttgtaaatggcttttattttatacagataaaatttatttatttgtaaaattcagctcagccaggccaaaggcttatttatggtggacgatcgcaaacaagatgcggaagctaaaacgggaacaccagcgtcatcaggtcttaagtcttagatactgtgcctcattcacctggtgtgtgcatccatgagttttgttcaaatgacagttcatcaagtgactgtatgtattaattgattgtagaggcacaaattttaatttcaggccttccaagactttcagggaaaggcctctttcttcttcttgagtacagaatgcgctcagagcaagaggtagaatgggtgatggcacagcctgaggccacataaacacatcagctctcgtgagcatcgcgagtccygcatggcacagaagcagggtctgcatggccccccgttgattctgcgccgactccctactttgcaggcactgctgcgccctgcactgctggactcgtttcagcttctcagctccatcttctgtcttctgttttgttgtgctgcaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacgtaagtgcacgtggccttggagaccacccaccaagggaggcctcggytttccctgcctgggtgggccttgggggcgagtgtgagagctgcgtggcctagcgccctgtttgcccgtggctgcctcagcgctcttcttaccagggagacttccccggggagccggttctctcctggttttgctggatttcctactctcccctgattctggagtgacccatgtccccattccttcctcccgtcctcctgtcctcccttgccccggcatcaggngttcatgcatgggagtcttccatcttcccacaggctgttccttctcatgcccatcttgccaccacagcctgaattggacccagtcagctctttgccttctgataagatatatcttggacagtgttataaaagactgacttaatatcttaactgggtaaaaagtatctcttggaaaatcaaatctcttattccatttcagattcaatagcaaactctttatttaattgaatttgaaattcatttctgaagtagagatccagcaggctctggtgctgagaagattcaggacagttacagcaagaatagagatgcccgggtggccctggcggtcacacgacaggggctcgaatcccgcaagccattctgataagctgtactcaactcttagttctttgactgagtttaaaccatatggcaggagacagctccctcatgctgcctgccaggtagggacactcagagccagctccctccagccacactgggcattgctgatcacttcagctctgcatgcaaaagttcatccatattccatttagtcgctcactttttttgtcttgcaaaagctaaccttttaatttttaaggtaaccatcatctggccacactgtgagtttggagactctcaccccatgcttctgtgttggtgaaaatggaaataaacattcagatgaggaatgtccagacacacccattggtgtgagcaaaaagtgggggccccgggctgcactccgctcccctttccccgcttctgcagaggctgagtaagccttcggccacaccccaaacagcctgagcaggggcctcctgggatgggtgggggtctggatccctcccagtgggccagcatgtggctttcagctctggctggtgtgtcactgcagttctgagaaaggccatttccaccacctgttttcttccgctctggttcctagaacctggagttctgtgcccctgcgctccaagtgtttgagacaccagccacccggagaacaatgtgcctctctttgttagcgcacaggggcccctgggtgtctcctgcctgagggtagagtccatggggtcttctgttctcttccttaactggaaaggggctggctctggggagaaaaggacatgtggaagggaaaggagcttgctcaatggccgggacctcagcacccgctccaggcattcacggccctatgttgatgtttgtctctgtaagcagagagagctcagctcttgtgaataagcctccctgatccaatttgggcagatagcaatgagccagatgccccctgtccctgggtcctctggccacaggcccactcacctacaggaaggctgcatgcttcatctctagccaaacaaaaccaaactaccagaacctcctgcccagggaatctttctgacactctttccccttgtgcctgggaggtgcactgtgtctgaatgatgagacccagctgtgacaacagtggctggatgctgagtctgagaacaggagctctttgcagatagggaggaaacatcaagtgccccttggtttgtttctgcccctccttgtcccgaatcactgatcctgggcaggtactaaaggcatcagatgtgccattcttgcggtcaacagaggatgtggctttctctgctgctccttcactcttgtctcctgcccagggtgagccccaaaggacagggcgtcccctgctcctttctcaggcctctctgagtctcctttctgaagctgttctcaaatgtgtcccagccaagggacgtgtgtgcccaagtccctgaaggtgaaagtccaggaagagccatatcaggggaagcccctggcttacccctgggggcatcacactgtgagtggataccgatggggtgagttggctgatgtcctttaaattggtgaccatacatcacaggtggaccattgggactgcccaacatgcmgaccatgtgtccttggtcagtggcctcgccctatgggctgtgcccaggacaggagggcgacgcaccccacagccagccacggacctctgggtgcagacccacctggccctacggcatgttgataataaccttatcaacaaaacccagacaagaggtttgatgctggcctcgaggccagcaggagtgtgctcggcagctgcatgtccctctatgatgtcaccctgtgttgtrtgggaatggacttggctgtggggagcctgcagccctgtagctcagtttgggttgcaaggcagtaaccagtttcatccaaggtgataaagagaccaaggtgcttggtagtcagagggggctgcagaggtggagcgagaagcagtagggctggtttcccgcagcacctagaggcctggggtctgactctgggttcccgcattgctcggggcaggttgctggtgtctgtaaaggacacgctgaagcctcacttctggttctgttccttttcaagtttcctcccttccttgcatttacacaaagatgtttgttccatatcaagatagatgttttatctccactcatttttatttctaatgaatttcataacatgaaatacctcattacagacattcttccagcctcgctcccctgatgtgcttttcctggttttgcttttcttctggggcttgtcctctgaatgagagtcgtgggcttgtccacacagcgtccgcatgctctgcttgtgattattggccacgctgggaagtattttccatatttaaagtagcgttcacgttcacagtgttggcactggctggcggtgatctgccataccccccttgcacacaagtgggctgccaggccgagtgactggggacaggccggggcrtgtgcgggagtcactggtgggacagccaagctgtgcccttgccctcacctggcatgctatggcgatggcttttttctgaaacgaatgccaatttagtaaaggtataagatggcatcttgtgttttattaaattttattgtgtatatttaaggtatgcaacatggtgttacagatacayagagatagtaaaaaggttactagtaaagcgaagcaagttaacatagccatcgcaactcacagctgcccgcttttgtttttgtggcaagagcagctcaaatccactcatttaatgtgaatcctgcatacagtccagtttcacacccggtgctcccntgttgccctgtcctcgggttacgtagcttacttggcattgccatggtggtggacctgctcagcctcactcatgtttgctctttcagatccgaacgacgtcaggtgctcctccaccctggtgacggtaaggaccctgttttcttgtccttttctagaacagtgtgcggttctgaccacttccccagcctgctcctgcctgtgcggtgtcagacagaaacacacagggtagacagaagtcccaccctcaaaacattggcagttctaggaatagagaatattctgttttgggtttcgctgataataaccttatcagcaaaacccagacaagaggttcaatgctgtccagatgaaggacttcatgctaaggggaaccaaaggctgggccctggccaggcctcctcaggagtggagacctcctggtttccccaggggcctcagtgtgacggggaaaaacgcacgtgtcagctgcctgccatcacttaagttggtggctgcacgtctcaggtggccgagaggtctgcccagcacgccattccttctcttctgtacccctgcccagctcagccagcgtaggccctgcaggcaggattgctgaccacgttggctgccatgaatgagccctgccctagctgcctccacccgcagccagtcaccactggccactttcccacctggctaaggccagccctcccgcggtaccggtcccctccctctcatggcccagggcttgactcccgcagacacaccccccgccccaaataccattcctggcacactcatgtagtattggtggctgtcttggaagaaagtccctctggccctcatgcctgctcccagccgccccgctccccatgtccactggcatgacacccctcctgtctgcaggccaccgccacctcacgggaacagcccatcagatcccagcaacgtcacccggacrcatagggtggtcagctctctggcctcaccctgctgggcccgtcgcccgcgtctgacccaatgcttccctccctctgggggtcagctctcttccctccctctgggaaaggctcccctacccgggctaacatgttagtcacgtctgtgcckagtgtcagaccccagatgtgggggtgcccccaggctgccctgcggcctcctctctccttgtctgcccgctcactgcaggagagcgcgctcgggcctttcagcggctccaggtgcgttgatgtcgagtcaccatgctgtccccagagtgacccacccctgagctccgcaatctgaggtctcaccaccactcaaccttcccacggagatgtctgagtgtccttcagacttaacacgactggaggagatctcttgattttacccctgcacaagccgatcccccagcatcccccatctcagtcaggaagctgctgtccaccctgtggacaggccagacccgaggagccagcccaacaccccctcccttcagccccgcaccccatccttggscatgttctgtcagttctgctctgttctgtgaggggatgtggaatggaaaccctctcacctcctccgcctctaccaccctggtccccgtcaccaccgtcagctctcctccgagccactgctcatcagcctcctagaacgatccactcttgctccccagaatctcttcttcacaccgcacttgcagagactgtattgatacagacgccagagcacatcagcccttgcacaacacagtccagtggctccatgtcgccccntgtgaaatcctcaccagtccatctggttggtctctgtcaccctcacagaagggtgcgagcccctcgggcctggatcatcactgggtcccggcacctggggcagcacctggcctcgtgcgggaggggggccagagtcctttttctgtcttttcatacctcgggctcctgggtgtgattcatatggaaagaagggttctgatacttgatgacaaaaacaaagaaacaaaatgaagtttgaaaaccagtgccttcaggaaggtcaaacaccatatgatgttcttaaaactatggttgatattttaaaatgttttaaaaagccrtgttcctgccctgagcatgaatttcagtttccaagcttgtacagtcgtgccgtgaagtagcttaaagctgcccggaccagccgtcttgagactggggagaacttcgcacacaccttccgccctggaacaccttctgtcctctaagaagagcttttctcacccaggggcggccaggcctgaggataggaagcaggcgtgcagggggttttggggaggagcagctcttcctcacacacagcttttaggaatatgagagctcatctaggcgagaggcattgcttctgctcctcstgtgtatgagtttggggctgaagcctgtgtttcattctccccgttcaaatcctctccgagcagttcactgagatctactggtgcccaggtgtccccgacgtgccctgaggcaggtggtccagagaaacagcttctcgtcctctctcctctccatgttggctggtcgcagagggagagatggctgatatctggggatattttatcagcttctgcaaacagccccaaagttctttttcctgcaggaatgttacctgctctgtgcaggacaccaacgagacccttgtcacgggccttcctgagggagctgagggcagtttggccaatgtcccatcagctgctgtccttctgtagtatcttccctttatcacaaatgggagcttttgggcaaagcaaaatgcatttgtaagagatttcagatgtgctgacttgttctgggaagttcccatgtggaagtgttatttttaggataaaattctaattttttccaatattttaaagttcttgttatggagactttaaacatataaaaaggtaaaaataacagcataacgaacccctgtgtacccattacccaagtttccaacagttggccaatctgactctatcaacgccccttctaatactatcccttcccacctcctgctgatgtattttgcaagcaaatagcaatcatcttaatattttgtctctgactacttcagtatgtttccaaaatataaggactcttttatgtgaaacaaaatgtactataccattatcacacttaaaaaccaatggcaaagaatagaaaaacagtagagaaaatcaatgaaaccaaaagttggttctttggaaagatcaacaaaattgatcatcctgcacctagactgaccaagaataaaggaggactcaaattaccaaaatcaggaccaggaaaggtggcatttctgccacatttactgaaataaaatggattatgagggaactatatgccaaccaattagaaaactttgaataaatggaaaaattcatagaaggacagaaactaccaaaactgactcaagagaggaggaaatctgaatagatctaaaacaagtaaagaaattaaattgttaatttaaaaacttcactcaaagaaaatcccaggaccagatggctttactggtaaattctgccaaacatggaaagaagagctaatactaattactcacaaactcttccaaaaaataaaagtggggggaaacttcctaattcattctatgaggtgttatcgtaataacaaaagactaaaacctcttaagaaaactgtacaacagtatcttttatgagtgtagatgcaaaactcaatagcagcaaccagaattcagccacctacaaaaggattatttaccatgatcaagtgggatttatcccaggaatacacagytggcttaacaggtaatgttaatgtaatacaccatttgaatggataaaggacaaaagctgcatgatcatctcagtagaagcaggcaaagcactggacaaaatccagcaccctttcatgtgaaaacactcaacaaactaggaatagaaagcaacttccttgacctgacaaagggcatctaataaaacccacacctcacagtgtgcttaatggtgaaagaccaggtgctttccgcctgagatcaggaacaagactaggaggcctgctcttgccgtttctatttaccattgtaatgcaggcaggccagttaggcaagaaaaggatataaacggcatgcagattagacaagaagtaagactacttctctttgcagatgacatgatcttttatacagaaaatcataaggagtcctcaaaaaaatggttagagtgaattaataagttagcaaggttgcagaaaacaagaccagtatacaaaaatcaattgtatttctatacactagcagtcaacaatccaaagatgaaattaaggccgtttcatttacaatagcatcaaaaaacattacgcgaagcagaagaaaccagtcacaaaaggtcacatattgtatgatttcattcatatgaaatgtccagaataggcaaacctagagatagaaagaagatgagtggttgtcagggactagggtgggaagaaaggggggatgactgctgacaggtatgaggtttctttttggaggtgatgaaaatgttctcaaattgtagtgatggttgcaaaactgaatttaaaaaccactgaattgtgaacattaaatgagtgaatggtacagtatgtgaattctgtctcaacaatgctattacaaatttttaaaatctataatcctttctattatcatacagctactcaatggtcagatctgctgattgtcttataaatgattttgcactgtgtttgagcaaggcctaggcaaggtccactccttctgattggttaatttaatgtgcctcttaaggctcttctaatttataggacctcaatggttttttttgttttgttttgttttgttttgttttgtttttttggtttggtgttattctcctttgaattgcttttgtcaaaataaaaaatggtcattttttctaccaagtttcccacatttgaggctttgctgaccttgtacctggggtgtgtttcacgtgttcctctatcccctgtatctcctgtaaactggaaaccttcatctgatccagatttgatttttctaattagtttttgtttcaaatgaatcacaattaatatgaaagagagtattcaattctttaccatttgccttgagtctgagggtgctaataagaatgtgtctctttatgcttctgccctgtgctattgaagagccatgggaacttgttcttttgatttgtatttgattcctaggttacttaggtttaggatatctattttgtgccctaatctaggacctcattgggtccaaaaccctgtatcagttgtgtcaaaattaatgtttttattaatatcttcagattagttggggttgtgttcagcagcaagcaatagaaaagcccacaggcagttactaaaacaagatgggaaggtatttctctcttctattcaagaaatctggagagagccagcccaggatgatgtggggtgtgcgtgttgagtgtcagggacacagactcctcttgtcttttcgttcttcccctgtgcatggcttcatgccaaaggtgatatattccaaccaattagaacagtgccaggcacagagttgatgcttaataattatttgttgaatgagtgaytgaatgattggtcagtggctgctggagctccagccattacatctgtattccagccagcaggaaggagggaaaggacattagggacaggccccttccctttcaggagacttcctagcatttcctaacatcatttctgcttagctgaccacatcaagctgaaaaggaattttaagataggctttgcctgagcacccacgttcctggctgaaaagcaggaagaagagggcccgggtgatgctggcagcctctgctcactgcgggggacggggggccgagtgctggggagcaggaacccatctctgcttctgcctggaatggtcggatgataaactggccagataatcacccctagcctggcaggctttgccctccctctgagcacaaaacaaatgtatttttaaaggtgttttgttacattttcaagtaataagatcaatagtttttcttaaccttcagaaaccttttcaggggaaatgcctcgaaatgtaaagggtgggatccaactgtccatctgaacggagtttaacccatgctctgtcttccccgtgtttcccgccttttggaggccccatagatctctacttgcagatctcacagttagcgtgcaagcctggtggtttttcttctcaaatgcatccagcactagtgccagaaatctaaatcatctgggcctctctaagccttagaaattgttttgttatcatttatactagagtgagtgaataacatctttctaagtacagactgattccttattttaaaggaagtttgtttggactatttcatcaacaaacaacaacattttaccactggagaatttcaacaattatttttataccattaattatcttcaaaaggggttctacatagagccctgtagaaataatgattaggaaatggtacctttattctagtgcccaagaaactgccttcatttcttcacttttcacttggtaacaggagataattttgaaatgattttgagttttggagtgcatcagtgcagtccttccacctccctgccctctagcagcaggtccacattctggggctgttgagcaagccacactctccttccctagagacggttttttttttttccttcagaagcattcggctgacctagggagggcaggtgttcctcacatgttaaagggaaagattggtctgtgccttttcatttcaaaaccattgaaacaatctcacggccattcagaaaagttaagttggcttaatgggtatttttacatttgattacacctctgtcttagctctttcttcaagagaggattttatgctcacattctattatctgagagtctggagtgttgagatcaaccattattctgtttaaatcagttgtcttatgtcctcttggtagcttttttgggacgatagtaagtatccttgctacagtaaagccaggtttaatttctagctgttgaatcagtatcgctctaatgaaacttttttttttaccagcactcaaaaggctatgagaatggtacaaacagattgagactccagaagcaaatcttgaagagcgaaaagaacaagcctctggtaagtcacacacaacttccacttcctagaatgtcggagctgcaggaaaactcctttgagccacgtcggctctctgtccctctgcctatgtgacatgtgtcacaaacatccaggtcttaaaaaaattctgtctcattgtatttcttcagtaaaatttgagtttgcccttattggctttctttggattttacacttaaccagttcattcattcagcagctccgcacctttcaatgtcccaggcactattccaggtgttgggggcggtgctggtgtagacggaacgcaggcagagacatcccccaagcggtgccaagcngcaggaagacaggctgagcaggctctattttcagctggccttgggaggcttccctaggcaggcagtgttgaaacagagctgtgagggactggagggagagtctgcaggtgcctgagcacagagggtgtcagggtgaggggcgcacggtgggctggccacgtgaggtgcacacagaaaactgacatcatgggaccaagaaaagggagaagcaggtaacagaaggaggcatctccacctcccctatgtcacagatgaggaattccggacacagaaatgctaagttaatctgccttgtcatccgcggtagcagggaggcctcagtgcaggtctggcccacccctagcacctgagcctcctgtgccctacccttcccatcatygatccttgtagaggctcctcacattgctgctgcttagctgaccacaccaagctgcagcgggcattttaaatttgagtttaatcattgaagttataagctgttctctttctagatcaggtttttgtttgtttggttggttggttgkttttttttttttttttttttgagacaagatcttactctgtcgcccagtctggagtgcagtggcatgatctcggctcactgcaacctccgcctcctgggttcaagtgattctcctgcctcagcctccctattagctgggattacaggcacccaccaccacacctggctgaattttgtatttttttagtagagatggggtttcaccatgttggccaggctagtcttgaactcctgacctcaggtgacccacccgccttagcctcccaaagtgctggaattacaggcttcagccaccgcacccggcctctaaataaggtttaaccttctacagcagacacagggcctctcctctgtcagaaagacccctccagcatgtgtaaggggctgctctccctatctttttaaattaaatagcttaaaggattaatgtactaaacatgcatctcacttttttattgactgcagaaatttatttgtagtggctgaaatattagaaaagggaagaatgatgtctcgtgcatctgggttcttggattttagggagacagtaggcagtgactaattcaaccaaaatgctttaaaatctgtacttacttctgaattcacatttaaacaaatcatgtcccagtgtccaaaaggctgtcacccctctctgatgatactgaagcctgccacttcttctgaatcaagaccacaggccctttcttctggtgtagtaactgacccatagaactagccttggcttctaagtatagtttctctctttccttttccggccctctaagaaaggctgtttacagacttgccatcaaggagccagttatgtaagtaaaggcactggcaggccttatttcaggctgagggtgacgaccacaaccgggcgcatgctgacctcgcttacgtggcatcccctttcggcyggcctgccattgctcttgggtcagggtaggcggggagagtccccatgaggttggctggacaccctggatgtcccctttcccagagtgacckctgggctcagtggggtgtcacccagcccctgacctccactccttttcagacagagctgctacactatgtcacgtagcaggcagtttctcagtggcctcttgaagagacatgtaaagaaagctggggggcggggagcaaatgtgggaaagagaatgaggcgctgctgtcacttggccacgtggcgagcccgcaggtccccgcgggcgttttagaggattgtcttggggacggtcgcacttgccatccctgtagtcacttgtcacttttcctccttgacgtctctgaggatccttctgattggctgtggctcaagaactgttgggcccaccaaacgcggcgtgagcacggagtgggtatttggaggttgaatgtgactccaccgtgcactttgcacgccaagtggggactccacaaatctctcttgtgatggcctttcccaaagggaagctgcagacagcatcgggtagcggggtgagcttagcatttttagataaagcgatcgttattacgcagtccccccacatgcgtctgtgtgtatttttgttgtgtgtgggggcattttagtagagggaacccttttctctttgaaagtgtaagccctaagcgtggagtgcactggccacagaagcccccacacccaccgggggctccacagatccnatttggggctcttgggacacagactggaaactgcttgtttagaggcagaggtgcctcttggcctccagccttgtcttggtccacccagtggcttcttgtttgctatgtaaggaggaggcagcagcagccccctgtttgttttggaaaaccagccatggccccacactctttcccatctcctccaggagcaaacaactcaggtatggtggctacaagtcctgtttaagatgagtggctgtgagcacagggcccgttctcagcagaaacagagccttctgtctgtctcgggggctccttgctgcttagataaggagcagagggtctgtgtctgtggctttaaaccagcccagcaagtggaccctgaagcactttacaaatcctgcaagggccgtgggcggcctttgggcatctgggtcctacctgaggccaagtaggtcttctgtgttgacctgcggtcacttctctgcgggtcagagggtgcgcttctcctggctaagcggcctcgttccgcttgacttttctccagctggctgcatttcacccactgctgagcctgtttcctgcggaacggcctgtgaagtcctgtagccctcagcttgctatgagtggaactcgcctggggctgccccagggactgcttccgtggggctgggggaattcgaggcttctcaaagccccccgaggagattccagtgcttagccacagtagagcattactgatgtagttttctaaactggacgattagcagaattcatgagagaaaagtttattcagaaactcaagtcgccattctttgctttcacgtgccgtgatgggattatcatcgggagcatgttaggcatctgcactcagccttgtcatcttcattccagagcacctgactatgtggccacatgtgaatatcttcatcagagacccgctctccatgccagagtcctagctgtgaagccgggcttcctggggcacgtagacgctgggctgcccccaaggccacccactgggtgcccacactgggctgcactcggtgccacctgccacccggtttccaaatgtctgttttccactggaagagaattctaaatattctaaatatcaaggggcaggggaatgtggaatacattaccattttcttttttttttttaattaarctacatttttagtccaacttataacaggttatagtgagataagtaccacaaagcctgtttgattttgtgaaaggtcygagatacctagaagcatttctttgtaagaccttgaacctcatagctcactcatgaaraatatttttattttattttcattcttttttgagacagggtcttgcccgggctgaaggacagccgcacaatcacagctcactgcagcctccacctcctgggctcaggtgatcctcctgcctcagcctccagagcagctaggactacaagcgcataccaccacattccactatttttttttaggtcttactgtgtggcccaggctaagattatttttatgttatccttgctctgacttgaaatcccactctaggttggggaatcactcttctttgctttaatgaatgtacactttgtcctttaggaacgtctagacaatcagaattcataaatatcagaataggtgtattttaaaataatgttggtgtattttaaaataatgttatttctggtcatatatggccattgtgaactcctaaaaaatgcaggatcatgtaaagaatttcttattagcatttcgataaaaattacacataattccaccactcgctgacaaccattgttggcttagattttagcttctttctttctagaaatagatcctatagttgcctagttacatacgtagatatttaaacattctttgaggttataatgacatgcagttttgaatgatgtgttatttaatgtgtcataagcattttccgtcattaaaatctcccaaccttttttttacaagatgtcattcgtatggatgtatttgaattttctattttttctcaatgatgatgtgacatccattttactttataagtatctttttacttttcaaattattttttgccaatagattcctagaatttctggatcagaggatctgtgtacctagccgttcatgaaaatgcatgaatgctaatcattctaacacagtggccaggtgggaatgtcacccaggatgtctccaaggcagtggaagagagagccgccaggcaccctcgtcattaggaagcctggccccacttcacccagactgcccggctggtaacacctttcctttttgttcccaatggatttgcctccaggacccagagatgcagtgcctgctgctctcagatgggaagggctccatccacccgaaccacgtcgtcattctccccggggacggtgggagtggcacggccgccatcagcttcacaggggccttgaaaattccagtaagtaaacgtgcccaggaggagtttcagaaagggctgctgtgctggctgtgggaagtctggtcggttgatgattaagcttaaaaagacatctgtggttgtagaacccggggattcgaatccatagccaaagctagacgctgcacagtgctagcttcaggactgaatatggctgcagtgatatttgttcgcctcataccatgtttaaattttttttgaaattcgttttctccatttagaaattcrggttcatagaaaaatggggctccctgccttcactggaaaaacggaaagcctggcaccctgggcctgcccccatgtgacaggttggggaactgaggccctgactactgtgccacctggcccctgtggcccggcccctccccagtgcacttgccctcccacaggccttgagcgtgagcccatgggaggcgctggcactgagtgctgcgccgtggccttcgcgagcccggctggattctctttccctttaaagtgcctttaggctgggcgcagtggctcacgcctataatcccagcactttgggaggccgaggcaggcagatcacctgaggtcaggagttcaaaaccagcctggccaacatggcaaaaaccggtctttactaaaaatacaaaaattagctgggcgtggtggcaggcgcctgtagtcctagctactcaggaggctgaggcgggagaatcgcttgaacccgggaggcagaagttgcagtgagccaagattgtgccactgcactccagcctrggtgacagagcaagactctgtctcaaaaaaaaaaaaaaacmcaaaaagtgccttcagtgccacagcccgtggtctgattgcccgtgtgtgtgagcagaggatgccaagagtgagggggaggatgcagggaccaagggaagaacgagtagcacaggcgggagaagccctcagaagctggaccgggctggtcctcggtggtgctgctggccttgcctccagactagaagggcgtgatcagcgggtgatcagtatcgggaacaaggtgacttggagcagatgagcgggaggggcactgtagggagatttcttgctgctttcagtttttattacattgatggactctctcagcagagaatctaaggagctgtgcacagggtgtggagacactgtgttcttccgatgggggcagagggctgagagcaggggcgtgggagggagaccagaccctgctgtgtgggctgggcaggctgtccagggtgggctgtccagggggcgctgtccagggtgggctgtttggcggggctgtccaggccgtgctctccagcactgacagccacagcaccagggagcagacacagctctcgcttgttgacacaacctagagaaaggcagagggccaggggcacaggcccgaggcccctcagcaggtcagggctggaagtataaacaatgcaacccagacctcaaaatcatatcacagaaattaaagactggggagaaccttggcttcagaacagaaagtattccagtgcccaggagaaactgggtctgcagaggtggaccctggagccagtgttcagccagaggagaacgtcccagcccagggtgggcaccagcttatggggaaagggctgtgcatgctggcctgtggaagctgctgggtttaagtaaaaagatttgtttttaattgtgtccttaatgctagtgaccttttctgctgtaccttcctctgtagctacccccaaatacttgtacnaaaagtagggtgcacactagcataaaaatacaggtttttatatagtggaggtatagacagtatgggcttcagaggtcccgctcaagcctccccctgccaccgccaggctgagtgttcaggcaagtgtggcacactctgagcctccatgtcctcatctgtcacacgggttccatccctggggtaataccatatgttgttctgaggatgaagtgaggtcatttaatgacaactaagcacaatgccaggcccatgaaaggcatacggtaaattacacgtacacatcctcatcaactgtgaagacntcaactcgtttcattttagaatgacttggcaaagtagagcgctgggttcccccggcccccattctgattgatttccagtgcacagacggctgggggattcagtgccacantgttactggatttctcactctgaattttcagatggcatctggaatttttatctcacaagtgccacctctttctaaaagtagacataaaacaaacacaaacaggcattttacagaacccaccactcgatttcctcactcatacctacgtgtctcttttcactgttttccctgatacggactggtctgtagtactcacaaggcgggatgcggtagcctgtacgcctgtgtgctgacacaatggtcggaattgtttcatctgtgtgtttccaggtggcttgataatgtacaatgatttcagttccagngaagaagaaggagccattcgatactcagtccactgcacccggctatacgagaactcttttaatagctaagttttccaggcgatgtagtntgaaaatcaaacccgtccatgtttgcattgactcgactctgatgtaaagacactgggttttgatcctgaactccatttcgaaattcagaaacgccgtagataaacagggcttcctgtcttcacttgaaaagtagaaaatctggccacgctgggcctgcaccccatgtgacagtggccgaggagctgcagctggggccncacccttctcagaggycccrcccctccctggtgcccctgctcggggtgagcgctccactgttcccgcgtcctcactacaccacacagcggtgcagcaccctccccagtacgtgtctggaggtgctaaagccagaccagagacaggatgtctttatgggagcgaagtcatatttaactctgttgcatgtttacacacacctgctgactccacatttggaggagacgcctgactgctctctctttcagggcgtgatagagttctcactgtgtctgctgtttgccaagctggtcagctatactttcctcttctggctgcccctgtacatcacgaatgtgggtgagtatccacgctagaacacattaaattccgcacagtgactggggtccgaagtctcttctgtctgctggtttctagagtattgaaaacacaaggtcatgaagggtgatttgagaggtacacctttgaataaagtactatgatgaaacataggctaaaagaattcagatatgcacattgtattgccataatggtaaactttatggggcttcacggttgacacgttctatcccagctagggctaccagttcatgaggtacttcctgttctggggcagcctgcgtttaaacgtgggctacactgaactttggatcatagcagccagtgagcagaagcagagcctttggggacctgagaaaagaaatctctgatactctgacctggaaatggcttctgggagatagcgtctcatttttggcagggccgacagtttgctttatgtttcagaagccccgcagtggctgcagctatagattatcagaaaacgtgccagtgaaatagtaacatgccccccccatgtcatgtgtgaacacaggacagacaagaggagatgaacagtgcttaagggaaggagccgttgagtggggaaattggaaccctggctgagaggmagcggggatggtccaggagcacgtggagggctcttygccccgggagccagagagagcgagaggaaggagaagacacacgctgggccgtcagggaggggcagaatccggcnatgtctcaaagaggaggcctttgagaatgggggaggctgaggancacagaccacctattctggggatgcagatcccaccagaggaggatgctggcagcacgaggctggagactgaataccctgggagggaagttgaggaggcggtctggggactgtcccacagcctagcagggacagggcctgccccaagggccagtgactggggaggcagcaaggagcncccttggatcctgaggttccttccctgccttgtgacccccgcctcactttggccagtgagctgcacacagctgggccttctttctcccttcttcccctgtggttgcaaaaggggtgacgttctcaggacttgagtcttgaactgctgacatttccagtctgtttgaaaaaagcaaaattttctgtccatgccattgatgattcggaacggctgggtttgacccacagccccagatgccgtgcagtttcctctcccacacccggctggctcagtccaccttaaagcccagaacctgtacaaaacctcatggagggcaccctgagctggtgccgggaggcctctgtgtcctcatctgcagttctaaagccgtgtgacaggatgatcgagcatccaggcgccttscacacctccacttctgtcctgtgttaatctaactttatggcggaggggcccctgggggggtctctgaaccaaaggtgggataattagactgagcagaggaaagccacggtttttggttaagagtgttttcatcctttctgtgttacttgttttttaaatctgagttaactactaattgctcctcggtataaatcaagcttatgaagccagagtcccgtgcacgggtcctgttctgccatggtgtgtcgctgcgatgcgtgaaggagatcctcactgtttcacactccgttgtcatttcaatagatcaccttgatgccaaaaaggcgggggagctctccaccctgtttgacgtgggcggaatctttggtgagttcattaagacttgttctgctgcaacaataatttcgcaaggcgcatgatctctgagttgattcactgctcaggggaacagggttccccaaggtctcatatcccctgagtgggcccagcccaagagggtcaggcygtcacctgggggtggttttattgtctcccgtccctccccagggccctgactctgcacttgaacagcttccctcagaaatagcatgccagctggactcaggggctcatgcctgttatccagcactgtgggatgctgagttgggaggatcgcttgaggtcttcttgttatgaagaccaacccrggcaacataacaagacccctctctacaaaaaaaaaaaaaaaagcwtagctgggtgtggtggctcgagcctgtggttccagccttgggaggctaggatgggagaatggcttgagtctgggaggttgaggctgcagtgagccatgatcatgccattgtgctccagcctgggtgacagagtgagaccccatctcaaaactaaaacaaaaaaagcagcagcatgtctcctgggcaggtgacagactggccaccttagtaccttgataggtaaaggggcttcgaggctggcctaaaacctgaacctgcagatgtctccaagactctcacatctgaccacaaccaatggaggcctgtggggaggtcagggctgtgagaaggctgcctgcccgtgatgcatggagagaggggcttgggaaaggaggaggccgttctccgagctcctgcagttctgcttcctccccgtgggctcatgccctgggacgtcagtgcctgaagcccgcctctccgttgcaggtgggatcctggcaggtgtgatctcagaccgactggagaaaagggcctccacctgcggcctgatgctgctgctcgcggcccccacggtcagccgtgctgccttccctgggccccaaagcctgcagacagtcccccactgtcctcctcgccagccagcatccttccatctggcccgtgctccactttcctgacaagcccncttcattccctctcatgcctcctgtcccccgacccctcccttggcacctgcaggcctccaccaggctccctctgccacgtgcacagctgctgctggtttagcatgggcygcgcgcaagctgctcctctctttggggtgcccccttgccccagacaagctcctgcccatcctttgggatccgcaacacctccccaacctcttaggcatcgttgacacctcccgtcatgatgcatggtgcatagtgcttttcaggcatttcgtagctcctgaccttgggctgtgacacccccctctatgccccagttccctcatctggaaaatgggacgtcagtatcaccaccttgcagtgggttagaaacaatgcacatggttactgtttttatcatcgtaacattagaggtaacaggcttgtcagtggacgctgtagctctgcgcrtctgcccctccgctagccccagaacaaggcctggctttcagccatcttggggttctggacatggcccaacacagaacatgaaagaatgctgagtgaagaaatgcttgggtgggccccttgctgccactggggggtgggcagcctgaggacttggcagtcagactngcaaatcaggagctcaagaaggcagccccttggctgggtaggagctcaggaaggctgcccttggctgggggtgtanggtgggagcaccctgcagacttccccaggtcgcctggggtgcttggtccaaagccctcgtggtggggacaaggctcagtacctgagacrggagggggcgtggccgtcacgcttttttaggggtttccactcttgggatggctgcctgagaatcacccgccgggtttttgagaagtagatttccagcaatctcgcactgcttgcagccagccatggctttgaccttgtgtcttgatgtccacagctctacatcttctccaccrtcagcaagatggggcttgaggccaccatcggtgagtatggaggccttcctgcttttcttccacacacgtttttaaagttcacacagctggcaagatgaaatactaaaatcaacaggcgcattgagctggtttaactggagcacatggtgtggctaaaattgtccgtgtcctcctttgggcaagaccatctggagaggccggggtctcctctccccagtgngaggcttgccattctgtgggtttcactgtgagctggaagtgtgcaagcctggtctggggcagtggccctgggcactcagtggagaagccagatgtgaccttgagggcagcccctcctggggccttggtggggctggcggggctgcagcagcctgcgacctgccacctgcaccctgcacccctggtggtgagagcagctcaggctggctcttgggccacgtcaggtagccaggaacctggcggtgtgacctgaacagggtccggccaggagccagggcaggtggccccccagccacctcctcccagctttgtcagctgcccctccaggagcggttgcgtaaccttggaggactattttgaacaccctgcaggcagcgctatcaaactatgcctccagcacttagaagtatgctttctgtcctaatgagccagcagtggggatgtgtggtccccttaaatgttatccagaaggcagcttgcccacaggagaggaagcggaatttcctgtgaccccccctcaggccagaagcttcctcacctgagtgtgagcctagaggagagtttaggaaatgacctggtccggagagagggtgggggtctgccctcagcgagcaccacagcagctgtgggtgaggagaggaaggcctttctgctgcagatgaagcaggggtcagcccaggcccagggtccggcctgtgatcgctccctcatggtggcagctgctgcccttcgagggtggatgagcctgagtcttagggagggtatgatttgctttagctcctcactagacaagtttagaggaagctgtttctgctgcatcccctccctgtgctccccaggcgcccacctcaggctgctcctatgcatgcggggctctctggagggcacatttccattctttgcccctctgcctcccacagccatgctgctgctcagcggagccctggtcagtgggccctacacactcatcaccaccgccgtctccgccgacctggtgagtagaaccgggagagacaccagccctgtgggcaccctgccatgtgccattcatgacaaaagtggcctccattactgttagtaaaactgcatttgcagaagcacgtttttggcagctcacctacacctgtggtctccagccttcccgcacctgycccsctgctcacccttctcctaaaatcatgggcaggttggtgcaaaactcaccgttcagcacaacaaaaggctcttgggcgccatcctcatgactcaggcgccttttcaatccaagggggcaggggagaggtcctgtcctggacgcctctgcagagagagaggggccacgaagaggcgctgggggattcggcccttctcatccaggtaccatgccctgccttggtcacctttgtattggacgtgtcctgaaactgcctgagtgtgcgtgagcatgcagacttgtgtctacatgggcatggaaaattctggaaggatccacatcagaccattagcaatggtcagccttcacggggtagaggcagaggagagactttcacttattttttagacttcaaaatacgtaggttctggatgattttcatattgtgtgttctttattttatatacatattacgtgcatatacaagcatttatttttttgaacgctggttcatttttatagttttaggcttctaggcactgtttcccctgatctttttcccctcctattgtcctcattttggcttttttcccattgtctatgcaacattttcaaaaccagagctcctggcggctgctcaccgaggacctgcgccagccttggtttctcagctctcccctcctcccttcttcccctggcgtttgctattgatcaggttgaattttaggtcctgcagagacatctgacaggggtcccaggaaggccctggctgtcgaggaatccagcagacacgtggatgtgtctgggaaggaaggccggcgcagctcagggcaggggcgcgcgttgcgcaccttcacgcctctcacgctggctgctctggggcctcagggaggagcaggactgtgcggaacaaacgttttttatttgaagagaatcctaagagttcttgtaactagaaccaagcatttctgatgacttttgactcttaaaaacccttgaagttttaactctccaaggcaagcttggggtggagtttaaataatgggaaacaccctcacgatgagttgttttgcagagcagtttgagtaaatggtcatacagaggcttaggtttacttctcatgctgtggcgataactgcacgtctgttttycctctcttctaggggactcataaaagtctgaaaggcaacgcgcacgccctctccaccgtgacggccatcattgacgggacgggctctgtaggtgcgcagagagttttagctctgggaggtttggtgtcttaggggaaatcacattgtcacatgctcgtgaacaggtacccagggttccaactgcatctataacattgggtgggccggcttcttactatacgagcagatgagcaggggacatcggcacacagagatggtcacgcatgcctgggtggcttsagagagacgggcgtgtgactagctgtgcgtgtccaggttttcacccgaggcagtggttggcaaactacagcccgtgggctaactcaggtccactcattatttatcgccttcatctcaagaaaggcagaatcttatttaaattacagaaaaaccaattggtccaaaatcatacagggttctgagtgttaccagcatcgtcgaagctcttgaagagaattcagtggcatattctggaatttaaaaaggtggcagaataagcaagccatccccttagggagcaggcaggtggagctggcagagtgccagtctcctcgcccatgtgcagcctgacggcacggctgtggccttccctgagcccttgtatggggagcacgcacagtggctgcacctgccaggcgaaaatcaggagttgccacacctgccaggtgaagatcaggagggtccttcctacatgggggacgttatggggggctgcctggtgtggctgtcacagctaataaggaggacctggggtgccaacctgtgtgtcasttgctgcgtgggggtctccagtaaagccgagtgtttggtagatgaaggtggctcggtagacccaggtcagccagaacctggtgctggagccttcccactggctcgtgcagggagctgatgttgytcttggctgcccctggccttggtgccagcaggctggaaacatcacagcacgtttctgggtgcccactgctgtctcagtgatgcagaatgcaaagccctcccgccacatggcctccctgctgctcctccgaaggccaggctggcccccgtgcgggctctttgctctggtcacaccccgtgcctgggaaggtccccacaggtgacctcgtgccgcactccctcgtgccgcactccctcgtgccgcactccctcgtgccgcactccctcgtgccttgagtctttgcccagatatcatcctctcagcaagacttcctgggaccaccctgctgagaacgcgtgaacccttccgactcggcctccaggcccctctcccgggtctgttctctggagcgctctccccatccgcagtgggattcggtgcactcctctgttttgtctcctctgtctcctgccactggaacggaagctccaggaggacgggatttgcctgattctttgctgtatcccagtgaactgaatgagctgctcccagacagttagaatcgcagccggggcccaggcggctgactgcacagtgaggagccaggccggacaggccccaggcgcccccgcccagccctgggtggcrggaaccccagctccacgctgctgctgctgcgtttccttgttctgcgtttccttgttctggccttgttctgagaagcggcgggcagggtggccgttgccatgtgacacacggcctgattctgagaagcggcgggcagggtggccgttgccatgtcatgcgacacacggcctggttctgagaagtggtgggcagggtggctgttgccatgtgacacacggcctggttctgagaagcggcgggcagggtggccattgccatgtgacacatggcctggttctgagaagcggcaggcagggtggccgttgccatgtcatgtgacacacggcctggttctgagaagcggcaggcagggtggccgttgtcatgcgacacacggcctggttctgagaagtggtgggcagggtggctgttgctcagaaagccacactttggcttttgctgttcaccaaagtgagaccagaccagcctcgtctctgcccttcatgttggttccttcctttcactggatccagaggggctttgagtgtattgggtggcggcagtagtcacccctctgatcttctgtcttgggcatctcagtaggaagtcgggggactgcggggctgagctcagttctggttgacgttgtgactgcgtggccttctcttggccttgtgcctcagtggactgcagtctgcaattcggtctgactctgctgtgaaaccctgttcttaaagctaacttggcgctctactggcaaccccgattgctgttttaaaagcagargatcagcataaaaaaagagaaggaaatcatgaactaggtgaaaaaacacatttttcttcatattctcaaaatgagagggaagcagaagtctgtggctaagggtggagaccctgcgtctgtgaacagaggccactgcccaccactgcccccaagcaggtggagggaggcacagttctgaatgcctttggcccctcacaaggaaggtggcacacacaccggaccccctctggccttctgttaacctgcaccaagtcctgactgtccgcggagctgccgcgcccaccttgatggctgctgcgttacaccagaggcaggaccaggacctgactcctccaggctccactgcccatcagtgcctgctgcctgctcagtgaatggtcaccatggaaacggcgctcaggcctacccacccccaccaccacgccttggtcattgttccttccatgagtgagtgctgcccagcaagacaaagtacaggctccagtgggaaggccaccatgtcagccaagtcccttcccgaaggaggtgcccgcatgcttattcagtgtcactgtccactccttggcagtgactcgggtggaggcgaaacatgactaatcgtaaatcacccctgccttctcccaagtgccacacggtttgttgacacggtgtgcgcctggggcgttcacagtgcttagaatcgcagaggttgccgtttctgtacatttcatgcagagcaattaaatagggcactgcatttttcttcaagttaatttttatttattaaagtaaaacataatgtaccttagaagcragacagtcctacaagcttattatgttgtacagcggcgttccgtccccctccccagccctctctttctagaggcagccaatttcagctgcctctctctgcttacctacgtatttccatgtttcttggttcatcatctgaacgtcatcagctgtgctcctcttacngaagaggggacctggctcccttccaccccgacattgcccacccctcctcctcctcagttataccagccatgcttctgcccttcactttccagccaagaaacaaactttaattatgcaccctcaatagatacatcttgttttttcccgggtaagtaaacatctcttttcctctttttcacatttccgncaaagttcttccttccctgcaccgtggtcgccatcctgccctgccccacccctttcacgccatcagcctcactccgcccactgcgcggcttggccccagagcacctgtcaccacggtgctgggagtccccctcctctcttgcctgcgacacagccctagcagtctagacccctgtttaccactcctgtggtggaaactggctcctagcagcttcctgagttaggggaggtgggttctgcaagcttacaagtgcgtgatggctggattctgctctcgcctgaggcaatgtggacgtggaaacaccttctcttcagaacccccgtcttccagcctccattgctgtcactgacacgttcacagacattctgaccccagcccttgctttctgaccttctcttttttctcttagatctccaggttcccttccttaccccgggagcctttcttcatccaccgtcctggggcacctggtggcaccttcagtctggaaacacctgcccttcactttaggggaattgggcccctgttcgtttgmtaagttttcctaccattttctgatttgttttttctttctggaaaatgtattagtcagatgtaggcttttctggattaatccttcaactttcctttctttctttcccttcctgcctgtctccctgttctttcttacactttctcagggagattcttgactgtattttccaactttgtatcgaccattttacttttcctgccatattttcaatgtttactgatgtttctctgccctttcagtgcatcctgttttatttcatgttagactgaatcatgtgaaattgataacaggttttcagccacacacacacaaaaaaaaaaaaaagagtgtgtcctgaggttcagcttagtcttctgttggctctctggggggaggttcaacttagtcttctgttggctctctgtgggtgctgtgagctctgggaatgttcttctcctccaggctccctcctgccagcttgcttgctttcacgttggggtgttccccagacacagggcagacctaggttgccccttcatcacttcccatggaagaaggggccctgcatagtggtttgaagtctctctgtggggacagtgtgctggctgctggtctccaggcagtgggaccctgcggaacctgcaggaggagactccttcagtgcccaggggagcctgggtccagctgccaacatccttgccatggcatggaagcttggtggaagctggtgtctttccccagatcccctgtcgcctgttaggtgagcatccctgtcctgcactgggcttagtgtccccacgggttaagctgcgctgtcctgcacgggggcytcaggaggagtctctttatcagtgaggatgagaaaagagacctgggatccgaggtgcggcagagggaatgtagctaacagtttgtgataaaagactcaacccatgcaccttttttctcttgctgacccccttccgttcccactgcgttcctccttccttgccttcccctcccctgtctcttgggctccgctgggcctcgctctgctccaggtgtccctgtgctgtctccctctgaggatgctcagtggagcagggaacactggaggctgtgttagctgtcagcccttctgtgtccatcttccaaaactacgtgcccttcggtgggaggwtttatcatctttagaagtcagtgatggngcagttcatgttgcttgggggtgtggagataacacatgagtagccgaccatgtttacctggaagttctgagaattaaaaaaaaaaacatacaattgctcctgggattataaaatagtaagtgcactttgtgaacacttgaaaaaaacaagtgcctagggcntgaaagaccctggttatcttacctctcagagttgaatatgtcagttcataggttggtggaaattcttcatgctttttcccatgcatctaccaaaacaggccatcctacatgtgtatcagaattcatttcagtccctcttggtaaaatgcaccagatgctacaaaacacattcttaaacagcagtccttgggcatttagggggatacgttatttgttttcatcatttaaaaacacatcttgacataatttcagactttgagaaagttgcagaaatagtacaaagaattcagacattttagtacatgtggttcatcatgcaccygtgtttttacacacacacatgcacacacacatatatgcacacacacatgcataatttttctgaaccacttaagagtaagatgcacacatgctgcccctttcctcgtaactattcagcatgtacttcctaaaaacaaggagttccatgacagaccacagtgcatgatcagaatcagaaagtgagcattgaaagaatattagtatctacaattcttattcaaattttacccagttacatttttatagcataagaatatctaagattgtgcattgaattcagatttccttacgtgtactcaagaaaataatgggagtgttggatgaaaagaatgaacattgcaatgtcaacacacatttttaggatggttctgggaaaaggctgtgccagctctgccttcccagtacggaggcgtacaggtggagtatccttatctgaagtacttgggaccagaagtggttatgtctttttattttttcagattgtgggatatttgcattacactggttgagcatctcaaatcccaattctgaaatgccccagtgagcatttcctttgagtgtcagcactcaaaaagttacaaattctrgagattttggatttcaggttttcagatttggaaggctcaacctatactaggccttgtacccgctcccaatctgataggccaggatgaggtagtgtagttccatatgtgttcctttcattgtgagtgaggtgttgagccccattctctgtggctgctagttatgtgctgggattttctctaaacagcaccatgtgtgtccatttgcctgatttcaggagcagccctgggccccctgctggctgggctcctctccccgtccggctggagcaatgtgttttacatgctgatgtttgcagatgcctgtgccttactggtaagtcggcctatttttagtccaatccaccttgaatgcagatctctgtggttgtgtccaaacactggtggaactttctcccatgcattcctgagttatcagagaggtttgggtcttcccatcttttctaaatatgcgtggtctaaagctccttctctctctgattagaaaaagtcagaaacagaagcaggacagtcttgctctgcagccttgggcgggatagcacaaaggccaggagcgtggagctccgtggctctagatcctgcctgtcacctgtcatgtgtgtgacttgggcaggtttcgtaacctctgctccacagtttccacagctttaaaatgggcatgataatggcacccagtgacaagattgttgtgggaattaaagcagatgatacacagagcctggcctcccagtggtcatcagtgtcctggtgtccctcctgcagccatgctgtcagacggcgggagcggccccaacttctttcacctgaagggatgggagagaataaaggagcaaagaggttgccagtgcagacactgagtcgccttctggcttctgcccccttttctctgggctcctgcttctgtgccctcctgtgttgagaaagtttgaggttttcccctgggtaaggaagaccagtgatgatgtcacagtcacatagatgtgcagctgtgaggggtgcatacacatctttacaagtcacctggccacaaagtccccagacccacagccatgcctctcctctcacttcaccagacaaaaccttaggctgatcccaataaaaatgagttgagaatttcagaaatatcaactcactcaattaaatgaaagtcttatattttaattccaggaaattctaaaactcaacttccccaccacatacaaaatcaaataccractctcaacctatgaacttactaggtttaaatggctgttctttggatcatctgtgggttcttttaatgcctgaatgttctaatgaagcctccagatggatttccactaagtagcagtaaaattcctgtcattacaactgttcagagaatctgaaatatcttctttagaactatctggtaatatatattgaaaattgttttgatgcttagccaaactcataagaaagtaaaggaactccccaggagccagaattgtaaaggcaatataaatacacaagctcaggaatcaacgggttggggtggttgtgcccacactgggtaagagacaaggcgttaggctggcacaagatgaagatttggaactggagacttcgtcatagagccaggaccctcgaagagccatgcttgcagtgaaagagtatactagatgatatctgcacactggcacaggaagacaatgggaatctgcccatcttagccagattagggggaagaaatctcccttgaaaatttttagccatagacctccccacagtcagctttaatctttgagcttatataaatatattttaaatgagcaaagttggtccttaggcagtaatacagaagcaaatagggacaaatctcaaccctgcagcataggatttctgtagctaacaccctacaaaagatgagctcacaatccaaaataatgaaacataaggaagcaatccacattgaatgacagtaacagacataaaaaatggtggaattggactcccccaaaactgcagataaaagagttatgtaaactaaaaataaatatatgcaatgttactaatgacataagaaaaaggaactgacctcatgaaaaaaagaacaagacactattgaaaagacagagcaggcttcaaaaacaaccaaacaggagttatagaaatgaaaaatgtgatctttagcctggaaaaagactcaatggatgggttagaaaagcaaattagataccgctgaagagaagattactgaagtgaaatatagatatgaagaaattatccagaattcagcacaaaaagagagatggaaaatattagagagaaattaaatataaaatggaggaccaaatgagatggcctaaagttatctgaaagtaattccagaggaagatgatagactggatttgaagcaatattttaagacaaaatagctgagaattttccagatacatgaaagacaaacattcttagattcaggaatcaaatgacttagaattctgtacctagataaacttgcacacaagagtaagggtgaagtgaaaacatttttaaccaaagatgctcccagcaaaaattgctaaacaatgtatttagagaaggaagatagatccagaaggaaagtctgagatgcaaggagaaatgcaagcaaaaamaaagtgatattcctaaggatgaatctaaaggagtattgaccatataaaataggggccagctaactgtggcctatttttgtgtgatcctccagctgggaatggtttatatttttaaatatgtctttaaaaaatcaacaaaagaatgtgcaacagaaaccatatggctgcaaagcctgaaatatttactatctagacctttacagaaaaagctttctgactctcagtttaaaacaacagcaataatgactaatttgggcaatataaaaaagaactgaaatactgaaaatgtaaggtacaagtgggacaatgagagttccagtacactgcagttcttatgttgtcaagccaatagcaatagaatgtgtaaccttcaaggcaatacagggaaatgaagacttaatctaagagaacctagggtcaggggaagcatagaaaaaaacagggtaaatacagaaatacagagcaacatggatgaaaatgatcccagcatgccagcaacacagtgacaataaatggacttaaactcatcagttaggagcagagattgtcaggttgcttttaaaaatacaggcactggttatttrcaagaaacacacctgctacactggaattccgaaaagacaaaagtaaaagaatgggaaactacacgacaggtaaataataaccagaggaagccggatttgctgcgttggaagaaagagacctaaagctgaagcacttgggagacgggggcttgtcgcagtggagaaggaactataccaggatgtgcagcaggtccgtgagcttgagttgggcttttcaaacctaagaactagacatacctttttctcttcactgatcaacatgctttttggtatcttttcaccaaaatagacaagtgtttcctcccgagtctggagctgagaacctccatgatctgagcaggtgtcctggggggccagagggcaccatgcttcctgcctcacaacrcacactgatggccagctccagggcctgcaggactgcctggcgcacgaccgaaggcctcaggtctccagtgcgtgtcgcctgggctcctggagttggtagggcccctccttgttggtcattcttgcatgcgtgagccaaacacgtgggcatgttttgaaattggatctctgttcttcagaactgtcaccatttacagttcatcccgtacccacagataacacttgctactatattcttcatctttttctctcttaatgatcagcttttcataatcataggcctcttcgggctagcacttttcatacatcacacttggcaggatgtagatgtgggtaaggtaccagctcaaacacaataagcctgtgccggtagttggagctagaggttcagattcacacagatggatttatttaacaaaaatcttgctattgtcaccagcactattgttcgtacctgccgtgttcccacgacctttaccacctaattgtcgcaaacacctttcatgcaccaagcagagcagctggatgcatcttatctgtaggaggggcccctgttctctccagcttgaactcacctcatacaagggactcctaagctcctacttgaaccacaagcacctaagaaaatagaagagtttctgccttctagagctctggcctgaggcttggtggtggggccatgtgtttggtttttaagtagcccctcgagacyctccagcaccccttccctgcctcccctggaccagtgatccaccctgggtctgagggcatctgctgccctctaagaacgaggggccacgtccagggagagccctcctgtgggctgatgtcccacttggggagagactggatccacactggaaaatgcactagttaaattggaggtagcacaatcatttgtctggatttgtaggctggcgttgagccctcaaacatgtgaagggcacggagttaaagctctgggtccggcgaggagccaaggctgaggcagtgatgttggtggaaagccctgggccccggccaggcctggcctccaaggggctcccagtggggtgcggctgtcctgtgacagcctcttcagaccccagggctggcgccagaggaagtgctcacctggctttagagtcacctgagaagctcgcaggtccacccactgggccacccgcattatggtcctcttgtctttatttcctttttcccactgtggacatttcatgattggattaattttagtctaaacgtgacttgaacccagaagtagttcaggctgcatctctcccaaaagccttgttttcagggcagctcctggttcttcgtgggccttcatcagacagccctgcccwcatcagacagccctgcccacaggagcccaggcctccggctgagcatgcaagccccgctgctcttgcagggaggccaccccagggaaggtgctgtggggagagagccacccgcccaggccttgcgggccaggtcctcatggtgcccacggcgcgggccgccctgtgcctgctccagtaacaggtgggctcacctttgttttggtgcagttcctgatccgcctcatacacaaggagctgagctgcccagggtcagctacgggggaccaagttccgtaagtcccactcgggccctgtctccgtgcgtgaaagccggctccaaagtgccttctgtcctatctgccttcygcacctggctttcctgaaagaaagaaaacgcgtggcttatcttttcacggcacgccaccttcactctcrctttttctttkctaataaatacctcyggatgggttagtggtaatctctcctcaaaccctgagtggaaaatgtgagggaattgccgtctttggcattctgttggagctgcagccccccgagctctccttgccttcctgctcgcccccttctccctccctcctcttttccctccccccttggtcctccctcgctcccttctcacttcttcctggcccccagaaggctgcgggaaaggtgcaagggtttatccagcatccagcacccctgcaggagaggaatccctgctgggccgggagggcagctggctccccatrggatttgcacatggtgtgtgaagttcagcatctcttgctgagccactgctggctgttagagcagctcttctttcaacctttctttcagatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacytggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgtttcggactgacctaaaaactaattgtcgagaagccaagggtgaggaggcaggaagcacctccggttggaggcacccaggcttgccagccacagagcgccccaaagtcaccgtcatcccagcccctggccttcctgctgccctccggggccatggcactgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaaytccaattgttctctggctgtttttttcagttgtgtctagcaaaatacttatctgccctttgaaataaaatgtttttgtttaaaaaatctcagaacactcagagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcayskstgckcttgccgtcctgtggaagcgtggctctgcctgtcacgcacgtctgygcttgccgtcctgtggaagcgtggctctscctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctgaaaaaaaatgagccctgatttattattattcaattcaacagacataaaaaccactctgctaaatggccacaggaccactccagtcttgactcagcagagcacagctgggccaggtgagaagcaggtgtgagggcactgtgtcccttgcaggctgtgcccacaaggcacccaggctgtcccccacagggctccgatgcgccaggtcacctccattcccaaggctccgcattgacccacagtctctgcacaggacaccccaggtccctggagggcagtagaagaggctgtagcactggctgccaaggcaggggcagctgccaggcccaccagagaccacgggcagtaggcaggtcacttcccagggtggggggggggctgaggtgggagcacaacctaggcccctcctggggaggtggtggagtcagaatcacgtaagagccaaagttccagtccctcagtgccggctccattgtcccctggacttcccttacaaaccacagatgcaaagagagcacttctcagaatctccacacagccacggtggagcactcaacccacgcgaccctcgggcgcaggtgctgggtgactgccctggccatgtgccctgtggcccgcagaatgacacctcatccaggatggaagcgggaaccaaaagcctggctgagagaccccaggggcctgagtcgggaggagcgatggttcatttggaacccagtggtgcccttcactgagtttgggttaactgtcatcacttccctgtcccgtgcgttccaacgtgccctgcccctgagaacagatccaagggactctgaagaacgcagtcctgagctgcttgctcattctgaagccagctcttgttgctggccccctccaagggggcctgtgagctccagacatggggataatgtggggtctgggccacccgtagtggtggccaagtgcagcatgttccccgccacaccccttgggagctggaatttaactccagctgctgaacacaggcagtgtttctggcacccagggcctcaccctcccaggagagtccatcattgctgagccagtcgcaggtcaccatgaagcatcgccctgggcagcaagtgggatgcaggggcacagcagggcacgtcccaggcggctgagaaagtccacggagggcaagggcaggggcgtgcgccatcgtcggagacagtcggggtgggcagcaccctggactgctgggaaggacagtggggggagggtggaaggcaggggagcccttgccagttgagaatttcttgatccttggaattggtccccaacatcctctgggacacgcttaacaatggtcaggtctggtaactgaaagaagcaattgaggtaaatatctcaatcaaccgaggtttattctgccagcgttagggcatgtccaggaaaacacaagccacagacacatctgtggctgtttttctaaagaggcttacaagaggtttggtayttagacattgaggtgaggtgaatggtgacattcttgtgagacttcagttagcacccagtaaatctgcatttcacataaggtaaatatttgaagaagaaaagggagcaaaggaggaatccattttgcagacttctctgggtaggtggaggaacacttgatctcgtcttgtctttggcctgcccctgggaggacaagcttgtaaaggacattatcagcatagaatggaacagactctcattttaggagctggacttacattgcacacctaaatttatgattggcatgtccttgtttatgggaggccagcaaagaatgtactgatgaaagatctgtgggagcacttgcagacggctgtggcctccacctttctgtggggacctggctgatgtatcctattcatgacagctgtccatacggatgcagcgttgcatgattctcactccaggcttaatcttccctttggcataagaagtttgggcatcctgtgatttttacgcccacagccacttttttttttttttttttttgagacggagtctcgctctgtcaccaggctggagtgaagtggcgccatctcagctcactgcaacctctgcctcctgggttcaagcagttctcatccctcagccgcccaagtggctgggattacaggcacgagccaccacgcccagctaatttttgtatttttagtagagacagggtttcaccatgttggccaggctggtctcaaactcctgatctcatgatccgaccacctcgacctcccaaagtgctgggattacaggcgtcagccaccaagcccaaccagccaggccaatttttgaccaaaacaggatcggtgagtggatgtcatgtgtcatttgggccaacagtgaacacggactttgaaggcatcttgatccagaatattccattcccttcttccttgacttggtaataaccaagacggttctgtctctctttgaaattctaaaatgaggcaggcattggacattctgttactgttaaaatccacaccctgcctgcctctaaaaggaacttggagtggagatgcagaaaaatggcaggtgcgtttaaggagtccctgcaccccacgacgaagtgacagccacacccagacatcctggagcccaaaaggaggagctagtggctctggaggggcagcctctccgggtctcaagggctattattattattttttttttttttttggaactgaggtgacatttacataacatgcaaataatcatttcaaagcatacggtcggtggcgtctggcgcattcacagtgctgtgcagccaccagctctctcaaggtcaacacgtctcatcaccccagaagatcactagaacctggtaagcgatagctccccttcccctcccatttaaaatgagagttttcaaggagattgggtccagggtggctgtgagcactaaaattctggagcaaggtgaaaaatagaccccacttctccttccatgctaagccactgattcattaaagaaacacagggaaggagcctatactcaaaattagcatctccagtggaaacatggcttgagaattatgcgtccttacggaccagagaccaggcctccaagaattctcccaggaaacaaatgtccagcaggaccatggctgggctgtcacgtccagaagccaccaggccacagcaggggccccggcaggcaggccaccgtcggaagccggcaggccaccgtcggaagccaccagaccacagcaggggccccggcaggcaggccacggtccagaagccaccaggccacagcaggggccccggcagacaggccacggtccagaagccaccaggccacagcaggggccctggcaggcaggccacggtccngaagccaccaggccacaggaggggccccggcaggcaggccacggtcggaagccaccaggccacagcaggggcccccggcaggcaggccatggttggggctgctttggcctctctttcccttttgcaccagctttcaataaggctttcttcttccacgtccccacgaccccttgatcgtccacctgctattggcagcgaagccttgaggctctcatggtgtgtccccacatgtccgcagacgggaaggagtcaccccagcctcctggggcagcaggatgcagcatatctgactctcatcacactttctgtatctcagcaagttaccaacatttctttgtatttacttctggtaagaacaaaaaccttagctggggccttggctgcccttggagctgctgggaaagttacatgagtagaagggttgggttaaagcatggaaacacctctgtctacaccagctcacgataagcctgaagaggagtttggagtccctcagacgctttcggcaccacttagtcagcggggggaataatagctttccgggaaataggcccgagacgcgggaagggaagggaagggaaccccgtgggaaagaccttactcattctgccccttgcagtcagcacctgaggagaagcagcggggaaaagaagtgccaagctcgccgcgttgaccagtgtcagggccgagtagccacaggacagaactgagaagcgagtaccaacatcaag

SEQ ID NO: 10748 - DNA, 48460 bp, Homo sapiens
  misc_feature (1)...(48460): n = A,T,C or G, or insertion/deletion polymorphism (see Tables 1-2)
gtgcaatggtgcgatctcagctcactgcaacctctgcctcctgggttcagtggttctcctgcctcagcctccagagtagctgggattacaggcacgtgccaccatgcccggctaattttgtatttttagtagagatggggtttcaccatgttggccaggctggtctcgaactcctgaccttaggtggtctgcctgcctcggcttcccaaagtgctaggattacaggcatgagccaccgtgccaggccctaattataacatttatatggaagtaataaagggctatgaatacccaaggctttcttggaggaggaagaagagaggaggagaagggggaaaatgtgaggaaaaaagggtgaagacttgccctagaagttattacatcttaatacgctgctagggtgattaggtctgtgtggtatttattcatggagagacaatttgacagtagaatataacagttcaatgagagacccacacctatttagaaacataatatgtgtccagatgcgttggttcacgcctgtaatcccagcaatttgggaagccaaggcgggcggatcacttgaagtcaggcattcgagaccagcctggccaacatggtgaaaccccgtctctatcaaaaatacaaaaattagctgggtgtggtggcatgtgcctataatcccagctacttgggaggctgaggcaggagaatcacttgaagctcagagagggaggttgcagtgagctggattgcaccattgcacttcagactgggggacacagtgagactctgtcggaaaaaaacaaacaaaaaagacataataacaagtgatggtgaggatgtggagaaactggaaccacaatgtagtgctggtgggactataaagtgctgtagccactttgtgaatcagcttggcggtccctgaaaaggacttttttttttttgaggtggagtctggctctgttgcccaggctggagtgcaatggcgtgatctcggctcactgcaacctctgcctcccgggttcaagtgattctcctgcctcagcctcctgagtagctgggattacaggtacgcaacaccacgaccagctaatttttgtatttttagtagaagtggggtttcacaatgttggtcaggctgatttcgaactcctgaccttgtgatccacccacctcggcctcccaaagtgctgggattacaggtgtgatccatcacccaggctggagtgcagtggcgcaatctcagctcattgcaacctctacctcccaggttcaatccaccacacctggccagttcctgaaaagtttaaatgttaccatatgactcaacaattccattcccagtggaatgttcacaacaccattattcattatagccaaaaggtgggaaatcccaaactgcctatcaaccaatgagcagataaacaaaatgtgatatatgtgatatatgcattcagtggaatattattcggccatgaaaagcagtgaagtactgatacatgctacagtatccatgaaccttggaaacctaatattcagtgacagaagccagattatatgaaatgtccagactagcaaaatccataaaacaaagtagattaatggttaccaggggtttatggggagggtgaaagggggagtgactgctactgggtttaagatttattttgtgggtgatgaaaatgttctaaaattgtggtgatggatgcacaattctgtatatatactaaaacccactgaaatgtacacattaccacatatcaggtggattacaacagtaagaatttattctcacagttctggaggccagaagtctgaagtcagggtgttggctgggccacgctccttctgaaaggtctaggggagaattcttcctcatctttctcttggcttctggtgttgccagcaatccttgaattatggccacataacttcaatctctgtttctgtcttcatctggcattctcctctgtcttctcccttctcttctcagtacacataacattcgatttagggtccacccaaatccaggatgctctcattttgcaatccttaacttaatcacattagaaaagaccctttccccaaaaaaggtcacatccccagtttccaggggtggacatacattttagggggccacctttcaacccactacaaccaccatgaaattaatgggtctttgtccatttttgtttttacacaattttttttttaactgaaggaccataagacaatgcttatgtcgtcttgccagtttgtaaaaaaaaaaaaaaaaagggtaacttcttgcccatttttctttttttttttttttttgagacagagtctcactctgttactcgggttggagtgcagtggcgcaatctcggctcactgcaatctccacctcctcggttcaagtgattctcgtacctcagcctcctgagtatctgggactacaggcacgcaccaccactcccagctgatttttctatttttttttttttttttttgagacggagtcttgctccgtcacccaggctggagtgcagtggcatgatctcggcttattgcaacctccacctcccacgttcaagcggttgtcctgcctcagcctcccaagtagctgggactacaggcgtccgccaccatgcccggctaatttttgtatttttagtacagacggggtttcactatgttggccaggctggtctcaaactcctgacctcagatgatccacctgccttggcctctcaaagtgctgggattacaggcgttagccactgcgcccagcctgatttttgtatttttagtagagatggggtttccccatgttggccaggctggtctcaaacttctgacctcaattgattctcctaccttggcctcccaaagtgctgggattacaggygtgagtcaccgtgcctggcctttttgcccatttttctattgtgctaatggaaggattctcaggttcctaataccttttgctcaggacaggactagaaatacaacacaacaatccataagttttttttttcttttttctgagatggagtttcacccttgttgcccaggctggaatgcaatgggtgatcttggctcactgtaacctccacctcctgggttctagtgattctcctgcctcagccttctgagtagctgggattacaggtgcatgccaccaagcccagctaatttttgtatttttagtagagatggggtttcaccgtgttggccaggctggtctcaaactcctgacctcaggtgatctgctcgccttggcctcctaaagtgttgggattacaggtgtgagccactgcacccggccaatccataagtttcttaattgaaaaagaaagcccacactcactctaggctaatgtaatcaatgatttataaaaatggccatagttgggccgggtgcagtggctcacgcctgtaatcccaacactttgggaggccgaggcgggcagatcacctgaggtcaggagtttgagaccagcctgactaacatggatcatggatcacgcctgtaatcccagcactttgggaggccaaggtaggagaatcaattgaggtcaggagtttgagaccagcctggccaacatggtgaaaccccgtctctactaaaaatacaaaattagctgggcacggtggcacatgcctgtaattccagctacttgggaggctgatgcagaatcgcttgaacccgggaggcagaggttttggtgagcggagatcacgccattgcactccagcctgggcaacaagagtgaaactccgcctcaaaaaaaaagaaaaaaagaaagccatagtttttatgagcttgttgatctatatctaggactacaaggaagatatgcatgctacagacatttgtacctagcagtaggtgctactgtaacatgtggcattagctttggactagaagtctggaaaagcagtggggaaactggtagtgaacactggaacaatggtgaggaaaactacgggaggtggacaaatggtgaacaactctatgtcacggtgaaggatttgtaaaattgttgcccttcagtaagatgggcagagaaaaaggcaactactgaactctgggacttgaaaaagatcatatcagtataatgttgagattaacctgtgtttcttttgcttgaatatgttgagacacttatagaaaagagtgtggttaaaaacaaacaaacaaacaaactggccagcagaatttagagcacactttgggttgaagctggggaaagtattattagacccaatagttggtaacaagttctcaaagtaagtcataacctgggccaaagatcaaattcagagtggcgctaataaaatatggccttaagaataatgctgaagtcaaggtgatctcaatgatttaaatgttaacaagtggctgggcgcggtggctcacgcctgtaatcccagcactttgggaggccgaggcaggcggatcacaaggtcaggagatccagaacatcctggctaacatggtgaaaccccgtctccactgaaaaatacaaaaaattagccaggcgtggtggcgggcgcctgtagtcccagctactcaggaggctgaggcaggagaatggcgtgaacccgggaggtggaggttgcacttcagcctgggcgacagagcgagactccgtctaaaaaaaaaaaaaaagactagtgggagtggcttcttgggcatggagagcacctgaatcagattcttgagaagcccataaagtttttaagggacttgtagtgaacaaagcaccaccagctgccaaaatgtggacagaacagtttagagtgaaaaaaggtctgtgggctcacaatttgctaatgacaggaaggaggttgagaaagtttctcaaagggcacattcttcaacatggccaagaaggtgctggaaaaggagggacacccaagagggcagaggcaagagctgtgctgagatacagcctggggagatactcccaggaagcagaactcgggcctggttaagacttcttattcttgtagggcctgaaaacatcttccagtaggatttcagaattgctttggaccagtgattactgtgtctcctcctcttctcattttcacatgcaagtatttattgtggttatctggtcccggctcaccatcatatattgcgtgcacgggagagaaaattaatctttttagtttgtaagtctctggatcaagaggagctgcaccggacaagccaatctaaaacagaccgtgagatcctagattttgtgcctgatgctgggattgtaagaggcttttggggatcttgggatgaacactggaaactaaccatagtttgggttgaaaatatcactacagttcggagattttaaggcatctgtggcttgtctaagtgcaaagattcagtaggcttacttctagcgacctcagacttgacgccacccgagacaccctcacccatgaccacatcttggacattttttttttttttgagagagagtctcgctctgtcgccctggctggagtgcagcgggggcgatctcgactcactgcaacctccgcctcccgggttcaggcaattcttctgtctcagcctcccaagtagttggggctacagtcgcacgccaccacgcccaacaaatttttgtacttttagtagaaacggggtttcaccatattggtcaggctgctctcgaactkctgacttcatgtgagccacggcccccggttcattcacttcttgaaggatcatttaccaggcatctagtagccatcatcaggtcctacgtctctccagctaccgcggaaaaagatccagaaccagccctaccccgtctagaggaaaggatgaacattaggcaagtacttggaatcgtgcgaagtgcactccatcagatcaccttggtgagtgaactgccaaacccgaaacaccgaaggccaccagccacaacccggagggcggtcacagcacctttcacgcatgctcaaggcaggctcgtccttgagcatgcgcggtacgtggggtatacgtcatctctcggcgtctgsgcctggcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcaggtgagggggccttggtcttggaacagggagaccaggctgcgggcgcgcgtcgggtcctggcgaccccgcttctcccgcaccgcctggtcgcacccactctggggtgaccccggggaactccgctccagcccacgagtcctccgccgcagtctcggcctggccgcgtctctgcgcctggagggtccgctttcgscgtccgctctcggcgtccgctccccggctccggcgcgctccttgcactagatggctggtctgcggtgttcttgcccggttagcgccgccgggtcgcttccggtctccgcggcgccggcggggaccgggtaggtagagcacgtggggcgacgctgaccagtcagcaaggcccggccgaacacgctctgcagaactgggaagaagcgggtctcgggtctccctggtgagaagggaggggcttactcactgcgagctcactgacctccaagcgcgctccctctttttgcagggttgtctgttccctcttcccggcctgcatccactcacctggccttaattgctccttagggctccaagtnatctccgacacttacccaacccaagggtgcacgtggagctcgcagtgcgcacctccctagtggcccttcgcacggctcgggttttgctttccgtaattttattctccttccttagtgtatcgccagtgctaggacgacgcaggggatttttaacttagtaaatgtttgttgatggaacagtcctaactcaggactctcggagcaattagtagtgctgtcagtttcagcccctcgtttcctttcccaggttatttgtgatttcatatttgaaacggacgacgtgtctgtcagatatactgtatattttttgttcgtttggttttagaaagccaattcgatgttaagttaggtctcacaaaaattgtactcagaaacccgtcacatatcccagatgattttgttttagagactcacggtctaatatctgccagagtgagctgtggatatattagacatgatttgcttaccttcagtctttgcattttgaggaaattctagtggctggtggagtttctgacttggaagacaagtccacggttccatatggaaagttttttggtgcactcgctttaaaggctataaatatgtacaagatacgtgccagggggtgaggatgggataaaccgaagtttaggttcagtatggaaaatgggtgattcttatgttggtaagtgcctggggtcatgggaacactttcaggtaggtgagatatgtttctaaatagtaatggctctttgaaatttgtatacagaatcccactgaacgctcaacagtatcagaacataatttcttttttttctttttttttttttttgaggagtctcgctttgtcgcccaggctggagtgcagtggcgcgatcttggctcactgcaagctccgcctcccgggttcacgccattctcctgcctcagcctcccgagtagttgggactgcaggcgcctgccaccatgcctggctaattttttatatttttagtggagatgggggtttcactgtgttagccaggctggtctcgatctcctgacctcgtgatccgcccatctcggcctcccaaagtgctgggattacaggcgtgaaccaccgcgcccggcccgtaatttcttataaccatgtcgcatagattttgtggtgcctaaaagaatagcatattaattcctgttgagtatttatccctcatttgttttactgaacttttttttcccacagaactatgcagtatgacrtactccaataagagattaagcaaataaagtttgttaactgttccctgaaatattgtatctagacagttttcttgtcaagtatacaacttttaatttaatgagtgtgcaaatattttttgttccacagagaaaaaaaatcaactttttttttttttttttaacaaagtgctcttttaaaaatcattgttaggctgggcgcagtggctctgcctataatctcagcactttgggaggctgaggcgggcagatcatctgaggtcaggagcttgagaccagcctggccaacatggcgaaaccccgtctctaccaaaactacaaaaattagccaggcgtggtggcagatacctgtaattccagctaccgggaaggctgaggcgggagaattgcttgaatccaggagggggaggttgcagtgacctgagatcatgcmcttgcactccagcctgagtgatagagcgagactccaactcaaaaaaaaaaaaaaaaaaaaaaattagggccaggcgcagtggctcacaygggccaggcgcagtggctcacacctgtgagcactttgggaggctgaggttggtggatcacctgaggttggggatttgagatcaccctgatcaacatggagaaaccccgtttctacaaaaagtaaaaattagctgggagtgctggtgcatgcctgtaatctcagctactggggaggctgaggyaggagaatcgtttgaacctgggaggcggaggttgcggtgagccaagatygtgccattgtactggagcctggacaacgagarcgaaactccgtctcaaaaaaaaaaawtttgttatttctctctaatgataactccttttaaaattattgttatttctctttagtgatgatgacagcctcttcatctatgactgcagtgctgcagaaaagaagtcacaagaaaataaagggtgagatgtggggaagctttttcagggcctgctttaatggttcgataatgggaccagagggtctaagaagcaattgttgtcctacttgctgaattcttagcttctgtcacacagtggtgcagataagtagcacctcaggagagacatgtaaaagtaacttttaggttaggcattaagagtacattgttggctgagcacggtggcttatgcctgtaatcccagcactttgggaggccaaggtgggtggatcacctgaggtcagaatttccagaccatcctggccaacatggcgaaaccctgtctctactaaaaataaaaaagttagctgggcgtggtggcaggcacctgtaatcccgtctacttgggaggctgaggcacaagaatcacttgaacctgggaggcggaggttgcagagagctgagattgcggcattgcactccagcctggggratagagcaagactctgtctcccaaaaaaaaaaagagtacagtgttagtgccgggtgcggtggctcatgcctataatctcagcactttgggaagccagggtgctgactgaggtcagaagttcaaagccagccttgccaatgtgatgaaactccatctctactaaaaatagccaggcatgctggtgggcgcctgtagtcccagctacttgggaggctgaggtgggagaatcacttgaacctaggaggcggaggttgcagtcggccgaggttgcgccaccgcactctccaacctgggtgacacagcaagactccgtctcaaaaaaaaaaaaaaaaaaagcacagtgttaggacttttctaaatacttttagtttctgtcagtaatcacatcttactggctccttgaartaatggttgaaggcgggtgtaggaagttaacttcagctaattgagatataaaagtagagcatgtgagtgtttcgtatggtggctttctttagttatcrttggtattgtggctcagtttgttttatcgttattattattttttgagacagggtctctctgttaccccggttggagtgcagttgcacaaacataactccctgcagcctcgacctcctgggttcaggtgatctcccgcctcatccccctaagtacctgggactacaggcacatgccaacatacctaatttttttttgagatggagtcttgccctgttgccaggctggagtgcagtggcgctatcttggctcactgcaacctccacctccctggtttaagtggttctcctgactcagcctcctgagtagctgggactacaggcacgcaccaccatgcccggctaattttttttttgtatttttagtagagacgaggttttaccatgttggccaggatggtctcgatctcctgacctcgtgatccacctgccttggcctcccaaagtgctgggattacaggtgtgaggcaccgcgccagggctgcctaatttttgtagttttttgtagagacgtggtttcgccatgttacccaggctggtcttgaactcctgagctcaagcgatcctctcgccttgtcctcccaaagtattgggggaaattcagccagatattgggcaaaattcacccccgatatttcacgtaggttcttttcaattttccctaagcgtcggccggtttgagaaataaagggacagagtacaaaagagaraaattttaaagctgggcgtccgggggagacatcacatgtcggtaggttccgtgatgcctcctgagccgtaaaaccagcaagtttttattagggattttcagaaggggagggagtgtacgaataggtgtgggtcacagagatcacntgcttcacaaggtaatagaatatcacgaggcaaatggaggcagggcgagatngcaggaccacaggaccggggcaaaattaaaattgctaataagtttcgggcaccantgtcattgataacatcttatcaggagacagggtttgagagtaaccggtctgaccaaaatttattaggcgggaatctcctcatcctagtaagcctgggagcgctatgggagactggggcttatttcatccctacagtctcnaccagaaganggccacacccaagggggccatttcagaggcccaccctcaggggcgcattctctttctcagggatgttccttgctgagaaaaagaattcagctatatatctcccatttgcttttgaaggaagagaaatatggctctgttccgcctggctcaccagcggtcagagtttaaggttatctctcttgttccctgaacattgctgttatcctgttctttttcaaggtgcccagatttcatattgttcaaacacacatgctctacaatttgtgcagtcaacgcaattatcacagggtcccgaggtgacatacrtcctcctcggctgacaggattaagagattaaagtaaagacaggcataggaaatcacaagggtattgactggggaagtgataagtgtctatgaaatcttcacaatttatgtttagggattgcagtaaagacaggcataagaaattataaaagtattaatttggggaactaataaatgtccatgaaatcttcacaatccacattcttctgccatggcttcagctggtccctccgtttggggtccctgacttctcgcaacaccaaagtgctgagattataggtctgagctaccatacctggcctgttattagtattgttaatgtgagtttatccctgcctctagccttgggttagtccttgcccatgaggaagagggccatgtgtcattgagggttcttccagcttagctctctgggttctggcatgtatgctgggagattttctgtttagttaggcttcatgctgataaaattagagctgttttgaacttccccatgtccctttaatatgtctgtattttggctacgtgatccccttaacagtttctacctcctcccatgttagaaattaccacgctggccaacaaggaatgcagccttatttccttaggtgaagcttaaccgtcttcctcctctcttcctcagggaggacgcgcccttggaccaggggagcggtgcgattctggcgtccaccttctccaastctggcagctattttgctttaaccgatgacagtaagcgtctgattcttttccgtacaaaaccatggcaatgtctgagtgtcaggtatgagatgctaacgctggattcttaagatgtcgaatgcacaccttatccttgcatgcctgtagcaatartgaccataacatggtgataagggtgataagtggttgacacrgagccgcagttcagtgccagacaccactttcagtgccacatgtgtgttggctgatctgatcctcacggcagttctgggagggtgcaggggtgctgttctgtcccacgctgggtggtgaacagttagrtagcagactccgatcagtgggctcggaagacagagccgggccctgctgctggtccctccacctacagtgttggtgcccctgttttccagggcagtcctctgtccttgtgattagcaggaacaaggctgtgagcctgccctggagagtgatagggatttggggtctgttgaggggtctgtaccatagtattaagctaggtgggtttagtgcacatatgtctgagtatctgaagagtggatggggagtggatccgtggggatggggaggccagtaactctggcaagaacgggagatatcgctatgccttgccctcttacttagcaaagtccggaaaggttcttctgccttccctattcctccttttttatttttttgagacggagttttgcttttgttgcccaggctggagtgcaatggcgcgatctttgctcatcgcaacctcgacctcccggcttcaagtgattctcctgcctcagcttctccagtagctgggattacaggcacttgccaccatgcccggctaattttttgtatttttagtagagatgggatttcaccatgttagccaggccagctcttgaactcctgacctcaggtgatccgctggcctcggcctcccaaactgctgggattacaagtgtgagccactacaccyggcctgtctttaagatttttatttcatcttttttttttttttttttggagaagggtctcattctgtcacccaggctggagtgcggtggtgtgrtcttggctcactacagcctccgcctcccagtttcaagcaattctcccatctcagcctctcgagtagctgggactataggtgcacaccaccatgcctgactaatttttgtattttttgctggagacagagtttcaccacattggccaggctggtctccaactcctgatctcaggtgatccacccgcctcagcctcccaaagtgctgggattacaggcatgacccaccgctcccagcctcatcttattttcaaagagaagagtaaaaacccaaattcagctgggtgcagtggctcccacctgtaatcctagcactttgggaggccgaggcaggcggatcggatcacctgagattaggagttcgagactagcctggcccacatggcaaaaccccgtctctactaaaaatacaaaattagctgggcatggtggtgcgtgcctgtagttccagctactcgggaggctgaggcaggagaatctcccgaacctgggaggcggaggttgcagtgagccgagatcatgccgttgcactccagcctgggtgagaagagcaaaaccccgtctcaaaaaaaaaaagccaaattctaggtggcatcaaaagcaatgaatgcctgctctgtcctctcttccagtcaggttaaaaagaaagccctgaaacgctgcatcatttctactctatgtgtttttgtgtatacgggttttactatatatgtttttatgtatatgtgatttacaatatgtttttgtgtctttgtgtatcaggtaggtaatagatgcacatggtttaaaaacttaaaacacaacaaaattaaaccaaagagtatgcgtcagtctcccttcttacccaccttctggctcctttcccataggcagtgatggtttcccagtaggaaaatgacttttaaatgcatgtccctacatgtctgagttataactgataataaatggctgcttccacctgactgctgtggatcgcgtcatctttatcttgaaaggcctgtgaacggcatcctcttgctaagatagccacatgagtaagtcatttaggacctagaatagagaagatgggaagtgttttcaggattcagggtgaatgcctcaaggtggccttgaggtgtcctgctctgagcccctccacagggatctctgcaggtggcaggggctttctagtaggttggccttgactttgggtttcttggacaacctgtgggaaggagggatggacaggttttcacctctcagtgttgaaagaagatagtagttgtcctagtctgcttgggctgcccaacaagataccacagactaggggccttaaataacaattttctcacagttgtaggggctggaaaaccaagatcaaggggctggcaggacagggctggttcctctgaggcctctctccttggcttgctgatggcgtcttctccctatgtcctcacagagtcgtccttttgtgtctatgtcctcatttcctgttcctgaaaggacactggtcagatggggtcagggctatcccaatgacctctgtttcacctctgtaaaggtcctatccaaatacagttacattctgaggtcctaggtaggtcagggcttcaacataggagttgtggtttggaggattcagttaagcacataacagttcattttgcctttcggacactggctgctgtagagagctttcataattcacatgagattctcaaagggggcttggactcccaaaagttaaaaatgaaatgatctaagggaatctgatggtaatttttttttttaatttgagacggagtttcactcttgtttcccaggctggagtgcaatggcgtgatctcagctcactgcaacctctgcctcccaggttcaagcaattctcctgcctcaacctcccaagtagctgggattacaagcatgtgccaccacgtctggctaattttttgtatttttagtagagaaggggtttcaccatgttggccaggctggtttcgaactcctgacctcaaggtgatctacctgtctcagtcccccaaagtgctaggattacaggagtgagccactgcgcctggcctggtaattcttttcctaaagtaaaggccctggctgagctytggcataggcatagtgcacaagagccgcttgggtgtcttgtgaaagcacagactttgtgattcatttcatctgggctaggccatatgctctgtgatttctttctttctttgttttgagacagagtctcgctctgtcagccaggctggagtgcagtggcccaatcccggctcactgcaacctccacctcccgggttcaagcgattcttctgcctccgcctcccgagcagctgagattacaggcacttaccaccatgcccagttaatttttgtctttttagtagagatggggttttgccattttggccaggccggtcttgaactcatgacctcaggtgatccgctgaccttggcctcccaaaatgttgggattacaggcgtgagccactgagcccagctacagcagttttcttgactatccctctactggtggtcagcatttttttttttttttgagatggagtttygctgttgttgcccaggctggagggcaatggcacgatctaggctcactgcaacctccgcctcctgggttcaagtgattctcctgcctcagcctcccgagtagctgggattacaggcatgcaccaccacgaccggctaattttttctatttttttagtagagatggggtttcacaatgttggccaggctggtcttgaactcctgacctcaggtgatccacccacatcggcttcccagggtgccgggattacaggtgtgagccactggcgcctggccagaagagcaactctttatatacttaagaatcatttgtgttttgtaaactttttttttttccatatcctatgtttttccattggggtgttgtttatttgtaggagctctttatatttggacactttagttttacaaaataagcccatctcccaaagtgtggctctcaacatggcctttctcacacggcctttctgtggcacaggtgtgtaaggtgagctgcaccggtaaccactgagactggattagcattttccaatacccttgccttagctgacaaaacttcaaagccctggggtcaagaacaagtgcagagctgagatccacgtgccgatgtgtacacggatctcagacgtgatccagttacttagacaacagtggaytgtgtgggttcccgttcagctatggtgagtggggttgtagaagttgggagtgaattctcacttgtctgcttcccctggagtacagttcggtgtcctctcatgctaccttttgccttttttatcctttggttttggtccgtacagaaaattggaaaccactgagaagtacaaaatgagagcaagaacaaaaaccaccctgaatttcaccacccagagccagagtatgggatgagcactggggccaggccctcctcctcctctctgcagatggattacaggatttgcatgtgttacactgtagtggtggcatgtgctagcctatagcctgttcccccccgccagggcagtgttgacaacactgtgtcattccctgtagctgagttgttacattgtttgcactgttccactgctcaaatgctagtgtttccttgtacctcttcctgcctttaaacttcgggaagtttgagccagagcaactgggacagcagaggtgtggacagtgtgggtttactggcaccaatgtgtgacaacagacacggcgaagcttcccaagccttggtgtccagcggtttccttggggttgatcacatgctgtgggggtggctgacttttagttcccagcccctccagaggtggagtggacaccttgtggccccaggcccctgccctaaatcacgtacttaggctgcctgtggggcccaaggcccctactcttggagatgaggccaaaggcaaggttaattcttcactatgcagagggtgtaccctgtgccaaggcttttgatgtctggtaccagacaccatttgaggagtagccactgcctgcagagggtaggggaggctgggtctggccgtgtgtgccgtaggcctggctggtggtgggggtgagcgggcagggagctcactcgtgtcttgaagacgctgactctttcaagtctggacagtgctgcggctgtgaagttctgaggttgccagaaagatggagacgtgggtggaatgtcaccttacttcaatgtgagcttgctgtccagaggtagtgtctcactttgaacttgggagagaggggatgtccagtctgcctgcccgctgtgtcctggttcctaacagtggagcttcttcaccctgatggaagcgcggaggcccagggctcctccaggggttctgactcctccagagggacggggcctctgctcctggcatcgtgcatggcccagaggagggaggaatctagaattctctccactcaatgtggttgcctgtggcagttggcttcttggaggaggtcatttgaggttgagagctccatgagttgggactcgtggtggatgcagataccgctgcaggctgggcgggtggggggcctcttcatccttggttgtaggtgctttgccaagagggagatgtcttgctgtgttgactcgtcttttgaaggttgtgtgctggtgtgattctctttatggaagcacctggtaaaactctgggaggctggcatggtggctcatgcctgtaatcccagcattttgaggggccaaggtgagaggatcccttgaggccagcagttcgaggccagtctggcctcaacatagtgagatctcgtatctacaaagaaaaaaaaaagcacaagtccaagagtgggcagtgcatctagtttaagtacccctaatctgaaattcacaatcctccaaaatccgaaattttgtgagcatagggaagatgctcaaaggaaatgctcactggaatgtttcggattttggatttttaggttagggatgctgagccagtaagtatttgcaaatattccaaaacctgaacaaatctgaagtgcaaagcacttttcgtcccgagcatttgggatgagggatgggcagcctgcagcatgtgagcaaagagcagtgtttggctcttggcagtgcccctttacctgtgcgttcacttttttttttttttttttttggtggagcggagtgtctctttgtcacccaggctggagtgcagtggcacggtcttggctcactgcaacctccacctcctgggttcaagcgattctcctgcctcagcctcctgagtagctgggattataggaatgagccaccacgcctgactaatttttatatttttagtagagatggggttttgccatgttggccaggctggtcttgaactcctgacctcaggtgatctgcccaccttggcttcccaaagctctaggattagaggcgtgagccactgcgcccggcctgctcttggttttgaaagtgatgtcagcagtataacttcgtgtaggaaatgtttgccttaggtggtgtggaagatggaccatgtgatttgatgcagtccaggcagcagattacaaaatcccgcctcgatggtgtggcttggggtttctcctgaccttggtgtagggcacgccttgctgcctcccctttctctagttgaactgcaggacagtgggtacagttgtgaagttactgccactttcaacatctcttggcaaattcctcaataatctttttaaaattcctttagaattgtgggtttgtgaacttttcagcatcgggtggagtgaaattgttaccctttctctcagtgagaaattggaggggattattgtggcaggaggagtaggtttgggggatgcgagtggggcagggagaggggcatagggtgagttttatcaggagctgctttcaaggagaggactagggtgagtggaaccatgctgagctggcaggcagcaccctgtggctggtccgcaaacatgggggctgctccccacacctggaggctttttatgcctcttagatctcagactcttagatctgatgcacccmctccccagaaaaccgcccacgcttagcacatccacctccrttcagttttagaggttccatgtactcctagcctctctgcatttcactgaggccctgcaccgctgcaggatgcccctgagctgggcgagaccctaggctctgtcccatggttgctttgttactgtgctgctgctgggaagcttcctgttgaagggttttgaggcgtagccaagatggaagttgtgggcagcaacgattctttcccaggtagcagtttaraaccgcaagggacggagggcctgccacctgggcagtcaggagactcttggcccgagggactgaggccaggttttccaagccgaagatgaggacacagggtgacgagtgatacattgattttgacatgtgtgtttatgagggagaaatcctcccagtggagtctgtgtttccgaaaacnactgtgagagccacggcagcangtgggaaaggcagagccagagaaccatctgattcgctctgcccagggggtggagagagagcncctggctgctggagtgtgggtgtggatggtgcctggtgtcctcagtgccctgttggggctgcccaggcggctctctggaggggggcttggggcagtgccaactcagtctgggagttcagggctcagccactcgactcctggcagagaacggagggtgtggagatgggtggttacttgctaggttctgctggtctctgggccctgaacccagtgactgtggagggagtgctgagacccgagacccgagaccctgcacaggctgggggttggagggcgggcggggttgtgcctcagctagggtgacaggccggcttgccattggtccagtgacctgccccattctgtgacctcccttggatcctagcacccaagcctgcgagtaaggctcngctgcgtcctagaatcggtgccaggataagcccagctggagaggctgggagcctccggctggggcaggacaaagggacgcggagcagtgccctctgctgagctgggcaggaggcacggtgtcgggggccatctgtgccacacgccttccagccaggctggggggatgagcgccctgtgagtccaagtccatcccccctccctgtggcatcctcttgggctgctcctctgtgccaccatggtcgtgtttgtggcagctgcttaatgagcccatcggacattgggggctgtgtcgctggtgcagtgcagggctgtttgtttaaattgcagtgcaccctgagaattctgattaatcttgccccagagcgtaattatctttctttgtccttgttttctctgtgtttaccccgttatacttcccttctgcctcccttctgcagctctgctgcacagctgtgagggaggaggagggatgctgcttccagcctggggtgtggcccaaaggtcctgcctgcccttttctgtcttttagtccctctgcccctgagagaaacataggggcctcattgaggacagcgttcctgaagcttccatctcaatttccagccgcagtgggccgggcgccctgtacttgtctgcctggtgttggctgcgtattgggcagtgtgtgctgccacagccctgggggtggggaagcagggctggctgctgttctgtagtgaggccctgtggctaactgcgtgtgtgggaagctgtgctacaactcatatctatgtaaaatagaacatatgggtccctgccttgtggagaggacataaatacgggacgattccagtagaaatgatgtggaaatgagagccccaggaagtagtgtagccctgagccctggcgaaggagagggagcgaactgtgactttggttcttgctgaagcagtgtgcaaacgtgctgcatccggaactctggtgcatccatgactctgggtcggggttggattcatggatgtgctgatgtggatgtggactggggggagcgcaggcctctcacacgctggataaccgagcttcctcccgaggagggtagggtgctgcctcactgctgccctgggctgggtcctgccctgagggtggccaggcccctccatccctctgcagggcatggggcacggctctctgtctgaggctcctggttcgacgcagcagaacgagcagcaggggtcagtgtgggtcaggggagcggcaaggctggggggccctggagactggtgcctgcctttgtccttgacagtggcccccagcacactcagcatttatggagagggccgttgtctccctcaatgcatgatgaagactctggggttaaggaaccattcccccatttcttgatgacagttttcaaacacacaggaaagttgaggattttgtcacgcatttatccaccacctagatcccaccatcaggagcaattttctattcttttctttttttttttttgagacggagtctctctctgtcgcccaggctggagtgcagtggtgcgatctcggctcactgcaagctccgcctcctgggttcacgccattctcctgcctcagcctcccgagtagctgggactacaggcacccgccaccacgcccggctaattttttgtatttttagtagagacgggttttcaccgtgttagccaggattgttttgatctcctgacctcgtgatccacccaccttggcctcccaaagtgctgggattacaggtgtgagccactgcgcccagctaggagcaattttcttaaagaaaaacgttgtgaaagtaaatttgtcgaaggcattggctttgttccagttgttagcattgcttaatttttttggcaccaccttcagcagctggaaaacagagcatatggccaggtaccggtgcctgccacygcccacgtggcctgccaggctgtcgaggaccctgcgctgctcctggaagctaatgggggtgtctttntggccttctaggacygtggcaaggaggtgtacagccctgactttcatagcctcggaggagaaggtcttggtggccgacaagtctggagacgtctactccttttcggtgctggagccacacgggtgtggccgtctagagctgggrcacctgtctatgctgttagatgtggtaggtgggggacgtggtaggtgggggacatggcaggtgtgggacacggtacatgggggacgtggcacgtggggcatacgctgagtcaatgtctaccctgtcaaggctcaggcacctgtccatgctgttagacgcagtacgtgggggacatggtatgtggggtacaggctgaatcaacgtctgcccggtctgtgccccagcgtttggtggggagantggggctcccccgtagcagggacagccctctgcagatttgggagcaggggagtggtgggaacaggatttaggaaggtggagcagacagcagggagaatgaagaaggcaagtgagacaggaggtggncagtaggtggccccaggttggaagtgaaggtgtgggaggagcaggtgcagccacgagcctctggctccgcctccttggccgggagctgtgccaggtgctgtaggagcatcacctcagcactgctcccagcagcccctgtcaccccactctgtgtgccccgtgtgtcacagacacacacctggagccccagagggcgcaggcccacagcccgggtggtggagctgggattggacgcacacagggacagtcaggaacaatggcgagtgtggggtatcaaagggaacctcactgggacttggtgacagatgggtgtggggacatgtgtgacaggaaggcaacccagtgttgggcaggagggtgcagcaggcctgnggcgggtggaaatgggcgtggggcctggatttgccaaggtgcgggagacaggcaggcaggggtggcactgccccaccccagaagcctgctctagcactgaggagtgagggctagaggtggccagggaccctctggggagggagaatgagggccaccaattagacgtagggacgggaggaggggaggagccacgctggtctgtcctcgaaggcctcatcctcttggcggccaggctgcagcttccctgccttcttccatgagggacttgattcgggaagactcaggtgagcggctttttcttttctggcccctggtgatgcaggctgtgagtcctgatgaccgcttcatcctcactgccgaccgggacgagaagatccgagtcagctgggccgcggcgccccatagcatcgagtccttctgcttggggcacacagagtgagtgccccttcctgcccctccagcagaaagaaggtctgtttgaaaacagcgtcagcttgcggctcagcaggtgccgttgtagctggcgaggccccacgcgggtgacagcagcccccgtgcttgrtgtttggtcactgcaggcgccgtggtgctgcctgcagaagccctgaaagggtggggttcactctgcgctgttacccggagtctgtgccagtaacttggcattgggcctgaccgaacaggaagggcttgtttccgggaaacccctgtctcagtgtggagacccctgcaccatgcccgggagttgttcgctggtgggtggtgggggtgttgggggcgaggatgaactttagtgatttcagctgtccaagaattaagcggcctctgcagccaggtggcggcgtctctcgtggcagcacactctgccaggacccatgtggaggtgtttctgaatgcccgcttctgtctcacacaaaaagctcattagaatttacacaaaggaaaaacgcttagtgtaattggctgaaatgttttaaaatatattatttgaggcagtggaagaaattggagggaggaaattcagtgccgaggttgcctgtgttttcctggttttgatccaaacatttcctgtttaagaaggccagtcactggtgtgtgcctcaggatagcttcttctgacttgcatttagttcgctagtgatccagctctggagttctctggcctgcagccccccggcccctccccttcaccatctctcgctggggtctctgcagctcccttgcctcgccaggcacgtgagggaggtttctgctgacgggaacacgcttctcacccttctagggaaatgcttcatcacttagaagtattgagtaaaaacatagtattaaaattaacttcaactgctccctccctccctcccttccttcccccctycccaccccacccttcccctcccttcctttcttttctctttcttagctgtgtcgcccaggctggagtgcagtggcgtgatcttggctcactgcaacctctgccttccaggttcaagcgattctcctgcctcagcctcccaagtagctgggactacaggcccctgccaccacgcccggctaatttttttttgtatttttagtagagacgagggttcactatgttggccaggctggtcttgatctcctgacctcatgattcgcccgcctcggcctcccacagtgctgggattacaggcgtgagccaccgtgcccggcctgcccgtttacttttcaacatagtggctggcaaattgaaaacaaagccccgtggcccctgtgtgtggctggaggtgtgtttctgctggatgtgctgttctgtgccctttgctgacattgcagtatcrgttggttcactggccgtctcccgctgcgtctgagtggttctgtgggtctgttgggcctgttggtgtgtgcagccctcagcgtggtgcctggcatgagtaggtgctcagtagataactgcagtgattggacgaattatgttttgagattttgtttcagacccctggaaactggtttcccggcctttcaaaccgttgagaactgtgaggccactcgtgccctctgcacggggcgtcctgtgccctatctgtcctgggctgtgggctgctgttggtgctgtggtgccgtgcagggcggtggctgcgggacngggcccggctcacgcgatggctagcccaaggtagcagaggccatgactggtggagatggagtgaggctcacgggccaccccattccagggtccccgggaaccccgtgcatgagggattgcttgaggccactgtgttagagtgggaagaaaaggggccttgtcacccttgtaggtgcccgagccaagatgggtttccaggcgagctgggctgcttgggttattcttcatggctgttctgatgggagggtccctgtgactttgagtcctgtgcttgcaggccaacccctcacaggaggactgggccgggctcagcagagacagctgtctggccaggtcactcagagttgttgctgaggggccgtcaggaccctgataggaacctgtgggcttggctgccctcctccctccaccctcctccctgtgtgctgtgtctttgagtctcccccgtgtctttgagtctcccccaaggctcctttcatcacagtgcaggtgccttgggccagggtgggtgctggggggcctgtagaggtgccgctgagcagagctgctgcagagggggctgcagaggggcacagaggcgcttgggtctctggcaggcatggctgaggagcggcctgggttagaggttgctgtgctgttggggacccaggaatgacctcactcacctccccgactgcgtccaggggcctccacctggttaaccctaaccaggttagggttaacagctacttcccatgttggctgtttttattggatcagggggtttagggcagaggcttctcttccttagatgaacaggcggcctccccaggcctcycggtccctgcgggcgctgggctcgctgactctgccgctctctctcgccctcacaggtttgtgagccgtatctccgtggtgccaactcagcccgggctgcttctgtcctcctctggggtaagtgttctgcccagcgtcactcacctctggattcttgagcctgcagggagggtggggtgggcgcctcctggacctggcccctgtggatcgctggcccctggctggctgtggctgtccactagatcttagagctgcctgcggctcgctccccgcctgcggccgctcactcaggactgcgtgtggggtgtgcgtaggtgcgtgtgtgttcgcctgtgggatgaactagcacgggtgtgtggaaggctcccttctgagggcggctgctgcatctacgatggtatcggggatcaggatctcaggtagaaacagtagamgggggcttctctgactcttggaggggtctcagtccatcccattatgggctgcattttttttccttttctttcctttttttctttctttctttttttttaagatggggtgttgctacatttttcaggctggtttcaaactcctgggctcaagcgatctgcctccttggcctcccaagtagctgggaccacaggctcgagcgcccgcacccgggttaccacagtgcatttttgcttgttgggtacagcttctgtgtcccagcaattgggtcctggaagccttacagtttagtgatgagagacgtgttttctctaaggaatgtgttagaaggattgttagtgattttgccaaagtgagggccttggattcctcacagggtctgattctgtcctcttgcggaattgttgcccgcacaccaccaccttcctcttcgctgtccttccctgtgttgtctgtgttggtcctttgtgtggtgtggcaggatggctgatggaccttctgrccgcttctatgtttcttctctgattgggcttcattcacagcctcctgttcctgctcttcaaattaacacacagccacgcgacctgagagaagaagaaaagtgtggccataatctccagagggtcagggtcagggtcaggcttcgtcagcggtttgttgtgcaccttccagtctttttcataatatgaggaaaatcttccacgggcagagaagcctccccaggccccatctgtccctcatggcttactgctttgtttgagtggaacacgtcatctggtagctgccaaaaggcgcgaggagggtcagtgttttctgactttgcttttctggaaatacctttaatctcctttgaggcctggttgttagtttggcgtagaagtcctggttgaaacggtttccctcggagcttgggaggccttgcacagtgtgctctccagctggttgctcctgtgggttttcccgcgcgcttcctgtagaaacctgcagctgtctgccgtgggtccgtggggtgacagctgggctctccttctgcctggaggactttctctgctccagtgtgcgatgtgaaagccactgaggtgacttggtgggccccagaggggagttggccacacagccagtgattttcagtgtcctccgacctggggcattttcttacatgattaccttctgttctctacccctgcctcttgctcactttttctaaagcttgtgttagttgaaccactttaatgctctgattcttattttttttgagacagagtcttgctctgtctcccagtctggagtgcagtggcgtgatctcggttcactgcagcctctgcctcccgggctcaagcaatcctcccacntcaggcctcccgagtagctagnattacaggcacacaccaccatgccccgctaattttttatncttttgtagtgatggggttttgccagcttggccaggctggtctcaaacttttgacctcaagcgatccacccacttccgcccactgggattataggcgagagccaccatgctgggccataattctctgkttttttttctttcctgttcaatctcgtatttctactcctttaggaatagtcttacttcttgggagattgcctcaactttactttccagccttctgtggagacttgagttttattaggattattttgaatctttagttctttcttgccctcggcacgttcttttttgcagccacccattctcggatagtgcacgtgtctcttatctcactgagatgagcgtggacttttctttcttcaatttcttcctggccttgtgtttgattgccttctctggagtgtgtygtctgcctttctcattggaggttttcctcggatgtctggcgatgccatctgcctgtgtgtgatgggagtcagcaccagccggcctcagaggctgggtgtgtgcacccagggtggggcccgaggggcttcagagcaggtgtctgtgggcagcagccccttgcctgtggactccgtagaacgtgtgggtcagtcggtctcttctgggtggtcagtgtcccrgccttcactcttgcccaggtctgtcccctggggctctgggaggtgagtgcgaaggggctaggtgactctcttctcagtgagtatttggcatccccgagacaggggcccctcggctccgtttccccagagccttctgctggcctggagtttggggctgaggatgcatcagggaggtcccgtttctctttgtaaagacatttgacagctcccctcaccaccttggtcttcaggctgcctggcccggtttggtctttggcaggtcctggcacctctcgggcttctctgtggctggtgcatttgttccctggcctccagcccccaggtttccttgctgtctctccgcggctgccttctcttcttgcctgttgtctttgtcttagtgggttcatggttattaaacatctttttcttgtcttcgtagagaggtttgggggtgagtgaaatgcctgtagatgtgtgtgttggtctccatgtttatctgccacatttgtagaaaggtgtgtgtgtgtgcgtgtgtatgtgcatgcgtgtgtgtgtgcattcatacatccactcttacctcggcacccagaggatatgcatctactgttagctgtttggggtatttacttttcatctttttcatttagtcatttaaaaatacttacaaatagtgcacagacactctctcattagatttaatgagtattgatttatttctctccactgaattagtgctgtaatgaattttttttaagccaggtatggtggctcatgcctgtagtcccagctactcggaggctgaggcgggaggattgcctgggcctgggagtcagaggctgcagtgagccaggagcaagcctgtgaatagccactgcagtgcagtgggcagtgtggaatagaccccatttcaattaaacaacaaaaaaataacaacagataaaascaagaaaaaaaagagaaacgcttttttccattgatgatggttttagagcgtggagcctcttggttcctgtgtcggcttcctgaagggttgtaccagttgtcntgggacggttgctgatggccatgtccttcctgtcattcttagtgaagtggagcagtggccacgagctcatgagcccacaygtgtctccccgtgggaatgcatgattgctgaagtgtctgcgcagacctgtgtgcatgcccgtgtctatgccnggcccgggcacagcagatgtggtctggcctcctggcggatgacaacctggccatctagcggccttggcttattttgctaggatctgcctcattggctttgtcatctgcctgggcatattggcactcgagaaacagggaatcggtcaccttcygttccccaccrttgtccttgatgatttgcatgagcgatttacacagtcagagcagagagcctttaattcctgagggtgggtggcatggctgtcacggagtgganccccgaccacacgcagctgtcctctctgtcaccytacctgacggaagccccacaaccatgtgctaacctgtgtgtttggtttgtgcaggacggcaccctgaggctctgggagtacaggagcggccgccagctgcactgctgtcacctggccagtctgcaggagctggtggacccccaggccccccaggtagctgcttctgttcactcctgggcgactgagtgcttgtagacaccggcagtcgcctgacttgagtggaaaagtcacttcgccgttggaaacgtttgctctcaatgccagacttcctcctgtgtgagggaaatctcgtatttcaaattctgaaggtggctcgtcatgtcagtgggaaataatttgtctccctgttgcatgcaaacagttaatgtacaggaaggcctctaatcctgctctgaagtggaaggaatggaggtgcttgagcatgcacctttgtgggtctgccagccaggtggggcaggggtggggccaggcccactccagcattctccggccagcttggagcaatctcatgacaccctgaaagcccaggccttggcaaagtttcccgccaaacggtctgttccatttcctagagaactgtgtggtgtggcctctgccccctgccaggcagctgtgtaagagaggaccaggccttttccttcatgcttcacgtggactcaggttcctggaagtttccttcatttaaaaaaaattttttttttttttttgagatggagtcccactcttgcccaggctggagtgcagtggtgctatctcgactcacagcaacctccgcctcaggctcctgagtagctgggattaaaggcgtgagccactgtgcmcrgcctcttcttcatttttaatatttyctctgccaggaactgtgggagctcacagggcagttgtatgtgtagctctcatctcttcctttcmcctgtgtcctccgctccctcttctcctcactgtctgacctatcttgttggctttggaggctgtcgcaggccctgcagggagtgccagaaccactggggggcttttgtcatctgcttgggaaacagggaatcagctaccctcctttccccactgattccagaatgttccagtgctgtttcctcttcctngatatgtgggggcgtgagcgtccttcggtcttgctctygttggatcagagcgcccggcgtcgggcccctgcaggtggcgtgaagttaatgggcttcttctccttttagaagtttgccgcgtccaggattgcattctggtgccaggagaactgcgtggcgctcctgtgcgacgggtaagctgcggcggcacctctatggcctcyggttctgcagacctgcagggggaagagttagcgggttggccactggcccacgtcctcaatgaagaggtcctgaacggtggtggtattggtctagcacctccctctgagaatgtcacttttgatgactgctgctgcatgagggtgagggctcctctcagccagcgctcttcaacctgacgttgaactcccctggcgtaaagagcaccagcagcctctgcctggccttctgagatgacagactttcccctgggccagtcgtggtggcatcacctcactcccggctcggggctggtcggatgggaaccccctggggttggcggtgctgacaaggtgggtttaggggtggagtgcagttctgctgcttcttcccgagtgacttgtgtgtgtcaggaaaggtattctatttggtgctttnggcacttttcatcttgtccttatgacagcctggggaggtctcttagctcgttctggaagtacgcaggtgtgagaggagagctgcgcctgagcccagggcctgcgtcctcctgccctgcctgcctgtaccgtgctggttagctattgctgcaccacgagccactccagagcttaggacttaaaaaagtgtacgtcaccccatggtttccccggcgccggcatttgggagtggcgcagctggggctttcagcgtaggctctcctgaggtggcaccggcgagggctgcaccgtctggggtgctggctgcagagcggagcccgtgggcctgcagtcctagtaatcatgctctctttcttcgtggcaagcactnctgtggtctacatcttccagctggacgcccgcagacagcagttggtgtacaggcagcagctggcgttccagcaccaagtgtgggacgtggctttygaggagacccaggggctgtgggtgctccaggactgccaggaagcccccctggtgctctacaggcctgtgggcgaccagtggcaggtgagactcggcaccttccagatgtcctatgccctgcctttccataagcctgggggtgtggggcggcagctatgttttttgggtccatgggtaagcctctttcaactcagccacttctggggcccagggtctgtgtcctgaatggcagtggctggggcttccaccgtgggtgaagggagccgggtgccaggccggcgtggctggcttgtcccatgtggtgatgtctgcaacagttctttttttgggngagtgtgtggccccccacaccacacttagcgatgaagttggcactcagtgtggcaagggtgtgtgggactaacacttggaggctggattagcacagcctcgggcctggggcactggctgagtcctcaggagcatgtggagccccgggtagaggagggggcaagggcggcaggctgagctgctttcctctggggagacagtggggtctctgggcgagggcggcgggccgagctgcttccttgctgggggacggggcgaaccctgtacctkgtctgcatcgctcctggtaacggagcaatgcccctgcccgccctgcgtctcacagggttgctgtggagttgagtggagtaggtacccatttgccaaagctcagttgagcactttggaagcactttttttttttttttgagayggagttttgctcgtgttgcccaggctggagtacaatggcgctatctcggctcaccgcgacctccgcctcccgggttcaagtgattctcctgcctcagcctcccgagtagctgggattacaggcatgcgccaccacacccggctaattttgtatttttagtagagayggggtttctccatgttggtcaggctggtcttgaactcccaccctcaggtgatccgcccgccttggcctcccaaagtgctgggattacaggtatgagccactgcgcctgacctggaagcacttttaagccatccagttctttttacctgagaagtggcaggccacatgatgtccccagtgggtgcctgtcgcacctgctggcccctgaggttgatgaactgcatgtgaagagcttgccctggcatcatgggccagctgcgggggctgcctccccaggtctccacagaaggtgaatgggggtccccaggcaccaggaggggacctcccctgcaagcctctctggccagcatgtgttgcgtcctggtgctgggtttccaggcctgcctctttctgatgaagatttcctgtttgtygcctgcagtctgttcctgagagcaccgtgttaaagaaagtctctggtgttcttcgtgggaactgggccatgctggaaggtgagagcacgggtgcaggctgcccttgggggtcacanccagcgcggtccccagagaaagcagaagcacacactgtgacctgcccggggtacctggtgtgcagataaagagggagagtaagcgtgtgtccccatccagaaggcggggcagggcaggaggtgggtgacgcacagcagaagaaggagccccccatgggagtcaggctaacgagagccacttaggaaccgggggctcagggtctgagcacctgccttcagagttgggcgttgaaggtccccagggcagggctggcagctggtggctcccagagggagctggtgctgtgctgcctcatgcctggtccatggtgttgagggaattgatcccactgcagtgngcgtcagtaagtgcagggcctcactgggaggtttagtgggggtctagccagaggccccgggggtcttcaggaggctgagcaggggcaggatggtcactgtcctgacaggaacactcagctgaggggagggaatctagccagcaactcccgtggctgcggctgcaggaaggagagcagccaggctgagggaggagctggacgaacattttctaccctgccttctggggacacgacacactgtagttctgggtgcgtcgttgtgccagcaccttgcagtcttggaggngatggtgtctgcaggatggattagcccagcatggaatccaggtgcctcattcacgacaagaagttgctgctctgaagtcttgcaaagctaaaccccactgcagtgagcactgaggttccttggagctctggagggattcacactgaggtcggaggagtttccgctgattggggcccagccgccttctgccaggctccccgagtggcggcacgctggctctgcctctgaggcttctctccctcctgctttgcttaggatgttgagggttgagacgggcagggttgggccccccagcgtggttgggatctgctttaggaacacttcagagtgggcctgtcactggctgtgtcagggactgcaggcggcagtgctcatggccgggcatctgcagtgctcatggcccccgtgctctaggccacggacagcatagacctgttgagtgtcaccttgcacaacagtctcaggccaaagcctgggctcgctctcctgagatgttccatagatagagcagcctgttcccggcgcagacttgggggcctgcgttgggagagggaccggggagggctgctgctagagtgtcccacaagcagcagagtcgctggaggggcggggaggctgcgccacctgctggatgggcaggcttcaggcagtcgctggtgcgcgggttaccggctgggcctgtggtttcctggccaggctgaggctgtctccgtgtgcctgtggtcagtcattgcccccaatccttggcacttagataaagtagatgaaatccgtgtccattccctgtggcggcagaacatgctatcccacactcgatgccttaaggcaccccacccttactgtctcactgttgctgtgggtcaggggtccggactcagctgagctgtgtctctgcaggtggccatctcagcttcaccaggcagggcccgacttcactcagtctgggttgtcggcaggacagggggcctctctggctgttggccagaggctgctgctcctggtcccctgccacctgggcccctccacagggcggctcatggtgcagtagtggctttctccgggcgtgcaagcagagagtgctggcggggtggaggcccagccttggtgccctggtttccattacattctttcatctttgccccgttctgttagtagccagtcctcaggtccagccagggtgtgggtcccaggaggtgggcacygtggggagccgtcccagaaggcgccccccacggtccaccgaggactctgggagtcacgaggtaactccctgctgcagggggcccgctgtggtggccgastcccatgttcctgccccacctggcacctgtccttgttcccccatcacaggctctgccggcgcagacgccagcttcagcagtctctacaaggcyacgttcgacaacgtgacctcctacctgaagaagaaagaggagagactgcagcagcagctagagaagaagcagcggcgccngagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtcsgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgantgcttgagcctgccccagccccagccrtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaacckaatataccaggcaaaactccttggtgcctgcgctgtgtgtgtgtgaggtgcgcggtgtgattgtgcgctgtgtgtgtgtgaggtgcacgctgcgtgatcgtgtgctgtgtgaggtgcgcgccgcgtgatcgtgcgctgtgtgtgtgtgtgaggtgcgtggtgtgatcgtgcgctgtgtgtgtggtgcacgccgcgtgatcgtgcgctgtgtgtgtgaggtgcgcggtgtgatcgtgcgctgtgtgtgaggtgcacgctgcgtgatcgtgtgctgtgagtgaggtgcgcgccgcgtgatcgtgtgctgtgtgaggtgcgcgccgcgtgatcgtgtgctgtgtgaggtgtgcgccgcgtgatcgtgcgctgtgtgtgtgaggtgcgcggtgtgatcgtgtgctgtgagtgaggtgcgcgccgcgtgatcgtgtgctgtgtgaggtgcgcgccgcgtgatcgtgtgctgtgtgaggtgcgcgccgcgtgatcgtgtgctgtgtgaggtgcgcgccgtgtgatcgtgcgctgtgtgagtgaggtgtgcgccgcgtgatcgtgcgctgtgtgagtgaggtgcgcgccgcgtgatcgtgcgctgtgtgtgtgaggtgcgcggtgtgatcgtgcgctgtgtgtgaggtgcacgctgcgtgatcgtgtgctgtgaggtgcgcgccgcgtgatcgtgtgctgtgtgaggtgcgcgccgcgtgatcgtgtgctgtgtgaggtgcgcgccgtgtgatcgtgcgctgtgtgagtgaggtgtgcgccgcgtgatcgtgcgctgtgtgaggtgcgcgccgcgtgattgtgcgctgtgtgagtgaggtgcgcgccgcgtgatcgtgtgctgtgtgagtgaggtgcaggccacgtgatcgtgcgctgtgtgtgtgtgaggtgcgcactgcgtgaccgtgcgctgcatgtgagtgaggtgtgcgccgcgtgatttgggaagaggcttctgcaatgggcaggcttctgggtacatcacttaattcgttcaggccggctcctacctgctgtccagtgatgaagtctccacacaggaacaggttcatgctggcgatgactatgatgtggggtatcgctgggtactcagaatccttttgtgtatcaaaagctggaatgcttcaaatttttcataagtgccttgttttccttttaacattgatctggaaacagtgctgtctgcaaagctgaggcccactcctctctgctggggatcaggggtttcagaaggcaggggccatgctgggccactgtcctgtacaagcagcctggcctccttcacgctgccagggcatctggcgcagggcatgctttctcattcatagtctgctttgaaagtcttggttttaggagaggttcaggttggtcttgctggcatcttcacctaaaatagggtctggcagacaggcccatgcgctgcatcctgcccacggcctgatagatggcctgtgaatggcttttttacattttaaaagtggttgaaaacaaattaaaaatatatttcatgacatgaaaatcatgaaattcacatttcattatctgagaataaacttttatggatgcagccatgcctgtctgtccatgtcttatctgtgtctgctttgtgctacggctgcagagtggagtggctgggactgagacggaacgccctcctcacggggccgcgtctctccaccaggaccgcggggctactctgaggctctgcttcttccccagcggggttggcttcctgctattcctcagcatcctgccttggtcctgagttggtccctctgccaagagccgtttctgtgtctcagtggatggcgcagctgccttcttgctggtaccttgactgatagactggttcctgttcacctgcccgaagtcatcccagaaatacctcttacagttgcatgggttgaacccagctccgcgtgtatttagagttttgtctcttgccccttcacccagaacagcagcacccaccaccttcccgtcccctgtgactgcctcgcaactgggtctgttctgtgagatgtcgccaccctgtttgccatctgggaggatctcactccttcaatttaatctgctctcttccgttatttttttagtttctatgtattttacttttaggacattccttggactttgttctacctctttaattgatgaagaaaatttggtcattgtatctggtttttttttttgagacagagtctcgctctgttgcccaggctggagtgcggtggcacaatctcggctcactgcaacctccacctcactgcaacctccgcctcccgggttcaagcgattctcctacctcagcctcccgagtagctggattacaggctcctgccaccacgcctggctaatttttgtatttttagtagagatggggttttgccatgtttgccaggctggtctccaactcctgacctcaggtgatcctctcgcctcgcactcccaaagtgctgggattataggtgtcagccactgcacccaatctattgtatttaattctaagcactttcttccagacggtctcactctgtcacccaggctgaagtgcagtggtgtgatctcagctcacagcagcctcaacctcccaggctcaagcagtcctcccaccttggcctcccagagtgctgggattacaggcacgagccattatgcccagcccgtctttcttcattttgattacagtgtgcgtactgtacmtccgagaagtgcatgtgaaatgctggaactgggatttcagcaactgaatgcacgtgtgtgactwcccacgagaagcaggacacttagcacctgctgagaagcccccacgcccatgttcccttctaggcactgcacakgcatgctggccggcctgacctcagtttccctcttgctgtggccgcttctgctccactctctgtgaggctcatccaccttgttgcctgtrgttgtggattgttcattctcagtgctctgtatgccaagtactccattgtgtgaaaatcccacagcacgttcattctattatcaatgggcatttgggtagtttccacagtttggctgttaggaatagtgcagtgatgaacatgctggcacctgtcttctgttttttttttatttttagagacagggtcttgctctgttacccaggctggagtgcagtggtgtgaccttggctcgctgggcctcctgggctcaagcgatcctcccacctcagtctcctgagtagctgggactgcaggtgtgtgcctgcgtgctggctaatttttgtagtttttgtagagatggtgtcttgctctgctgcccaggctggtctcgaacttctggcctcaagcagtcctcctgccttagtttcccaaagcactgggattacaggtgtgagccactgcccccggccagcacccgtcttctggaacatttgtaagcatttctgttgggtgtgtacttgcgcgtggaattgctggctctcagttatgcacatttcttagaagatcctgccagtccttcatcccagaccccgaccccagcgtggaaaacgcagtgcatcctcaacgcctagtgtttgcggctgtggcrgctcatgatcgacttggaaggcccacagtgtgtggtgtggagttttgcagggagccagtgacactgcccaccttcgatccagacctaaccttgatcctgttctctgaggccaccttaccaaaaccttgacttacccgtcttagatcacttaccctgggggaaatgtgccgcaagctcacgagggcactcagccagcctacaaaggttaccatggcagagaactgaggcctcctgccagcagccagcagcagctgaccagccgcgagggcccctccgggaaggagagctttctgtgtttcttcctgtaccccatatatgttgacgtgatacgttttactttctgatttcccttgtgagatctttggtctgtgggttatttggaagtatggtttaatttccaaacatttagggttttcctccagattttgttgttgtttctggtttctggttttaattccactgtggtctcagaatatactttgctgacttccctctctttagatttgttgagccctgttttgtgcttcatagtgggagggtgattgtatgtgcacgtgcagatatgtgtggcccccacacggtatctccagctatccgtgtcttgcctctccgtgcccagtgcacccttctcagccctgccgtgtgaccctgggctgggccctccctgtaccctcctttgcaggttggcacagtgtttggctctgtcactggaaggagctggagggactccacaggagggaggggcctgccctcctggttccagtgtgcttgcttttcctggcttccgtggtgtgtgcctgccagcctcatggtgggggcgggggctctcagtgacagtctgcaggagtttagcaacacccaggttcattcaccacggtgggaaggattcctgctaagcttccttgcctctgtccagctcccagggcgtctgcctccctcctgccccagggagagcttytgggtgagtctcgctggcactcctgccccgggcttcctgctctcaggccttggcctgctgcaccttggccaactgcaccacccggcacatcatagccccactcaggtcagagctgcgtctcagccgacgtggggttccgaggttctcaccaagatccagactcaacgcttgtgggtttgttgtctcagtcctggcggtggaggttctcccgaggcctcagcgcctccgttctcggaagtctctttacatgttagtggaaccctctgttcctgttgaatcattcttcgtgttaaatgtttctatctcttgactgatacatgatagtcatcatgtatgtattctgcggctgcttttgtttttttctctttatccctggttttctgtaatttgataagctttagggtatgtgtgtgtgttttgggggtttgtcaagatttgtaggctttgtcatttttatgcaatttggaaatattctagctattcggtctcttcccctgcctcctgcagtcccaggtactcgaatgggctgcttgctgtggactcatgggtccgtgagtctgctcatcttcttcagtttgcgtttcatttttggtagattctgtttccacgtcttcaagcccactgatcttttaagctgctgttaagctatggccattttctgtatgagccattgtgttttttcatctctataaatttggttttggtatttaaaaaaatgtcttccagctaggctggcggctcacacctgtgatcccaacactttgggaagttgaggcagggggattgcttgagcccaggagtttgagactagcctgggcaatacagtgagacctcatctttaaaaataattaaaaaggtcaggtgcggtggctcacgcctgtaatcccagcattttgggaggacagtggatcacaaggttaggagtttgagaccagcttggccaatatggtgaaaccctgtctctactaaaaatataaaaaattagctgggcacatgcctgttgtcccagttatttgagaggctaaagcaggagaatcgcttgaacctgggaggcggaggttgcagtgagccgagatcgcgccactgtactccagcctgggcgacagagcaagaatctgtcttaaaaaaaaaaaaaattagccaggtgtggtggcacatgcctgtagtcccagctgctcgggaggctgaggcgggaggatcacttgagcctgggagtttgaggctgcagcaagccgtgattgcactactgcattccagcctgggtgacagagtgacggtctcaaaaaaaaaaaaaaaaaaaaaagcacaccagtgtcttccatttctcttttaatcataatcatgctttaaaaaataccctcgagcatatggagcaaatttaagataattgttccttttctgctaattcattattactgtcatatctaggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaacatggtgagatttacattattaagtgtgaagttttgttaaggttcctttaaagaatattacgctttctggccggctgttaagccccatgtagattaatttggtctttttcaggtttgttttaagctcactagagtgaggctgaagtagcctttccttggatgatttagtccttcccaggtgtgaccctcctgctgtccctgcagaatcctgggtattcagaagtgtctgcacactggctggagggacgagggtgatttctgtgcaaggcgggaattgtttgtcttaccctccggaggattgttttttcctcaaaagctactctttggcgtcctggggttttacagaatgtgtaggttggtgttcatccgaagaccccaacgggacgctggtgtgtatttcctttcatctgtgcagctcccctcccctttgcgggtattctgtccccagttctagctgccttggccttacctataccagggaggccaagtggcccgctcgccccactccccttccagacagggtgcagacagggccctcccatctcctggacggcggcggcccctgtgcagaacttcatgggcacctggctgtctgggggcctcttccccagggagtctcctggtggtggccgtgttgcctcaggctcactgtgcactaggcaggtcacgtcaatgccacctgaggggcaggggttaccaccctgtggttcaggtgagaagcccgaggcccaggtgaggagtgtctggcagtccgtgcagtgtctggacagtatgccagcccctgcccggaggcccagcttctccagcccagcccacacccaccaggaaatgccccgattttactcccctggggcaaaggcccttggctggctgagcatcccctctcccagcactcggaggcacctgcagttgctcagctgttcattgagtgctgggagtggaaactcatacgctgagcggcagtgacrctgcggagctgacaaaccccacagcccgcccggtcacctgcttcaccgagggccacagcccccccggggtcaggtggccacaggggtcctggccatgtgggacatctgttctgtggccctgctcaggatggcacctggcggggactggccctggggtcgaggcatgggctcagccactgccctgcagggacacagccaggacctcttcccggcagagggactcccccactnatccccagaatactgaggggcacgctgggtgccaggctggcagggaccctggggattctgcagcgagctgaatggggtgggagttccttcttaaaatgtggagtctggaggccactcttggcgaagcgctggtgcccggggattctgcagtgagctgggcatggattcgtgaagctgctcatggtgaagcgctggggtgatggtggatgggccacagcgccactgtcacaaggaaggtgggtgacagcgagtgttccctgttcccttaccagcgagtgcctccctgggaacttgcccccaggctgtgctcttgggccatctccttcatcctcaccttcacagccacccctccttctcccaactgaggcacctgcagaggagaggggccccagacggggacagcagggcagaatcccagctcccagatccgggygaggggggattgggtgtggcggcagtttcgggggtagggggccaggtgggtgtgggacccaggggcgtggtttcaatcctccccccaggaccttgggaatggcctccaggagcctggcatggggaggccagggtcaccagctgaaccatctggaccagaattgcacagcagcgccctctcctctacagcaagacgtcacccaggggtccccacagaggaggcagggaagcttgagggtcccagaggagcgtggagcatgcaccatgctacgctataccacactacacacacgtgcaccatacacgtacatatgcatgtgccacacatcacacacgtgcacattccacaccatgcacacacacccaccacaccacacatgtacttacgcatgtaccacaccacatcacacgtgcgcactccgcaccatacatgtacatacacaggtacatcatgcactcacataccacacatccacatacacacatgtgccacaccacactaaactcacaccatacatgcacatatccacatacacacaggcacacaccacacagaacatgcacacaccatagaggcacccacacacaaccaatcacgtatgcacacactcgcaccatatatatgcacatacatagattcatacatcacacatcacagtacaccaccccacacaggcacttatgcaccatatgtgcacatacactcacaccacacatgcacaccaaacatcacatacacactcgcacaatatgtgcattgcgcacatacacaccacacattacactacacacaccacaccacatacgcacacatgtccactcatgcgcagacaccatacagatacaggtgcacacatataccacacacacattataccacgtactatgccacacacacaaaccatacatgcatacgcacaaataccataccatcccactcacactatacatgtacacatgcacacagacacaccataccacaaacacacgcacaccaccacatacagatacataccatcccacttacaccatacatgtacatacataccccacacatgcacacattcacacagcatcacagacaccacatacagctgtgcacacactgtaccactcacatcatacatgcacacacactacactatatagacaccatacacacacaccacatagatacgcatacacaaatacatcatactatttacacacatcatacatgcatagacaccatacacagacacaccacgcacactcatacacatacacacacacggtctggagatggagtcactgcagccagcaggggtggcgtgcagacaggagggcctaactcaggcaggcacagcaggtacacaggggcggccccctgggggcttgaggcggcccgggaaccctcctcctgcccagcccctcccatctgcccccctgggggcttgaggcggcccgggaaccctcctcctgcccagcccctcccatccacccccctgggggcttgtggccccagcctccttcccgtggcttcgaagcccctcgtcctcccaggccagccccatcctcacccacaggcgctcccagcactctgtgaggctctactcacggatggcaggcacttccccttactggtctcaaaggagaccctggagcagatggtcccgagaccccttcctgccagacacccctgggctggggccactccaggtcggggcatgcaagtgctgcccaccaaaaaaccaccgtggatgcagcggggcctctgcacatcacccctcggtgcactggaggcctcagcggtgctcctggctgagcatggggacttcactaccagtctgccctgggtcacgtatggaagcctcagccggaggcgtgggagctgaaggcccgacgcttcctgttctgctcagctcctccttggaggaagtggggtttgcaccacgatggcccttcacccctgccccctcctctctacacctgcactgatgtcagacagcaacctctcaagacaggtgggacacgccattcctcctgtgaggtcacagcgagaagtgcatcagcttgaaatgagaggcagctcttgggggcaggagtcagtggcagcaccaagcgacccacccaccacgtttgggggttggggacctccaaagcaggcaggggcttgcttccatcagatttgggggagggcaccattagggagaagaacacagaggccttgggagtgaaaactgaccttggaaagcaacaggaacaccttctgctaaggagcggaatgaaaaaccctggagagcaaattcctgagcaggagaatggagtggaggaagcagccaaggaggataaagagatgggaacaggaaagaaaacctgtaggatgagatgttgctatgttgctcaggctggcctccaactcttgggctcaagttatcctatctctgcctcccaaagttgttttttgagacagagtttcactcttgttgcccaggctggagtgcagtggtgcaatcttggctcactgcaacctcagcctctcaggttcgagattctcctgcctcagcctcctgaatagctagaattacaggtgtccaccacgcccggctatttttttgagtttttagtagagacggggtttaaccgtgttggacaagctggtcttgaactcctgacctcaagtgatccgcctgcctcggcctcccaaagtgttgggattacaggcgtgagccaccgtgcccggccttcattttgcctttaaaaaccactgcttggtagggcgtggtggctcacacctgtaatcccagcagtctgggaggctgaggcgggtgaggcgggtggatcacctgaggtcaggagtttgagaccagcctggccaacaggtgaaaccccatctctactaaaaatacaaaaatcagctggtcctggtggtgtgtgtagtcccagctacttgagaggctgaggcaggaggatcacttgaacttgggaggtggaggctgcagtgagccaagatcgtgccatttcactccagcctgggtgacagagagggactccatttcaaaaacaaatttgacagggaacagtcacacagtttagaaaggattatgcaaaccagaatcaatagtgacctgatgaaccgggctttctgacgattctaaaccacggaggctgaggggcccagctaaacaatgacagcacctcggggaagtgggtgagatgtgcagcgggctgtggaaggaggccagaaggaccagggccctagtccaggctgctggtgatgagaactaaacagggcgcagggcgacgagcaagtgctgtagtccgaggagcggcccctgggcgccagcgccatgggtggaggccgtccctcctaaggcgcagccggtgcatttgggaccgggggagcagatcccgtgcctccctggaccccggggtcttgggatcacccggccgcagaggcagaggcttcggctgcacagaaacctggggtggccgcagggaagcagcgccctcaggtgactggagagtgggtaagagaagccccaagaaggacctcgcccatccccgtaggcgtgggacggcacaggccgccaggacccccacgcacagcccagtctgcggggcgcgaccccaaggccagcagcagaggacaaggacggggccagggcaggggccggggttggcagagggcngagggtggggagggcgctctggggaggtcaaggccagggctaggctttcagggccatgtcctggctccccgcccctcggggagacggggncggggagcgctgtgagcagaggggcccgggtggagaaggtgctgccggccagcgggagggagggcagcgggggtgcagcagaagcccaggtggggacttggggtggtcgaggggacccttgggctgcagggactggggaggggagcaaggggtatggcttaggcaggtgccaggggacggttggtgccctttattctgaagggggatgtgctgcccagggcagcgggacctggaattacattttgagatttccaggaaagtttcaggtggaggcagaggctgggcgcagaggaaaatgtggcagtggcagagtgtggggtgagagccacgaagagaggaggtcactgaggtggacagtgggacagagagagggacggggagaggaacaggagtttcagaaacgtcctggacacattgggcagcygtcagcattgctttccattcatggacaaagcgtgggtgcccagaagaggccagaagccagtgcagaagcccaggcctccctgccatcacccggtgctggctgagctgcaaatggctgtgcagagcctcctccatgcctcaccctggtctggaccggaccacagggccctttggatcctttcccag

SEQ ID NO: 10749 - DNA, 35895 bp, Homo sapiens
  misc_feature (1)...(35895): n = A,T,C or G, or insertion/deletion polymorphism (see Tables 1-2)
ccaaggtcttttctttctagcacgtcatatgtgacagaaccttctcaaccaaacagtcccgagaccgcccagatggctgtcttcccatgcccgtgctccgggggcagcaggacaggcctggaaactgagtctgcaggtctgtggagctttcaggagagagccgggcctgggcccagcaacccagcaagtgaggtcaccacccagcctcggccatcttgccaggggttccagctgacttgttagatggcatggtgtggctctcagcaaggaagccagcccctcacccccctgggactccccctcaacagggcacctccctctcagcagcattccaggagcagctggcctgttcacacagcggggcatccttggagcctacattccaccccacgcagccaaactcgatttggaaaacgcctacctccaactattcaggcacctcctcaaatcccaggtctttttttaaaaataagttgaatcagccaggggcacggtggctcacgcctgtaatcccagcactttgggaggctgaggtgggcagatcacctgaggtcaggagtttgtcaccagcctggccaacatggcaaaacgctgtctctacgaaaaacacaacaattagccaggtgtggtgggtgcctgtaatcccagggaggctgaggcaggagaatcgcttgaacctgggggatgaaggttgcagtgagccgagattgcaccactgcactccagcctgggtgacagagcgagattccgtctcaaaaaataaataaataaaaataagttgaatcagccgggtgcgatggctcacacctataatcctagcactttgggaggccgaggtgggtggatcacctgaggtcaggagttcaagaccagcctggctaacacggtgaaaccccgtctctactaaaaatacaaaaaattagccgggcgtggtggcaggcgcctgtagtcccagctactcaggaggctgaggcaggagaatggcgtgaacccgggaggcggagcttgcagtgagctgagatcacgcccctgcactccagcctgagtaacagagcaagactccatctccaaaaaaaaaaagaccagcctggccaacatggtgaaaccccatctctactaaaaatacaaaaattagccaggcacggtggaacgcacctgtaatcccagctacttaggaggctgaggcaggagaatagcttgaacccgggagacggaggttgcagtgagccaagattgcaccactgcactccagcctgggcgacagagtgagactccgtctcaaaaaaaaaaaaaaaaagttgaatcataggaaattgccatttttttgtgggtcaaaaggtcacatttcagcaatttcacgtggttcaaactggggctgattggcgtcgtgggaggaccacaaagtcccatgggtaagagtgggcccaggagtcccgccgcctggtctcacccagctctgctccctgttcctgcacactcgtctttctcttctgtaaagggatggtcaggtcgtgcccctccttcagtgttaggaagatcctgtcaggtaacacaggtgaagctcccagagcagggcctggcacatccgcaatcagtgcatggcagtcagttgttgccgttgtcggtagcaatagcattagtaactgtagccgggtgtggtggctcacacctgtgctcccagctacttgggaggctgaggcaggagaatcacttgagcccaggaggtcaagcctgcagggcgccatgaatgcaccactgcactccagcctgggagacagagcgagaccctgtctctagaaaaatgaaagatacaggctgggtgcggtggctcacgcctataatcccagcactttgggaggctgaggcgggtggatcacctgaggttgggaattcgagacaagcctgaccaacatggagaaaccctgtctccattaaaaaatacaaaattagctgggcgtggtggcgcatgcttgtaatcccaactactcgggaggctgaagcaggagaatcgcttgaacccgggaggcggaggttgcagtgagccaatatcacaccacagcactctggcctgggtgatagggtgagactccatctcaaaaaaaaaaaaaaaagaaagaaaaagaaaaagaaaagatacagtattagtaactgaaggtgggatgtgggggtgtgggggtggggcagacacgcagaacggggagcaggaactctgcttgcccaaatgcagagtggagagatggcgtgaaagtgagtgagtgcacacgttactctcggaaaatgacacagcgttgctggaagacgtgcagccaacctgagacacggaccgcctgcattcctgggccagcagactcgcccctcaagtcaaaaggaataaatgtaaccaaagaagtgtgagacttacataccccaaatcccaaaacaccactgaaagaaattaaagatccaagctcctcctggacgcctgggctcaggaaccctcccctcagaacgatcttggccaccgacctacacaaatcctcccctcctctcatacccaaagggcattgttgctatagtgccagcccttcagcccctcggatgctccagctccttattctagaactctccatcggcagttctttctctccagtgacgctgcctgtccatggacccaccagcttttcactgtccctgccgcctgctgcccatccttcccgccccacccagcgcagatccctgcaaacaaacgcagctcagcctcccgtctgtgccgtctcccaccaacacactcagacaaaacttcactctcacacgtaacccagcctgcaaacagccccagtcccggtggctcccagcaaagggcattttgttcttcccctgccgggctctgcagggctgggccccgggctgcaggttgaggtcagggccgctgtccctgaggtctcagctgcaaacaggcacactcccttctgctgtgtgtcccaaggggtgaagcaaaccacggctcagcccaaatccaaagggtgggtaagtttccgccactgccgtgacttgggcagggagagagaatctcgtaaacacacacgaccatctccagcgctcttcccctgccctgccacgcgggccactcaccgcagccagagaaaagcacagccgtgctgccaggggcctgggaaacttgtgaatggaaattcgcaggagccctcagtgctgcccacctctcctccttcccttcctcttcctcctccttcccttcctcttcctcctccttcccttcctcttcctcctcctcctcctccaatctcctccagttctgagggcccagccttccggccaccaggggatggtgcaggcccaggcctctcccctctgctcgccccccagtggggtagcggtttatcctctgtccactcatgacatgtgcactttctgcatacgtgttatactctgaacaaaagtaacaacaacaaaaccctccatcagctcggcctcgctgtccacttgctgctgaccagctgtcaggcctattcctttgaagaaacagaggtgattagaaggaagctcttccaccttgtccacaggacgccagcattcctgcatctctggctctgagctccttcccagtacaatgtggtgggccaggccctcctgggggctctgctcctgcagtgcctcctctcatgtaggcagacacagaaatgaggcagaggctagaaaatgatgagggccggggagatgtgtttttcttttttctttttttctttttttttttttttgagatggagtttcgctcttgttgcccaggctggagtgtagtggcgcgatctcagctcactgcaacctccacctcccaagttcaggcgattctcctgctccagcctcccgagtagctgggattacaggtgcctgccaccacaaccagctgtattttttctttctttctttctttctttcttttttttttgtatttttagtagagacggggtttcaccatgttggctagggtggtctcgaactcctgacctcaggcgatccacccgccttggcctcccaaagtgctgggattacaggcgtgagccattgcgctggccagtttttgtatttttagtagagactagagacggggttttgctatgttgaccaggctgatctcaaactccggacctcaggtgatcctcccaccttggcctcccaaagtgctgggattacaggtgtgagccaccccacttggccattcgtgcactttcagtggtcaggtgtagctttttcattttaaaataggacctacggctcacattgatataactaagtgaataaataaatgagggagaaggaaaactctaataatggaatgccaaatggtacatggaggagtgatgggcttagaaaaaccactattcagcaaccattttattttattttattttacttatttatttacttttttttttttttgagacggagtcttgctctgtcgccaggctggagtgcaatgacacaatctcagctcactgcaacctccgagtccttggttcaagtgattctcctgcctcagtctcccgagtagctgggattacaggcacgcaccaccatgcccagctaatttttgtatttttagtagaggcgaggtttcaccatgttggccaggatggtctcaatctcttgacctcgtgatgcgcccgcctcagcctcccaaagtgctgggattacaggtgtgagccacagctcagcaaccattttaataaaaatcaattcagacaaaatcatcagtaagtgttaaaactagagagtgggctggctgcagtggcttacccctgtaatcccagcactttgggaggccgaggcaggtggatcacctgaggccacgagttcgagaccagcctgtccaacatggtgaaaccccgtctctacttaaaaaaaaatacaaaaaatagccaggtgtggtggcaggcacccgtaatcccagctacttgggaggctgaggcagaagaatcgcttgaacccgggagagggaggttgcagtgagccgaaatcacaccactgcactccagcgtgggggggaggttgcagtgagctgaaatcacaccactgcactccagcgtgggtgacagagaaagattctgtctcaaaaagaaacaaaacaaaacaaaataacaagttagagaaaccagatagactgagtgacagattcatacacacctgcacactgtgtgtgtgtgtgtgtgtgtgtgtgtgtgtgtggagagacagagagggagcaaatgtagtaaaaacttaacatttgaaataacaatgagtttctgataatagaagcaaaaaaaattaatatttggaaaatctggatgagggaatatgacattctgtatggttcttgccacttttctaatctaaaattacgttaaaatttctaaaaaattaaaaagtatttgggctgtgtaacaaattactgcaaacttgagtggtttaaaacaacacacattgggctgggcgcggtggctcactcctgtgagcctagcacttttgggaggccgaggcggatggatcacctgatgttaggggttcgagaccagcttggtcaacatgatgaaaccccgtctctactaaaaatacaaaaattagcctggcatggtggtgcgtgcctgtaatcccagctactcgggtggctgaggcaggagaatcgcttgaacccgggaggctgaggctgcagtgagccaagatctcaccattgcactccagcctgtgtgacacagactctgtctcaaacaacaacaacaaaaacaacaccgtttatcatctttctctcccgcaggctggctgaaggctctgagggaggccctggccacctttcccagccctgtggaggccgccagccatccctgccatttctcgtctggtggcagcacatctcatctctgccgccatctccacatggcctttttctctccgcgtgtctgtgtccacgtctctcttcttataaagactggacaggattttttttttttttttttttttttttttttctggagacagtctcgctcagtcgcacaggctggaggacagtggcgcgatcccggcctccaatgccaccttccagagccttcatgatgtaactccatccctgtcccctccccacatcgccggctttattgttcttcgtgtcagttcctgccagtggacatttaattctaattcacgtctcactccctcccctactgtgagccccacgtggcagagaccgcggcggagctgcgcgggccggaggaggctgcggagcatcgctctgacctgagccggggacgctgcggaggcgcagcacgttcctctgcccagagctgatgggcaccgtccgtgtctttcgctgcaggtccggggggagactcgggggcctgggatcccccatttagccatagggcggggggatcaggttcagcctctgaaagtccagagcacgatgtttgggaaacggccccgcccgcggcctccgggacctggcgaaggagccccgcggggcgcccctgctaccaccctgcgcggagtcggccccgtccccgagagcgcccggcagcccctggccgtgggccgcaccggagccgcgcaaggcgactgttctgcgcctcggmtcggggttcggacccggctctgggcgcggtcacgcggggcgctgcgcacggcgtccggcggccacagagcgcggccatcgagtcccgccccggcgcggcgccccctcccgggcccgcgacacacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggtagaagacaccaccggggtccgcgggtgggggtggctggaacccggggcgggcgggctcaggcgaagaggaaggcgggggagggggcggcgacccgggtctgcggttgaatcaacagggcgtgggaatggggcgggcggactggggtgggggcatgccggggtcccggggagggcgggggtcgggcaggccggagggtcccaggctgcggcggggtggggaaggggtgggggggaggggcccgggctgggtggggtggaggaggggctgggggggcgggtgctctgccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggtgagatccggccccaccgagactcgctcccctctctggacagaggatctcaactgggtcccggtttccctctccgcgcctccgcccagagttgcatcatctgcaccgaaaggcggcgagacagggtctcccaagacccccgccccaccggcgcccacgcctgcggtcttgaccgcccagaagatgggggctggccgtgcacgtggccccgggctcccaccccagcccccgcgccggcggagtggaccccactggcggcgagtcctggagcgtggagcagggacgcggggtgggaatccgggggagatgcacgtttcggtgcccagcattgagttcgctgcattgtggatgggaaatggctgtttgcaaatcgccctttttggcggaccgtgtggggtggcggtaaacgctgtcgttgcgcgggcggcacgcgaggtgggtgcccgctgggggagggacgcggggctctgcccaggttgcgttcgggggatggaggttttcctgggacctcacttccctgagccccaggcgagaccgcagctgagctgtaggatgcaagcgggaggcggagcgtgggtgggagagcggagcgcgaaattctcggcttcccgaggatcttctgggcttacttgtccccagctttgtcccaaagtgtcgcttccggaggcggagtggccggcggtttccgggtctcagtagggtctggatctcccacctggaaacctagaggagtttcccgctctccgtgcgcgtggccttccccaggcccctccgggagtgctggcgcgcgagtgcaggggtgccccgggaacgtcgtgaccccaagggggtcttgtggtttaaggagcgaacggaaccggccaggcgatgccagctgaacccgccttcccgggacgcacgtgcatccggccgcccggcgctgttgtcttggggagcccgcgggttcgggtctgggtcgcctggcgagctttccgccgagcgcctctgagttctacagagccccgacggcttgcgatctgcgttcccggcagtcccttaccttgcgagagagggctccagggcgaggcgaggggccaaaagcaaggcgctgggccgcctgcgtctgccggggcctcgggtccacggctttctggaagattcggcggcggagcatgcgcgccccaggccagacagggcctgtgccagacggagagtcccttcccgtaggtgactcccgcgacccgcggaggaaggtgctgctccgctcacggcggcggcttcttacaaggttgggatagaaagaaaagcgtgggacacgaacctctgaaagcgggtgcatttttctggggaagagaagatccaacgccttcggattttcagacaagtccgtggtcccaagaccttgaaagcaccaccctccagggtcgtttgaagccgctttggcccccagtctggtgaattgcaaaggtggaggggaggctgggaagtccaggaggccaagctgaggcctgggtagggcctgtgcgcagagaccacctgaacagcatactccaagggcttccaaaggcagccggcttccgcaactttttcttttttaataggctttttaaaaaaaaagcagttttaggccgggcggggtggctcactcctataatcccagcactttgagaggctaggcgggcgaatcacctgaggtcaggagttcgagaccagcctggccaacatggtgaaacttcgtctctactaaaaatacaaaaattagccggatgtggtggcgggcgtctgtaatcctactcaggaggctgagacaggagaactgcttgaacccgggaggtggaggttgcagtgagccgagatcgcaccactgctccagcctgggcaacaagagggagactccgtctcgaaaatttaaaaaagagcagttttagatttagaaaaattgaaaaaatagatagagttcccccagtttcccctgttattaagatcttaaactgatgtcgtatatttgttactttatttattttcttttatttttatttttatttttattttttgagacggagtctcgctctgttgccaggctggagtgcartggcgcgatctcggctcactgacctccccctcccgggttcaagcgattctcctgcctcagcytcccgagtagctgggactacaggtgtgcgccaccatgcttggctaatttttgtakttttagtagaaacggggtttcaccatgttggccaggatggtctcgatctcttgacctcatgatccgcccrcctcggcctcccaaagtgctgggattacaggcgtgagccaccgcgcccggcctatttgttacaattaatgagccaattccacgatcacataaccattgttgacattaaccaaagtccgcgcttgagtcagatttgcagagttttctcctcactgcccttttctattccaggatcccatgacagattctgttgtcacgtctccttacagagtttgagcggtgctgaactgtcagcaccatctgtccggtgagtgacggctgtggacttagtcttcctgttgaatgtggggaatcaaaggagggtgaagcggggctgagcccagtcctgggccctctgaagaaggcaaggtgggaggtggtcgtgggttccttgtccccccagaggaggggcagcagatgggacctcgcctggctttctttttgctttcttcttttttttttctgtctcatctatttcaggtgcgtgtgtgtgtttttaatcctgggtaaaatacacgtaacactgatcactgtaaccatttctaagtgtgaggcaaccaccgtgactatctccacccagaacgttttcatcatccccagcacaacctctgcacccattaaacaatcaccctcccttccccactcacctcagccgctggccgcttctattctactttctatctctatgaatttgccagacatagaggggcgttcgagagtcccaggtgcctcatcgtggaagtggaatcacacagtatttgtccttttgtgtctggctcatttcgcttggcataatgtcctgaaggttcgtccgtgttgtagcgtgtgccagaattcatttctcttagggctgagtaatattctagtgtgtgtatgagcctactgtgtgtgttcatccgtctgcggatacgtgggctgcctccacgttttgacttgtgaatagtgcagcagtgagcatgggtgtgcaagcatctgttttgttgttgttgttttattttttaaatagagatggggctggagcccaggctggtcttgacctcgtggactcaagtggtcctcctgcctcagcctcccgaagtgctgggatgagaggcgtgagccaccgcacccggcccaagcaactgtctgcttccattttttttggtatatgcctataggagagaaatggccaagcggctgcccacagggctggtgcctgtgtttttgtgcagttcttcctgggcttctctgagggagcagagcacgcctcccagagggggccgggtcagcagggttcgctggaaccccacagcatccragcctgaaccgacgcctctctccttgctttgccaggtcccagcatgccttctgagacyccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccgtaagtcctgcttttgatcacaagagggctgatccataacctggagggcaggagtttgttacctggacaccacacagccaggaggacatgaggtgtaaccccctgtagtcactctggattgaggagctgggggtggggccatgccgtgtagatgaggctctgagaggccaaggcctccttacgctgcagcccagcgcctaggccagtgcctggcaagacagtggatgctcagcaagtagttccagaataaataaataaatgtgcccaggtcacatgctttgcccggtctgtggctgcgtgtgcacattcactggaggtgagggaccaggatcctgcctgcgctctcttatttatttattttttatttttttgagacacgagctggagtgcagtggtgcaatcatggcttactgcagcctcaatctcccccagttaagggatcctcccacctcagcctcccaagtagctgggactatgggtgcccaccatcacacccagctgatttttgtatttttaggagatggggtttcacccaggctggtcttgaatgcctaggttcaagtgatccgcctgccttggcctcccacaagtgttgggattacaggtgtgagccaccgcgcccggcccagcctgcacttttccgttaactctaggtcatgaagacttcccgtaggcattacatatttttccataagggctgtttttctggtggcacagactgttcggtgaagaagccatcattttgtaagccctctacggggtagatagatgtttgcagttacctcattttacataactgcartagaagatacgacacattcatttagccaacaagtctttcctcagcgccatgtgcatttcgtgccctgctcaaggcgcagaagatctatcagtggaaaagacaaatcaacaaaaatccctaccccagcatgaaactgaaatcaagctcactaagccttaggattatctttatttccttagtgtamtcttggaggagaacaaatagatcaaagaatgtgcttcttagatgtttgattccttttttttttttttttttttttgagacagagtctcgctgtcacccaggctggagtgcagtggcgcgatctcagctcactgcaacttctgcctcccgggaagcgattctcctacctcagcctccctagtagctgggattacaggcatgtgccagcacgcccggtggatttttatgcttttaatagagatggggtttcaccatgttgtccaggctggtcttgaactcctgacctcagttgatccactcgcctcggcctcccaaagtgctgggattatgattcctattttgtgtccaccactaccagcgtttatggttgttgatttacagttcagaatgggtgggggtggctgggtgtactctcagtgcagcaatagaaagaaagaagtgacagtggacaaacccagaaggtctgagtgtcaaacatactcagtgctgggagctcaggaggccaagcagatgtgtgggcagccaggaggatgggctcttgctgccaagacaaacccaagagagcagtgggtgagaggcccggtgaggtcgggagtggctgctggagggtggagtgggcagggaagacaggcccgattcctgagggctccgtgagctcctaactctagggcatgagaaggagacgatgccctccaggttgtaaatggcgttgcacctgcacctcacatactggcctcattcatcctccgaagacacccccatcctgagacgcagagccgacgccgcttgtctccagtcggagggcccctgagaatagtggcgttgcggggaggtgctgcagaggtgggtcaggagttggaggttcattctaggacagtggcgtgtcctcccaggagnctcttgggctgtggaagtgggagtccttgagataaggggctccagggctatccctgcaagtcacatcctttttcttgctaagcgctctgggcctggccctgatcacctctgcaaacttctcaggtaacttcacagccacygaggcccagtgctgagtcagcacacctgctgcagggaggcgggactcttcccgcctggctggccagatgcccgaactgaattaatgaactaatcccmggcgctgtcaccctggggcttggctttccacctggccctggctctctacacctgccaagcctggttcccttctgccgagaactgcttctgagggaacctccctggcccctgtacagtttggggacctggcaggactgccttctgctccccgggaagggtgcgattggattccagctgctcttgttggcgcctgttttggccttcagggtagctctccctgcaaatgtggcactccctccatggcacaggacctctgggagctgggttcaccccaggtctaagggtcgcctcctggggggcaggacccaaggaccctggctgttcagcaggtgactgtgctgaagagggggcccagggttagccacggggtgtcatcggagctgcaaggcccagggaggggttgcgggtctggagaccgctgtaagccatgcgtgttcccagatgagtatgtggtgagcttggtgcagatagatagggggtgtcatcagcatctccctgggggaggatggcaggggcatgagggccatttaggaaaccacctggaccagggtttgagggtttacacagccagatgctgcagggcagggcatcacgagcctggccgacagcgcctctgccggggctctgagtctgccacgtgcctgacattttctgtgcagggctagacatcccgcctgcgctttgcagccattgtccctggtctaaggagtctctgccctgacacttttttgcttcctatggtcacatgctgagagatgaaaggaaatgtcatctccagtaaagcctttctgaaaaggtggacctaaacctttgttttggagtcagtatttgcttattttaacttttttatttggaaataatttrctactcacaataagtggcaaaaataatagatcctttgtacccttctcccagcttcccactaacaacatctgccacgactgtaggttcattttcaaacctgggaagctggcattggtgcaaataaaccacaggcatgatttgctttttatagatttgtatgtctaagcatgtgtgtgtatgtgtgtttcaggcgtgtgtgtgggatgtgtgttaggtgtatctgtgtacagatttgtgtaaccaccacccagataaagccagttctttttttttttttttttttttttccagttcttcgagtgttgatttgtgtaagacaatgtctgccagggctggtactatttttttttttttttcctgaataattgtggactcctctgtttcagggcaaaatctccaaaaatcttgccagatattctgaaraaaatcggggacacccctwtggtcagaatcaacaagattgggaagaagttcggcctgmagtgtgagctctgtgagtgccctggctttggagaggggcttcctccatctacactgggctccgtgggcctggggggtcctggggggtcctgggatggatcccttaggcaaggccctgggatcagaaaactcgctggttaatragtggccaagaacatatcagcttaagtttgggaaaaacacacaacagggcattgtgtcagagggtgaccaaagtgactccccagcagatggacmagggaacgaacaggtgacctttgaactgaggccggagtggaagcagcgagggtgtgaagggccgggtgagggtcaaaggcagaagcaagcaggtggggagggttagcgtcatgcctgctaaggagcagtggacgggtcctagcacgtgctgtgagccacccgctgtccagggagcggttacctctgtcttgccagcttcgtggggacagatagttcagctcatcatttatgagacagagaatgggaatttggagggtctgtggctggcctcgtcctgggtgcgcagggggtcacctgaggtgtggtctgaggcctccggggaagggcatttctttgcaggacgcagtttccaggctcaagarcgtggagggaattcctaagggtcgctcttcaccaagagcgcagagccctggtagacctcagcatcgtcacagagaaagctgtgggtgcagaggccttggggacaaggcggggacggaatttcgtatttcagatgaccaaggycaagtgagttcggagggaggcaggaagggtgccgcggagaaccccgcgacagggccagatggagggggtggagttcgagtgggaaggagagggaaccagtaacatggcttgggactttttcatcctgagatgctctaatgtcccagccgggggacctgtgagagctggggcaggcgctgggggaaggaagtcaggggtcggtgcgttgggaaccgatcgccgattcacaggaggggcctcgtgggagcctggccctcctctgcccccctctagggaaggagatctcggagctgcagcagagcagcccccttcacagagacccccaaggcagcagggccggctctgtgctcatttgtcagacaatagggacccttaactcgtacgcagcacgcgtggctggctcactgtgctccgtacaggatgacgtctaaacttgryggttgcccttgaagtaggttttggaatgcccgttttacagacagacacnccgagggtcaggttggtcacgtggcttgccggaggccaccagctctgatttctgcttcggagctggcccccaggcgctagtgagaatgatctaactgagggtttcacagtatgggacccagaggggtccgagaatgcaggcctgtagagggccagaccccgagagtcctccccaccacacacagcgcctcgtcctggttctaggggcaacacctgtctggtggttgctttcagaaattttgaggtgctgcaggctggtcccaggtccctcaaatcacatttcatgcagcccaktctctcgctcttaaaaactaaatatttttaagagctggagagggagagaggacttgcagtaaggaaggaagtgcaagtgaaggccttggccttgtgcgggaacygcgcagggagcccttccccgggcaggtgacgccccacaggggnaggaggacaatgggaggctgtagggagagtatgcgagtccccatccgatggggaagccagtgctgtggcttcaggacatcaagctgctttggcaggggccgctgggtatggctgggcataggggcgtaggggacccaaatccaggcgcctgcccgccacaagcccagctcgtgggtggggggacggggttttctgcggcgccccccagtgagggctgcttatgcctctctggttcccacagagttgctcagcgccctgcaggaccggtaggatgggctgcagggggagaagctctgataggctagtgcccaggtgcaggtgtaggggaggtgagtggagaggtggcaatttttcagaacccacagacccccaagcccgtcccccaccctggggtgtatcaggtaatgggggggtgagcaggaatcaatggsggggtggtcagggggtcccctctgtgattcatctctgcctcccagtggccaagtgtgagttcttcaacgcgggcgggagcgtgaaggaccgcatcagcctgcggatgattgaggatgctgagcgcgacgggacgctgaagcccggggacacgattatcgagccgacatccgggaacaccggtgggtgccaggcccagagggggtggccngggctggctgtcmcctacccatgccgagcctgccgggacccggggnggatggmtgagctgcagccgcatgtgctggcccgcctggccgcctgctccctggcatcttgcacccgctgccggcctgtgtcccaacctagcttcctttgaccagcattcggggccagtgccgatgctctcggggcgatggcacctggcagtgcctggcacacaagacgagcacccggagtctgctcttcctgtgcctgtgtacccggctgggcctggaggaaccagatctcctgtcctgcgccgctgcctcctcctccttgacgtgtaccttttatttctgcctctggcagcctctctccccctgcacttgaaggcagaagcagccatgttgggcaattttggaatcccacagaaccctcttccctgggccctaagggaaccggcatcggggtgtgcccctgtgtcccaggcaggggcggggcagggcttggggggtcactgggcccctctcaccctctgtgtgccctcagggatcgggctggccctggctgcggcagtgaggggctaycgctgcatcatcgtgatgccagagaagatgagctccgagaaggtgggtgggcrtggccaggggcggggtcatagggcaggggatgagggtgcctgggccaggcggaaggtgcaggccaccgctttccctcctgcaggtggacgtgctgcgggcactgggggctgagattgtgaggacgcccaccaatgccaggttcgactccccggagtcacacgtgggggtggcctggcggctgaagaaygaaatccccaattctcacatcctagaccaggtgaggcacctggggcctggagacaggcattccctaggagggtctcggtcagggatgtgggggtgactgaggtgtcaggggtcagctcacgggctctgctctctttctatgcagtaccgcaacgccagcaaccccctggctcactaygacaccaccgctgatgagatcctgcagcagtgtgatggtgcgtccctctgtccatcttgattgcatttatccctggctgcctgggagtgtacacatctcttgccctctccttggtgaactcctattcacccttcagaacccagctcaaatgttccctctgtgaaatgcttttctagagcatttctctagaacaatttcctccctccgttgtgccctcttggcctccgcctgtggtttacctgtaatagcaaacacagggcatggctgtatttgtttacccagcaatctctgcaggtctgcaggggctcctcctgcagataatgcagacagcgagtctgttcagggcccaggctggtgctgggctcacagcttggacttcatttgggatcatgccctgactcggcatcaaattcatctgcagaacagagctggtgacatctgcgatgagctcactctctgttacaagcatgaggccggctccttgggcccttttccagggactcggtgccaaggcctgtgggggttggtactgaggttttcccaagagatccctttagagataagttgccaagaggttggcgccctggcttcctattgggaatccggtgttggcatgggctggagtacaccctcagtccgtgcccaggagccgggctgtaaggtccaggcatttggttgtttgggctttatgtgtgagaactctctcatttggcaaaaacagtcctgtctcagcatgggtgcccaagctgctccgtctcgctgagtctttccctgctgtgacttctccaccagatgcccgcgctggcggccagcagtgtgagcgcccagcgagtttctgcgctgaagcctaaaagactgattccatttcctgtgtaaattcagttaactcactcacaccacgcaaacatccaacagcccacggaggtggttaattcacagcctccctctgcccgccctcagcgcctgcaccccccggacagggtcctgtctttctgcatccagccaaatgggggttttaggggtcgagtgtcactgagcaaagactgggctggggtgccccaggctgcctgtttctgaggctttcacagaccaagggcagcaacgagggctgctccaactggagaagaagtttttcttttgaactttttggttacccaccgtggtttgggctgagtgtgttttcaatgattattactatgagtgatgggctggccaggcagggacccaagaatgttatccgtccaccagggaagctggacatgctggtggcttcagtgggcacgggcggcaccatcacgggcattgccaggaagctgaaggagaagtgtcctggatgcagggtgagtggtgtggccgggccggrgaggggcagtgcggagtggccccggcttctgagctgaaagctgtcattcctcacggtctgctcagcacgctgtctcccgcggtatttctgcgctgcctgggaggtgtttgggaagacaagggtgcttgacacataagggaccagcagctcgtgacccgaaggagctggggctgggtgctcgctcaccggccagtgtcttggagaaccttcctgcnctgagtggggggtcggagttccaactgggggcctctgaggatcagccaggagctctaagtcctctggtcctgagtctgcccctcaactggggcttgtgggagttgggagagggttcctggactcggggttaagagcaggtctgaggacgggtgcctagaaaggtcccgctgatgagacaagggcgttctctccctgttgcttgcccttgaaaaagacgtcactgcccagcaatgccctttgtccccaaaggctctgctgctccgccgcagggtggtctgtctggactgtcctgggggccccgctccgagaagcaccccrgggaggtcagttcctcccaggcacctgcctttacttctgagcgccctgcactgaacatttaggtcattaccgctttaatacttggagcctgggttcttgggtttctcatcctgcctctgaggctgggaacaggccaccacccacaggcagatcattaacaggcagttgttaacggcrgtattggccactcccataatagaatatygaggcatgtccaggcggggcttttgctggccttgagccctgaagccgckccctctgcagatcaytggggtggatcccgaagggtccatcctcgcagagccggaggagctgaaccagacggagcagacaacctacgaggtggaagggatcggctacgacttcatccccacrgtgctggacaggacggtaggtcgagtccagagcccggccacagtgccrgtgcagcctgtaactcaccctcacactggggagcctggctgaccctgggccccaaccagcttctccactgaaacagaagggcaagccccgcacrcatggtgagaagctggtctcgaaggtcgagacaaagtagactgggggacgatgtccgcacacgtggcctgacctcaccaagggatgtagcccaggtggcacaggcagggagcagggaaaacgtgtgaaaattaaggccccggaaaagtctgttaagagccaaaaagctgactttggcctgagggagagcagagaccgaagggccggtgtgggtcacacggatgctcagtggggctggcgggcagttttgctgtctgcaaaacgtgttggaactggaaagtctgcagacgtgccgatcccagggggagaggctggggtgagacmtctggggtcctaccgcctagacacggggtccaccatgaggctgttcaccctcttggtcacgtgggagcggctcccacgctgacgggctgtggtggggtcctgctcaggtggtggacaagtggttcaagagcaacgatgaggaggcgttcacctttgcccgcatgctgatcgcgcaagaggggctgctgtgcggtgagtgggtggcgggcacgggggtatggggaaggcagagatggctagggggcactggggatggctgggggcgcaccctcagtcagccaccgacctgcatgtgtaagacagcagttctgaggagtgtcactgcggcggccacgagcctcaggtgttgtctgcctgcccagtgtggtcacctgctcaggtgagggcaggaggccatggggcggggcttcgagctgccttccagaatgtgtttctagaacaaggctgaagctctcatggcacttattgtttctaatcaagtccaccagggcccctggggcggtggctctgcattgacggggcccatggccgggactgggtgctgcgagcaccctggagcagctggggaggggactggagcctgaggctgtccagctcgaccccgctcaccttcctcctaccccgtgcccctctgcccacctgcttgggggtggacagaccaggtggccgctggcaatgccactgactagccacacaggcagcagaggccctgtagggaccayagttgatctagacctctggggactcggagagcacacaccagcttctaaaacgcaggcagggacatgtgaggtttctacatgtgcattccgtgtgtcatgtcactttgggggtggtgacagggaaagtggaaggaaaccagccctcagcatggccaagtcccccgttagctgagccccaaactagagattggaagaaagtcttgattgaaaaaccatttcccagccaggcgcgttggctcatgcctataatcccagcactttgggaggtcgaggcgggtggatcacctgaggtcaggagttcaagaccagcctggccaacagggagaaaccccgtctctactaaaaataccaaaaaaaaaaaaaaaagtagccgatgtaatggtgcatgcctgtaatcccagctactcgggaggctgaggcaagagaattgcttgaacctgggaggtggaggttgcagtgagccgagatcacgccattgcactccagcctgggtgataagagcaaaaactccatctcaaaaaaaaaaaaaagaaaagaaaagcattttccagatgaatctgtcacgaaaggtgacttggtgcccataatcgttgggctctccctgtctcagtctccctgctccccatgttggtggagaaacaagcccctgcctttggggctggaaagcaggtccatgggccccgttacagaggagggtgcctctcttcctgtgggggctcctnctgcagacttagaccttcccgactgctgtgtgcaccctcaaactaagcccagagaagacgcctctgactctgacttcagggctcctagggacagctggtgtcactgtgagccttggtctcttgtttataaagcagagcccagtgtgcagtcaggcagcctgcaggcgtggtgctgggggctccgtcctcgtagcatcgctggctctaggctcagggccaggaggtttgccaggggccgcagccccactgcaggcatttccctggcaccagtgcccaccccagctcattatgaagccccgagtggacacagaaactccatggtgcacaaggaagaagccgatgctcacggagaagtggggtcctcccagcccctctccccgaggcaacccctcttgacggatccttcggagtgtgtctgacatgctcccatgcgtgcacgtgcacaattcatgcatacgtgtgcacccacgcacgctcaccctggcgcgtctgactcgtggccctctctgcaggtggcagtgctggcagcacrgtggcggtggccgtgaaggcygcgcaggagctgcaggagggccagcrctgcgtggtcattctgcccgactcagtgcggaactacatgtaagacacggcttccctcccaggtccctgctcctctccatcctgccacccttccctggatgcctctcacgcctcacctgagaaccggcagccagaactgggaggggaggaggccagcggggccctgtgagcaccgcctccactctcctgcccacgtgccctcacgctgtggggcttcccagcctcttaatgctgtgaaaatcaatgcacactcgcagtgacagccctgacaggaggggcatgaaagacggtggctccctctctgtccctcctgtcccttcctctctggtgtctgtccccctcactgctctggggtccgtgagctccaacgggtagccctggccacatggactgacgtcctcttgggccgggccctgtgccacctcctatccaccctgactccctctgctgcttcccccaaactccagattgggamcgagtgctgcccaggtggccccctaggacttgctgtgactgttttgcccagaggcccctcggacagtaacgccacagacctcgctggtcaccgggcagccaggctgagactggcgctgctctgcacctggtctccggaggcggtaccagggcgggtgtctacagacccccatgccctgtcccctgcacctgcagggtttcctccatggcctgcaagctgcagcggctacacagctcccgagagctcagctgcccttggagggccaggcctggctggtgggtgcccccagttgggttccccagtgtggggtgattcacatctggtgcccagggtcaagatgccctgtgcagggctcctgcccacccccgtcagtgcaagaacaccatctccccacatacttggccagcctgccaygtgtacctgtgcgtgtgagtgtgtgaggggcagagagcgagcatgagaggacgtgtttatctgagtgcctgagcgatggctgtgtgcatgctcacacacgcttgttggccatgggggcgggaagtccagcccccaggcttccccctggggcttccagccagcacttgggggtctctgctgcaccagtgaggtccaggagaggggctgggcaggcagtgcgtgccactcagcaggggcgggggcccggtggggccctgcggggactcggtgactcccccatcccgcaggaccaagttcctgagcgacaggtggatgctgcagaagggctttctgaaggaggaggacctcacggagaagaagccctggtaagaccgctcggccggagacccgctgcctgtgctggccctgcccagtgtgacaggcaggagagcactcccccgtggcctgtgctggccctgcccagtgtgacaggcaggagagcggtccccgtggcctgtgctggccctgcccagtgtgacaggcaggagagcggtccctgtggcctcctgctgaggtgctgccggcgggggtgcgagagcgtttgtccttatcctgatccccccgacctgccctcttccctcaggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcggggtcagtctcagcccctgctcagagctcagtcctgggttctgtctgcccagctccaccccgtcagtgtcactggacagggcagccatgcagaccctgcagctgggctgataggcccgcctgggccgcctcatacagacgttcagggcattggaggccccttgccggtccctgagcagcctggggcagggctgccgtgctcactccaggccctcagacctcagcccacccaccctttgtgtgcaggctgtcctgggcccacctggaggtcaggggagagatgccccgaggacatgtctgacagcagaaagccttggcacacatgcccagtgaccactgagagccccacgtcgcggaaacctgacggctggtcacccttgaccctggctgaacgggtccaaggactcttggtttctttctccccaccagggcccagactggttcctgccgcgtgtaggctcgtggcagaggacttccatgtgtggccagagagcgctcctccctggggcagctgagcgtgtgccccacygtcctgggaggggtgaggtatgagngctgacccctgcctgcccccgtcccacagggtaatcctgggaatggtgacgcttgggaacatgctctcgtccctgcttgccgggaaggtgcagccgtcagaccaagttggcaaagtcatctacaagcagttcaaacaggtacccagtcacctacaggcagctcaaacagatgcgcrgtcacctacaggcagctcaaacaggtgcccggtcacctacacgcagctcaaacaggtgcgcggtcacctacaggcagctcaaacaggtgagcggtcacctacaggcagctcaaacaggtrcscggtcacctacaggcagctcaaacaggtgcgcggtcagctacaggcagctcaagcgggtgcgcggtcacctacaggcagctcaaacgggtgcccagtcacctacaggcagctcaaacgggtgcccggtcacctacaggcagctcaaacgggtgcccggtcacctacaggcagctcaaacgggtgcgcggtcacctacaggcagctcaaacgggtgcccagtcacctacaggcagctcaaacaggtgcgcggtcacctacaggcagctcaaacaggtgcccggtcagctacaggcagctcaaacaggtgcgcggtcacctacacgcagttcaaacaggtgcgcagtcacctacacgcggctcaaacaggtactcaggcacttcgggaccccagagggtgccagagtactccagcctcgaaggcgggacaccgcgcttcccgtgtgggggtgctgggtcctcgaccctcaacaccacttaggccgaagctggctgcacccctcaaaccatgaagctgagaagcacccactttacaagtgcagcagccggagaggaggctctcatcagtgcaggctcatccacaccagccgtgttttggggacttaaggaggtcattcgcgctcagaggctgtcccgggcaccatgcggcgtctgccggggtctttctcctgcccagcctcatttgcctgtgcatgcacttggttatccaacaagagctagaacattctgggagaagcccacggtggctccttgccgggctggtcagactccgtggttgtcctgagacacccaccctctgctgccctgagggtggcccaggaaagtttgtgtgaccttccacacggatcccctgggacatgcaggtgtggctcttgacactggaaaggctgagggttctgcccaaacctaggagtgaattcgacttctttcccatctcacacacacacccgagacgtcacccgaatccacgtatttcccacgttcggctgccactgcctcccnggtgggctttgcaggacccaccatcgcatcccctctcactccacagaaaactcgtggggccrtgttccccctgccactgaccacgcttcccttgcagatccgcctcacggacacgctgggcaggctctcgcacatcctggagatggaccacttcgccctggtggtgcacgagcagatccagtgtgagtggggccctgctctgtgcgtggggttctcactggggtcaggccaccaagcctggcctctgccatgggcagcagctgggccccccatcccctgcggggtgttaggggagtgggtggtgccgaccttcagtgacacccagtctttatgccngggcctcccacatgccctgggctggtgggctgtacctgtgattcctrcagggacccctcatcaggccacactgggtagggccctttgtccagcatgcagaggctcaggagtccaggccccttgcctccggggaggccagcagtcttggggattctcagggacaagcccagaaacatctagaagggtttcaagtcctgaccctggcattcggagggctgctctgaatggaagcctcatgtgggtctcacaggagccactgatgggctgtcctcagagccccgctcccagcaagctcatgaggttttgcaactcctgagcgcatccccgggcgtccccaccacatccccacaggccaggagagtcgctcgcaggttttgggtcatagatggcagccctgggcctggggcccacaggaagagttgggaggggccctggagcctggagcctgcccacccaccaggcctgtgtgcagggggtgagcgctcggtggctgaggctggtccgtgagggccccaagtctaaccccatctcccgtccttggctctgcagcgcaggaccaggcctgggcaggcgtggtgggggggcctgcaggtaggtatcacccacccctcagaatggctctcaggctcagattcacagcctccccatggcaaatggaggccttccagggtcctggacccacccccaagcttgggtaggagggatccccctcttaatctcacatttacttgtgtttgaacatctcagaaaaaaaaaaagatgcaaattccaatgtcagggtccccaaatcaagtcttcctggagcytgtccacgcttgtcaccaccgtctgtggctgctttcaagcacgtcagggctgcgtgctcataacagagacggcacngcccccaagacctaaaataccaccagctggcccttgtcggaaagtcccctggctggccctagtccattgactctgggccgngctgccaggnccacagaagcctgcggcactcagggctcccagggctcccttctccaacagttgctgtgcctccgtttccccnaaatgcaaggagctgatctcatctgtgttccctntcttttcctggggctctaagtgggccaccccaagggacctctgcctacaaagagaggagtgacagccgtggcggagttgggacgggctccgagggctcttcctcacccgcaccttgctcacccctctgtgcctcatgacagctggtgtagggtcctgtggagacgcaggaccaagaggatgtgtggggagcggggagagagagggaacgagatctgtgttaaggaactggatcatgagatcacggaggctgacaaaccctgagatctgcagggtgaggcggcaggccggagactggagagccagcagttcaagccccaaggcaggaaattccacctttggttctattcaggccttcaactgcttgggtgaggccctccacagtagcacacgttatctgcctcttgactcttgtgctaatccggaatcccctcacacatgcccagaacgacgtgtgaccaatgcctgggctcccacggccccgttaatctgtattaaaattaaccatcacaacagccctgtctgggtatgtggcatgggagcctcggccagcattaacaccgggtctacgcttgccaggagaaagcaggaggggtgaagacagaatcaggccagagatggaagctgtgtgctgcccatggtggcaaggggtttttgtctgtttttagagacagggtcttgctctgttgccgactggagtgcagtagtgccatcatagctcgctgcagcctcgacctgctgtgctcaactgatccttctgcctcagtctcccaagtagctgggaccacaagcgtgtgccaccatgctcgactaatttatttttaaaaatattctrtagagacagggtcwcaatatgttgcccaggctggtcccagacttccgggcttaaatgatcctcccaccttggcctcccacagcgctgggatcacaggtgtgagccactgtgcccggccctgtaagcgggtttgaatttcatgcccacaccggctctgaagtcatgagtgcctcaggagctcagccggtgggccagggaagggtgtgtcctgacctgcggtgggtggagcctggcctggggcccaggggactcacgtggtgggtagaacctggcctgggggctcatggggctcatgtcagaagaacactggcttggccaggcacagtggctcacgcctgtaatcccagcactttgggagccgaggcaagtggatcacttgaggtcaggagttcaaggccagcctggccaacatggcaaaaccccatctctactaaaaatacaaaaattagctgggtgtggtgatgtgcacctgaagtcccagatactcgggagtctgaggcacgagaatcacttgaacccaggaggtggaggttgcagtgagccaagactgcaccactgcactccagcctaggggacagagtgaggccctgtctcagaaaaaaaaaaaggaacacagccttcgccgctgggctccagccaccctgggcccccatggtgcacaggtgccccaggccctcaggagcctcctgccccgcagcagcccacccagcctcccacggcacctgcaaacccactgcctcgttctcccctcagaccacagcaccgggaagtccagtcagcggcagatggtgttcggggtggtcaccgccattgacttgctgaacttcgtggccgcccaggagcgggaccagaagtgaagtccggagmgctgggcggtgcggagcgggcccgccacccttgcccacttctccttcgctttcctgagccctaaacacacrcgtgattggtaactgcctggcctggcaccgttatccctgcasacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcrcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaaytgagatgaaattcaaataacctaaaaatcaatcacttgaaagtgaacaatcagcggcatttagtacatccagaaagttgtgtaggcaccacctctgtcacgttcyggaacattctgtcatcacccygtgaagcaatcatttcccctcccgtcttcctcctcccctggcaactgctgatcgactttgtgtctctgttgtctaaaataggttttccctgttctggacatttcatataaatggaatcacacaattgtggcctcgtgtctaacttatttcactttgcatggtattttcaggcatgtcagagcacgtgtacttggtttctttttgtggccgaataataagccattgtgtggatagaccacattttggttcctcatttatcggtgatggacacctggttgtttctgcttttcagcccttgtgagtaacctgctgtgcaccttcatggccgagtatgtctggacacctcttttcacttttcttgggtgtgtacccaggagtggcattgctggttaatgtggtaactccatgtttaatttttttttttttttttttttgagatggagtcttgctctgttgccaggctggagtacaatggcacaatctcggctcactgcaacctccacctcctgggttcaagcgattctcctgcctcagcctcccgagtagccaggattacaagtgtgcaccactgtgcctggctaatttttgtatttttgtagagacagggttttaccatgttggccaggctggtcttgaactcctgacctcaggtgatccacctgcctcagcctcccaaagtgctgggatgacaggcgtgagccactgcgcccggcgtccatgtttattttttgaggaaccatcaagctgtgttccatactggtcacaccgatttccattctcaccaacagtgcccgagggttccagtttctccaggtccttatcaacacttgctattttcttgttttaaattattatagccatgctagtgtgtatgaagaggtgtctcattatggttttgatttgcctttctgtaatcattggtgatgttgagtgaccatcttttcatatgcctgttggttattttttgggagaatccatctcctgtttttaaattgggttgtctttttgttgagttgtaggagctctttatatgttcaggatactaagcccttatcataagacttgcaaatattttctcccattctgtaggttatctttttactttttttttttttgagatggagtcttgctctgttgcccaggctggagtgcaatggtgtgatcttggctcactgcaaccttcacctcctgggttcaagctattctcctgcctcagcttcccaagtagctgggattacaagttcccaacaccacgcccagctaatttttgtgtttcgtattttttattgttttgagacagagtctttctctgtcgcccaggctggaatgcagtagcgtgatctcagctcactgcaacctccgcctctcaggttcaagcagttctcctgcctcagcctccccaggagctgggattacaggcacgtaccaccatgcctggctaatttttgtatttttaccagagacggggtttcacaatgttggtcaggctggtctcaaactcctgaccttgtgatctgcctgcctcggcctcccaaagtgctgggattacaggtgtgagccactgcgcctcgtctactttttaatatttttagtggagacagggtttcaccatgttggccaggctggtcttgaattcctgacctcaagtgatctgcccacctcggcctcccaaagtgctgggatgacaggtgtgagccactgcgcctcgtctaatttttaatatttttagtggagacagggtttcaccatgttggccaggctggtctcgaattcctgacctcaagtgatctgcccacctcggcctcccaaagtgctgggatgacaggtgtgagccactgcgcctcgtctaatttttaatatttttagtggagacagggtttcaccatgttggccaggctggtcttgaattcctgacctcaagtgatctgcccacctcggcctcccaaagtgctggggtgacaggcgtgagccattggtcccggtctctttactttcttaatgttctttgatgcacggcagtttttagttttggtggagtcaaaatttgtttgtttgttttttcctgttgctcatgctttgggtgtcatatccattggcaaatccaaggttcatggaaatgtacccctatgtcttcttctaagatctgtacagatttagctcattgttcgattttgagtcaatttttgtagatggtttaacatgggagtttgtggatgtctgtctgtctcagcgtctcttgttgaagagacgatgctccccccatggaatggcctggcaccgttgctcacagatgtatgggctcatttctagactcagtgctattccattgatctgtgtgtctggccttatggtggtaccacactgttttgattactatagttctgtagtaagttttgaaattgaaagtatggatcctacagctttgttcttttacaatgttgttttggaaattatgatgtatcctgatgtatttgtccttatgtttttgtgtgtgaaattctttgagcttattggatcccagcacgtggcaagtaagagttccaaaaagaaaacaaggaaggatctcagtaatgaagtaattcacaaaactgccccagaactcaaagacatgactttgcagaccgagaggcccacccagtgcccagcaaaatggaccgcgaaagatctacacagtgaacatcactgtgaaatgtgaggtcactcaagacatgagaagtctaaaacactcccaaaaaaggatgaaaagcccagctcacacagggaggcttgggatgagaaaggcatcaacttcagcctccagcacacatggaaaccaggagatgaaccctgacggaattcagaagaggaaggaatgcaggctggaagccctgaggccagcaccctctcccttagcaccggaggcaggagacccacttccatcatgcagggcaggctttctgcccaggaacacacgccaccaaaaggagggaatgaaaacaggagaggaaatggtgtcacaggaggtcccagggccactgtgagtccagcagcagtaggacagaggagacctaggcgagaagattgcttgaggccaggagttcgagaccagcctgggcaacacagtgagaccctgtctctacaagaaaaaagaaaggaaaacaactcctcaggaggctgaggcattaggatcacttgggcccaggagttggaggctgcagtgagccatgattgcactactgcattctagcctggatgactcagtgataccctgtctcaaaaaaaaaaaaaaaaaagacaggagtgatgcttcaggggagataaggaaatcaagaggtcgccagagtgctgtgagcctatcaagagatctgcatgcctggtggagagttgggagttgcatcagaacctagaaaacaaagaggccgggcacggtggctcatgcctgtaatcccagcactttgggaggccaaagcagacacactttgggaggactcgactcaacacacacacttgagtccaggagttcaggacctcatctctattaaaaatagctgggcatggtggtgggtgcctgtggtcccagctacttgggaggctgaggcaggaggattgatggagccagggagattgaggctgcggtgagctgtgattataccactgcactccagcctgggtgacagagcaagaccttgtctcaaaaaaaggggagaaaatattggagctctgtaagaaatgtaattacataacatgactaggctaggaataatagttgcttcatcataatcgtgtaaacactggatattaatctattctcaattataaaactgtcctgaaggaatccgagaatggaattatatttcctactagtggggaggagcatgggagaggaagaatcttcatttttccacagaaggatgttgatagataacatctatacttacaaaaagaaaaaagcagctgggcgcagtggctcacacctataatcccagcattttgggaggccaagatgggtggattgtttgagctcaggagttcaagaccagcgtggacaacatgaggaaacaccgtatctactaaaaatacgaaaattagccaggcgtggcagtgtgccctgtagtcctagctacttgcgaggctgaggtgggaaaattgcgtaagtttaggaggtcgacactacagtgagccgagattgcatcaccgtgctccagcctaggtgacagagccagaccctgtctcaaaaaaaaaaaaaaaaaaaaaaaaaaggaaggaaggaagaaaaggagggagacaggaaaggagcacaagcaagtttctggacatatggatgcaagtaagtttataggtgagcgccactccagcctgactggcagacggagaccctgtccgcccctcccctctaaaaacagtagagctctggtgagctgaacagtggtccttcaaagctaccaggccctaatctctgaaacctgtgaatgggccctctttggaaaaagagtccagcaggtgtgaagctgaggctcctgagatgcagagacactcctggatcatccaggtgggccctaaatgccctcgagcttccccttcggttttccccgtgtggcccagtgtgagtccgccagggctgctgtagcaaagggccccacagtgggtgcttcgacaacttactgtctcacagacttggaggccagaagtccagggtcaaggtgttggcagggatggttccatcaaccctgaataatgagattcataaaatacagtgaagtccagggtttattcaagcttaaagcttgggaaccatcactcgggaaacagactcgaaaagaatgggccagcgctccagagtgggaagggaaggtctcgcttacatagaggcagagacaagagaagtctgacagggttgcaacgttttccgtacaaggtagtgcatagcttatagtgtttcttttttacgagacagggtctcgcactttgcagtggtgtggacatggctcactggggccttgatctgggctcaagtgatcctcctgcctcagtttcttgaatcactgggaccacaggtgtacaccaccacaccagctaatttttgtagagacagggttttacatgttgcctaggctggtctctaactcctgggctcaagtgatcctcctgccttggcctcccaaagtgctgggattacaggcgtgagccactgcacccagcgagtttgaactctttaatgccacagctccttctggggctgagggaacctccgtcccaggcctctccggcttctgcgggttgctggccctgcttggtggtccttagcttggagaagcacccccttgttctccactttcatcctagcagggcattctccctccgcatctgcatccacattaccctttgtgtaaggacaccagtcactgggttagggtctaatggcctcatttagctttaatcacctctttaaagaccctgtctccaaataaggttatattctgaggtagtgggggttaggtctgcaacatgtcagttttgaggggacacaatctagcccatagcactccccacccccaacacacacacaccgtgcacagagtgcctgttaggccggrtgtgatggctcacgcctgtaatcctagcactttgggaggccgaggcaggtggatcacctgagtcaggagttcgagaccagcctggccaacatggagtgcctgttgacgagcacctcccagccttggcacttgctggacgagcctggaaaaaagccacaactctggacccagtttgatctgggtttgaatccaaactctgccacttatcagttgggggttcttgggcaatatgtcccaatttccatgtctacaaaatggagataagatctagacatggagataagatctacctcatgcagatgaatggagaagcaaaatgtggactatccgggcaacggacaatgattcagcttaaaaaggaatgaaaccacrccacgtgctacaacagcacaaaccctgcatgaccccacgaatcctgcgtgaccccacttatgtaaagaatctagaacagctgaactcagagaggcaacgagaacagtggttgccaggggctgaggagggggatgaggaatcattgttggctgagaacagtttcagttcgggaaagtgagaaa

SEQ ID NO: 10750 - DNA, 32611 bp, Homo sapiens
  misc_feature (1)...(32611): n = A,T,C or G, or insertion/deletion polymorphism (see Tables 1-2)
gtgccaagccatggacggccctgcctggactctgccccagaagcctgcccatggaggacagaagaggaggctgctccaggccaagtgaccagctgctctggggactcgcagcccagcactgggagctggcagggagcaggaggggcagagcgctctgcctgggctccaacaaacaggctttctagtgaatggaccaattggcggttgtgggttatgtggccaattgtggttaggggaagggaggagctcctggaggaacactgtattcctgctcctgtcagtgactccgagagagttctggactaagaggtgggagcacaagccctgcccactcctctgggctccagaattaagcccctgccccacatcctcctggcccctggagcaggggttctccccatgacaggattcagaaagggctttcctgagtggaaccagccttggtcatatgccaccccactccccgtcccccaccccccaccacaattccctgactgaggaggcattagcacagtcactctggagtccccctttaatgacatctgaggtggcactgactgaacaacaaatgcagtcccctccttgcttcaccagccactcaacaatgaccactctaccccttctctagctatattctatattctatatattctaagcaatgctctaggcattttatgcataatcacctaactgatccttataccaacactatgagtaaggcactattattattattattattattatttttgagacggagtctccctctgtcgcccaggctggagtgcagtggcgcgatctcagctcactgcaggctccgcctcccgggttcacgccattctcctgcctcagcctcccgagtagctgggactacaggcgcccaccaccatggccggctaattttttgtatttttagtagagacggggtttcactatgttagccaggatggtctcaatctcctgacctcgtgatccacctgcctcggcctcccaaagtgctggaatttcaggcatgagccaccgtgcccggccgagtaaggcaccattattaacttcattttacagatgagaaaactgaggcacaaaaagtttaggtaccctacccagggtcatggagctatcaggaggaagagctgggattttagcccaagcagttcggttacacagctaatgctcttactcaccacactgcactcgtgagggctgtgagactcttccttcccccagggagaagtgcccagcagcagccaatggaaaggggacttgcctgctggctggaggaccccggcctggggctcacggcagccacagaaatgagtgagtattgctggttgtagttggagtcaccaatgcctttccttccttcacatggggcaaccttaggaaggtgtcctctccccacttactctcctgctctgggcctcccccatctctgcccatcctggcctccatacagagcatccaagcatcaccttggacctcccagttggcactgggcaaaccaacatagagaaccaagacaaagcacaaccttaaatcatgtaagtggaatagaggagtctgtctctctggctgtatctaggacctgatttcttctaattcccaatctcttctctactccaggtttctgatttccttcaagtgacttctgaagccaagccactctgggcctttggggcactggaacatttcttcattgtcctactcactgccccttgatgtgtgtgtccctggcagtctgtgaggagggaggccatgtaattcaacgaagtgtgggcaagcacaggccaggcatgcagcaggcaccaaaaatgtctattgtactaatagatgactacagacagtgtaggttctcacttcctgtttctaggtaattctctgcctcgtttactctgaagtcacacagggccaggataggaagtgggcttgctgtgatgcttgtgcaccagctgacacatcatccttttcgtgattctctttttccgatgaaggttggaaactttcattctagaagggtcctcagctgagggattgtgactttagggaggtagagagggcacttgggaagccagaattcactgtggataaatgtttgtcagtttctgggttagatttttcagttctgaggagttcatgagagcaacctaagaatcagtcctgctgaggttcaggagacagtgccgggcctggctgtggcgggaagctccgggagaggaaagtggacaggctgctgatacagtcttgcattgcagcagtgcttgcccttcaggggtgacacaagtcctgaagccaccatgtatttctgtggctctgggacaagggggacagctgactttcccccagccataggatggggtggtctcgacaaatatcaatagttccaaagtaccaaagattggctcttggtagtttgccaaacacaaaggcttcacagcagccctaggaagctggcaggaagctgctattcccatttaattgacaagggcattcagtccaaaatccttccctgctggctgctttaccacccttcacgctgtctctcaccttgaaagtgggagaagacatgactgaaagggcaggctgcagtgcaaatgactataggtgcgtggctgggagatgggatgctctggctctgacgtcctgctcccaaacctggtcagccaggagtcctacattctggccctttctgtagcactgggacaagaaagcagcattttctctgcagccccagcttccaaggcagctgctgtccacccccagtctactttctaaagagccacagagccacttaggtggaagaaagagagaaaggtgggaaggaaggagaaaaggaagggagaaaggaagagagaaggaatagcaaaaagaaagaaaaggaaagagaaagaaatgaagaatgaaagggagaacaaaagaaagaaaaggaaagtaggaaagaaaaaagaagaaagggagggggaagggaggaatgcatgaataaggggagaaagaaagaaaaaagaaaagaaagagaaaggaagaaagcaagctctttatgatagaaggccattccctagaaaagatctcaaggggaaattggctgtcaaatagtttcaaggaaatgacatttggacaaccagcaaatgagggtttcctcccacttcctgccatccatctccatttccctctgttcaatctctcttctccctccagtggttcattcctctggcaaatagcatctctcctatgctcccttytactctcctctggggtcagctgagcactgctttcttgatgatgctacgttaggaaattatcaaaaccccaaatctcagttgcttccaattcccctatacctgtcccagaacctggcctgggacatgacttcactggtagcagggaggctagcagctaagctgtccagggtaagcatgcagagctgagtcctcttactccaggactcactctggaggtcctgaccctcaactcttcattcatgtgtgactctggaggaggaggcttatgctgtctgggtctccattttttcatctgaggcaacatgggatggaaaatctatttctgtggtaccagcactccttgccgatggatgggtacaaacagcttgcatggatgtgaagagctaagacaccacgtgcagacggacaccatcctgctggcttggccctaagactgcaggcagaacctgccagccacaagtctcccagccagccaggcagacgcagtggggctggggggcttgcggagggtggagagaagaacatcagctccagggcaggagcaagtggaggagactcaggtgagtcacttcaggctagccatcagcttttccagcctcaatttccctgtgtctggtgacaaaaagtgtccacatcaagcagatccacaatccctccttttaaggtaacagagaagagacagctgcaagtcccactgtggagtcatggttatcaaggaccttgctcatccctctgcaactccgtgaaggcagagcctcccagagccccacagtctacatgtccaaagagctttcataactgaacccctactctgtgttgtgcatggccctagggactcccatatgtcagcccgtttgacctcatgaccactcctttggggaaagtcttaaaattgccactgtacaaatgaggaaagagaggcccaaaaggctaaggggttacacagcaaagttacacagcaaatgaatggcagagctgggactaaaatctggccttgggactcccaagtccactgcaccattgtggtgtcattgctttagaacccatgtgagtgaacagataataataacaatagcacttactgtcttcaggccctgtgctaaatacttcacaggccttatctcattcaatactcataacaccttggtcagagagagaaattaacatctctattttatagacatgggaactgagagaagtttgtccaatgtcacacagcaaatgacttggcagagctaccaaggtcaaatcacttgtaagtagtggagtcaggttcaaaccagggtatgtaaagaactccagtgcggggaatgaggacctcaggccttgcaccaacgtggagaatgattacgctcctccagaagctgagcaaagtccaaatgccagcctcagtgaacctgggccagggctgggttggtgaaggaaggagcaagtaaaactggacccctttctcaacaagtctgttggtttatctttctcaggttacttcctctaaccttttatcagtcttaagaactgtggtgtcaacatgttatctgaaatcattattgtacagtgaccatgtcattgttgtatccccagggcccagcacggtgcctagcatctggtagcacatatttgtcaaaagaacaaagtattctctaatggcatcattcaactcagccatcattaacttggtacctattatgtgctaggtaccattgatccagaggtgactgagcatgggtgccacctggaagaagtctcggtctagggtggggacagaatgtaaccatcggtaccaccttaaacacttcgaaaagtactgtggagaatgaatggatggcaaatgacttatcagagccagcattgaggaatgagccaagtccaatgggaacacaggaaaaggaccctttgctctgccaggagagtcacagaaggctttgctggtggaggatgagatgcaatttcagcctgaaatgatgaggagtttgtcttcagccatgtggagaaaggagcattccaggcagagggaccagtctgagcaaaggcattcgggtgtaaaattattgcctaggattggagtgaaggatatgtagcgctactgacaagagactcctcttcaagagcaggccacatatcctttatttcccagggggtggaaacgggcaacctcacagaggaattgaatcataatgaattgaagaaagaaaaatctcctgaagttggcattataattaataggcttaggctcatcctactagtcctcacttagactcattctcatgtagaaacaaaacgtgattaatcacctcagtaagtgcaatttccaaaaacatccagggaaatctagggtccaggtgcaggacctttccaatctgagttggattttgcctccaggagagagcatgggtaccagccagcattttcatcatctaagggtcaggtgccttgaagtgtctgctggcacccagggaagagccccccagcttgctgtcacaggacacagctgctcccttcctggccaggtagctggcctccctcccagaatgggacttgaagctggccgggctgcttgggggctgcagaggaagaagggggctgccggcaaacctgctgactcaggctccacgagggagcaagtaacactggactcctttcggcactccgagaatggggtgggggcgtcttcaaaggatttccctcccttcccagtgcttgtccctgctctcggtccgttttctgctaagatttggggattttcaggcctggagggaaagtcccttgggacgatcatagagcgctagcactgaatcagcctggagagcgcggaaggaaagggtcggtccgcagagggcgcggggaaggcagggtggggacgcggtggagcccgcgctcgtttgctgaaggcttggaagtgcagcgcagaagacagagggtgactaggaagacgcgcgagcggggctggccggccggcgggtgggggaggggaggcgggggaaggcggctgagtgggcctctggagtgtgtgtgtctgtgtcagtgtgtgtgtgtgtgtgtgtatgtgtgtgtctggcgcctggccagggtgatttcccataaaccacatgccccccagtcctctcttaaaaggctgtgccgagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacggtaagcgacggccgcggcgctgggcccgggacgggctggggcgggggctcggcggccaggcggccgggagcggcccctcggagccgacagcctgggcgcgccggctgcactggcccggcgttcccgccgcggacgaaccgcctttgcgcacggactgggccctggcgccagggcggaggccggtggcggccctgcagctgcaccgggactgccaggcttccctgggaaacggagggctgctcaccccattgcacggaggggaacactgagccacctgcaggcaggagcccccgctcagccagggtgccctgcctctctccctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcttggggctagctcagaatctctttttcttgcaaattctggtttcatcggttggggagattctgggctttgtggtggtttatggtggtttgcagtgcttgaggaaaatggaaagagggtttggtgttgcagagctgtgtccaggggcagggtctgctcctgactgcgtaagggacgccctgccccaactgtggcggtagcagatgcagccatagaaagtgagggtggcactgttcatgaccagtcagtgggctcataatagatttgcttctgaggagtcctggaagaaaatgagaggggaaacctggggggaaaagagcagaaaattatttgggggtagaggagagcgggctgcaggtgaggtgagagagaaagggaagagtgggtccacagaaagaaagtgcctcactgagagagaggagatagagttgagaggggaagggagaagggttagccataggcagaaagcaaagcttcggggctgaaggggagaccatgaggaaagaagagaaagacaagggggctgtgtttagacaggggaagtccaagggcccggttctgccaggtctctccagaggccttgttgagggggaagatgaaatggaataggataggtggcagaggaggctggacagctggactgaggtgtcctagcatctctgagcctgcagcagagattccttctgagggctgctccccaggcagaagccagggctaggggtgggaggaagaggcagtcagaggagagcctgcccagccagatgcaagccagagtgttaaccccccactgtctgtccagatcctcctgaggcagaatggaggccccaggtccaggggtatcccctttggccagcttcgaagtcagcctctcatgtagtggctgcactttccccacactgatgcctcaaatgtcatcaaagccagacagcccttggggttaagcattgctcccaccttgctctcctccagggaggttgtcttcctgagcrgtccctttcatccataccattcactccagaccttgagtggcagccagtctggggtagatacaccgtctagtggcccagtttcctccaatcattcctgaacctaaggtttctgagtacctgggccattrttcccacccagggcaacctccccaacagagcctgaagtccccccagcccccgtgactgccgtccccctcttccacactttccctccctcagatcagccaggatcctcacagtccctgtgctgagtggtatgaaactatcctttggctcttccttccatggctcccacccctctcctgccatcaccttctccccatctttcaaggcctcactgaggtccctgctctctgcmgtctccctggtcacccagccagagctgccttctcctccccagaagagctggcaagcatttgggcttttggtgatatgtagattagcacattgttgtgggctgtttcatagcctcgttgtgtttttccagtgagcaacttatttgcagtatttgtctcaacatctggattattgaggcaaaacccagagtccaggatagtgtcaaccttcaccctaccctgccagcatttccctgaatctgggggcatcagccgccaggaggcttgggagctctcaggaggtgacctcaagctggagaaagaaagcccaagagtctgtctgcttttggctgaagaaggagagacctagggccaggggtagggatgaggagaccccagtgaagagaaggaagagaggaaggaaggggaaagacagggcatcaggagccagtcccatcactctggggctgagcaactactgggccaggtaggtgctgggagagaagaggggtctcagaaaacttctctgccatgataagaggtggctggctggaggcaaagcctgatggtgctcaaataggcaggtgccaggcaagggatggcccattactggcactggtgcctctgattaatcagctgggctccttttgaaacacacacccagggctccaagatgtctctggcaagggatgagttccagtgaaactgagtttgatcccacagtttttccagtggcagagccagatctgcatggaaccaggtgggaggaaatgctgggcccaggggagctgtctctggcttgccatctgaaagccggtgcatgaacatgaacttgagggcagttcaaaaagtgcttggctcagtgttgatgttgcagagacagaaaaaaatgggtagatgcaagtcctgctctcgagtttcctgtgtcattaaaatttaggctggtaggcacaccatctgtgtcagtattagttcaatgtatagttaggtttggctggcttaatctgggaaggcttcttgtagaaggtgacatctgggttgttttcatgggagaacaaggttgtgctgtggctgctagaaatcctgggaaagctggatttgagggatgctgtatcctgaggtaaggggcagagcctgtagcattgtagatatgaggcctttgtttttctgcgttgagcagggcatggggataactggggagagtgagacctggggagaaatgacamcctctctgtcacagacatggctgggctccctgctgttgttggtctgtctcctggcgagcaggagtatcaccgaggaggtgtcggagtactgtagccacatgattgggagtggacacctgcagtctctgcagcrgctggtgagtgtgtggccatgctgtattctaccttctccccactggggaaatgaaggcaggagccagggagcaggtcaaagagagcagttgcaggcaggaaaatagggcagtgcgggacattgcttgtggttcccactagctccaccagtgatacccttcactaaccttcccaaagttaggacctctggtctccccagctcgaagccctctctgactgccctgcaggcagtggatgctgtgggcttccagctgcttgcctgggttagtgattgcccaggaacatcaaccactgattctgaaaaggcttctgaggtctgctgtccctcagtgggatgcctcctctgggaagctagcccaggcggcctgctgtgtccagatgttgcatctagctcctggactctcatatgtggcgccagtctggcatcagagccccacccagatttggaggggaagcgcttgcctaactcccagccttccacactcacttccctggctcttgcccataccctgaggctgggatggcctgctcatctgggccatgaaggagcctgtatctcattctaatcagacccatacgtggtccagccaggcagaatcaggttgctgtcatggctgctgtcctgctcagtgggaatttaccattcctctggccagccaggcagggtggggcatcactggctaacgccagctccagggccctgagcttggggcctgtgggctgtgccttcygcctctcttgccccagcactacttctcctgtatgtagttgctrtagcaatccaaggtagaccaagagccccagcattctctgaggcttaaaatccagaactgctgctctggggctaaagagggctttaagggcatccagctccaacccctacaggtgttcaatccccagagcttgtccagcctctgcttgaattcctaccatgacagggtgctcactgcctccagggaagattatatcctatattcttctatagacatctcttccttaaaacaaatgggcatttgtcagatttcgtggggtggtagaaggaaagaagagacttcttgttcttctacagccttcccctgggcatctggaaggcactgatcttctcctagacttgactctgtctttccacgtgtggttggcagggatgaagttcaaaccccaatccactcagaagctaaggtccccgttttgaagaaggctgaaggctgagttgagctgtaggttaccctgcaatcrttggcctgctctctcttacagattgacagtcagatggagacctcgtgccaaattacatttgagtttgtagaccaggaacagttggtgagtgatggctttttacaaaatccatgcaccagcctgcatgcaactcccagggtggggtgtgtgggggagcatgaaagcggcagaatgcctactgctggaaagggtgagagtgtgaggatccatgggtgctcaactctggggtgccaggatccagggctcaagtcccctgccattcccttctcctggcctgatacataacaagcgctcactaggtaccaagcactttgctaatgtagttctgacagtaccactatgtggtacacaaatacagtttattatccacagagaggtgaaaggagcatagctagtaggtgctagaggcctgatttgaatccaggaaggttggctgtagggcttgaggcaaatcaatacttcttccaggtcacaagctttgcttaaggatgtcacttctcttcaccaggccaaccagcaggcaggtaggcagtccagcccttcctggacttgccccacacccaaccagccaccaagtgctgctggttctgcctctcagcatctctgggttctgtctcctccatccccaccttcacccctcaatcagttgcttggacaatttcaagagcctcctaactggtgtctccctgctttctagttcactcstcatcttaccactgggggaaattttctgaaacgccaacctgctgcctttacctccttctcccaaaaacatcagggcccccatcactccagaagaaagccaaggttgtctagtctgggttacaccaggtctagccattctccaccacacaagcctctataccacctccccattccctgcttcttcctgcctcccatctttgcacaagctctttccaatgactgtcatgcctttccacctgccccccaatcattattccacatctattcatctttatgcctcatgcaaaactgccttgatacccagaagttgcccctgtttctgagcttccacacacctgacccatatgcacctctgttaggactagagatcacctcatggtccaaagaatagcctcagtattttatgcactcactcgcttgctctagcactcatgcctgaactagcatttgctaggaacctactggactagatgctgggggtagagagctaaagcagagtgggtcttcaaggcaactaccatctctttagggagacaaaacacagaggttattctttggaccatgagatagtcttcagcacccctatgtcctggaggatttgaaggggccatatggtaaaagatatttgtgaaagcaagacaagaggaagacagaaagaaaggcaggggaaggttccctggagcccaccttccctatatacatccatcgtgattaaagcctcatattccagaaacccagagaactctctaatcagaatccacatttccttcactctagcccagtctccagtrgcgctagatcccaaagagagagaaagacaggcaagctgagggyggcattctcctagttgctggcatggtgtggtccctcccctgggggaagggggagagcaagctgcaaccctccatctgcctggggttgggggttcccaggccacaatggccaggccataagctccaggttcctgtttttcagaaagatccagtgtgctaccttaagaaggcatttctcctggtacaakacataatggaggacaccatgcgcttcagagataacacccccaatgccatcgccattgtgcagctgcaggaactctctttgaggctgaagagctgcttcaccaaggattatgaagagcatgacaaggtaggaagccctgaggcctggagcactgagtgagggcagagggtggctgtggaggcgccgctctatccacaggcacagagtacattcsctcacctcgcctcacgccattgcttgctcactctcatttatttgtcatcccaccaacctttaccaggcaggaggcaggagggatcatgctgggccctgacaatgtcatcatgagcaacaaatacatggtcccaccccatgcagcttatagtcaagtgagcttggcagctgttaaacaaaccatgacaccagtaaatagaattacaaactataaggactgttcattccaacagcaagcagttattgtgtgtctgttgtgtaccagacactgttctagacaccaggaaacagctgtgatgaaaacagacaaaaatccccacattcctggaacttacatttgggggtganggtagtggtggtgagacagttaacaaaatatgtaagtaaaatatacaacatgtagcatggcaataacagcactggagaagagtaaaccagggatgagacgacccgaaggaagtggaggagtgagctgggaacaagaacctgaagggctcaaggagagcaacagggaactcagacttccatggagttggggaagcagagacaagaaaggcttctgagtaagcaaatattgatttgagctccaaagatgagtaagaattgaaagcagtaaggctagaagaacattctggaacaggaaaagctatgcacaaagccctaaggtaaacaaacaggaaagtgcacattcagggacccaaagggttatcagcatggccagagcatgggaagtgaaggagggggaggagagaagtcaggagccagatcacatgtggttttagagatgtgggattttgtcttaagggtgagggaagctgttgtgaacaggcatgtggcttaatctcaggttataagactgacctggttgctatgtggaggatagaccacagggggcaggaatggaggctgggagaccagcagaaggtgtgagtccaggctagacacattggcggcttggaccaaggtgggacagtgaaggtggaggcaagtggactggacatgttcccgtgggtttaggggcagaatcaacaagacttggtacgtgcagtggatgtgagaagctgagggaaagaaaaagccaaggatggtttttgtcttgagcacctggatattccaatgatgctgaaacggggatgatccatgggcagagcaggtttgagggaagacagttcagtctggggcacagcagacgtgaggtgctcatgaaatggtgagtggagacgttgaggaggcagctaggtgtgcgggtcttgagtgtgaccagcaatgcacagatctatgaggcatgggggttcggcttatctgtgaagccatgggactggacagcactgccactgtgagaagagaagcaggcccaggaacccagcatttggagggcaagcagaggatgggggacctggcaaggggcagcctgaaggtgggaggaaaagagggagagtgcagagtcgaggcactgcattccaagatggataagggatggarattcataaaaaagcgttgagaaatcaagcaaggtgagggctaaaattgtccattggatttggcaacgtgtcacacatgctggatcagggtgaacagaaagagaggaagtagagacaccactgtggaagaacttggatccgaatgggggcaggaaaagagatgtagctggagggagtgtgtaattgagggaggactttttgttctgtttttgttgtcgttgttttgagacagggtctcattctgtcacccaagctgaagttcagcggcgcaatcacgactcactgcagcccaacctcccaggctcaattgatcctctgacttcagtctcctgagtagctgggacaacaggcacaccccactatgcccagctattttttgtagagatagggtttcgcaatgttgcccaggctggtctcaaactcccaggctcaagcaatctgtctgccttggcctcccagagtgctgggattacaaatgtgagttactgtgcctggccaggaaaacatttttaataagagaggtattaaatctgcggttttccaacattaagattcctaagaatcacttggrgaatgtgttgaaaatgcatattcctaggacacacccctagagagtctgatacactgggtttaagagtggctccagggccgggcgcggtggttcatgcctctaatcctggcactttgggaggccgagacagtggatcacctgaggtcaggagttcaagaccagcctgcccaacagggcgaaaccccccatcttactaaaaatacaaaaattagcagctggtggtggcgcatgcctgtaatccaagctactcgggaggctgaggcagtagaatcgcttgacccagggtggcggaggttgcagtgagctgagatcgaaactccatctcaaaataaataaataaataaataaataaataaataaataaataaataaataaaagactgaacccaggaatctgcatcttaagcagctgtcgcactgatgattatgacccccttggatattcacttgtagacatgtgtgaatgctgaggggcaggctccaagagagagggtgggtgaagctggaggagctagctcccagcaagtctctggagaagacagtgggagggattcagagctcctgagggagagtgagagtgagacttcatctcaaaaaaaaaaaaaatgtttaccagatagacgtacgaatgagaagactgggctcagctccatcacttaccagctaggtggcagtgaccaagtaaactgccggagtctcactctctcccaggctggagtgcagtagtgccatctcagctcactgcaacctttgcctcccgggttcaagcaattctcctgcctcagcctcccgagtagctgggattacaggcacgcaccaccatgcccagctaatttttgtctttctagctgggattacaggcacgtgccaccatgcctggctaatttttgtctttttagtaaagacaaggtttcaccatgttggtcaggctgatctcgaactcctgacctcgtgatcagcctgcctcggcctcccaacatgctgggattacaggtgtgagccaccgcacccggcctatctggtaaacatttcttaagggctgactgcataggccagggagatgcggcgatgccttcaaggacttcacagcctagaaaagcccatgtttcttccctgtgaagctcagtttaaggaaaaacttggtatctgtgattcagtggcatttaggccctggatgaagctgtgagcatgcatggcatggccttgtgtgaaaggagaggtgggcccgggagtgaaccctgagggatggcagcatttggatatcaggaggagaaggggagcttggtaaggagacagaaagagcagcttgaaaggtgggagaagacccaggatgatgcagcttctcagagctccagtgggtgtgggaagccggggccccttgagcagcacagaagacagggctgggacctcctcagccctccctctaagacacaccaatgccagcaaaggacccatatgcctggcggctgccccgttcccttctccacaccacagctcaatgatttttctcaaactcaactcttaccatgccactgcccacccctaacaccccttcagatgttttccctttgctctgtggacaaaactaaaagttctggtcttggcccacgaggccctcaagacctggcccttgctaacctctctccatgtgcgtctcttgccacgctcctcctagatggtagtgctgcagccacaccagccttcttttagtctttgggcttttcatgcattttcttgcctcaggacttttgcacggtctgttcttgcagcctggacagctctctgggatcccatctctttcctggtttctcttgctcatcttttagttgattccttggggaaattctccctgaacacttgtttagttccccttgttgcacaccatcggatggcccagtacttattcataggactcattgcacttgtaacaatgtgtttagtccctgctggattgctggactcagtgtccaactcagccaggaaccacctctctcttgttcgttgcatgattcccaggtaattaccatatgcctggcacataaacatatgttgaatgggtctgtgaataaatgacatatctcataacctcaggactcattctgctgcaaaccaggggaaaggggagcaaggaaacaaaagggaaaaagaagacagatgtgagaaaggccaagggaatttgacaaataagatggagacatggggccaatggtcatgctcacaaaagggggccctgatctccttccaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaaggtaagcatggcaggggccagcaagtgtgtgggggtggtagcatatggaatggggattgggaggtgagatgtgaagctggggggacccctggggaggcagcctggctgctactcgtgttcccgtgtgcatgaatgtgcttgttctgtgtatatatgtggcttcacgtacctctggtcctgggcacatgtcttttctgacatgtgtgtgcatgcacacctacatatgtctgcatgtggcagcgtcaagaaggatcatgctggtgccttgagattagggagtggaaatgggagcctgtcttgggagccctgtaggtatggaagctttccccactggctctgcaggctggctgaacgtgtggggggttctgtggagacagctgacacccatctgggagtcagggcccttgctccaggagctctgctgcgaatcaccatgataccctggctccagaagtccccaggatgccttgggtgtttcctcaagggacaaggctggatttgaagtctgagcatcattggaactcccagggctggctcagctgcatacatgtgtacactgcgtgtcctcgtctctgcgtctcgtgccacacgtgccctcctacattcaaccttgcttcccaaggcagggtctagggccctgcaacctgccagtggccaagtccagtctcgttgcttcaatcccaagtcctcaagccttggctgcattctagccccagcctgttcctgcctgtggctgtggctgtggctgtggctgtgtggctcctggctatgcatgaaaccagtgtctctggggcttgaagttgtcttgtattggtctggaaggcaaccgttcagcctcctgacctgactgctgctcacccctagcttggcctgtggccagtgggaacccctgcatgggctgttctcttatcttccttctccccaacccccagtgtgtgcatctcaaccctattctttgtcactgctcatgagaccctgcatacggcaccttccctgtgtcatgagcacccactctagtcccatcctcttctcagccccagggctgagctaggagatgagggccccccagactcacattcccctcttgccccgctctgggaaagctgtgctggaggctagtgactctatctcctccccatctttctctctccttctctctrtggttctttcagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggargatattcttgactctgcaatgggcactaattgggtcccagaagaagcctctggagaggccagtgagattcccgtaccccaagggacagagctttccccctccaggccaggagggggcagcatgcagacagagcccgccagacccarcaacttcctctcagcatcttctccactccctgcatcagcaaagggccaacagccggcagatgtaactggtacmgccttgcccagggtgggccccgtgaggcccactggccaggactggaatcacaccccccagaagacagaccatccatctgccctgctcagagaccccccggagccaggctctcccaggatctcatcacygcgcccccagggcctcagcaacccctccaccctctctgctcagccacagctttccagaagccactcctcgggcagcgtgctgccccttrgggagctggagggcaggaggagcaccagggatcggaggagccccgcagagccagaaggaggaccagcargtgaaggggcagccaggcccctgccccgttttaactccgttcctttgactgacacaggccatgagaggcagtccgagggatcctrcagcccgcagctccaggagtctgtcttccacctgctggtgcccagtgtcatcctggtcttgctggcygtcggaggcctcttgttctacaggtggaggcggmgggtgagtagatccccatgaggaagaagagcacgtcccttagggcaggggcagagcctggcgggggtgcaggtggggggacagcttgggtgcggcctgagttcttcagacacagagagataggggctggctcagcacagaggatgagaggtggaaatggaggattacttcgagaattgggaaggttcaagctataaggtcaatgggaagggactggagcagaagggagcgggagagaatattcatgggctgacagcaggatgatatccagacgggcagggagctggaggaggagagcaatgctgtgtgagcgtgtcagggcaggcgtacactggaagctctgcagagcctggggcaggaggacccatagggaacagcctgcaagggtgtggggagaggagaggggacaccatcagcagagagacctcacaaatctcccttgggcctctggctgatccccacttttgggaagttgggaggactcttgcaactctctcataaatacctggggcagcccttactggggatgggccaccgcccccccacactcccccagctcctcagtgagatgctctttcctgtcctcagagccatcaagagcctcagagagcggattctcccttggagcaaccagagggcaggtgagagcttgaggtggggctctgggaggcactgggggcctggcttgggatctgtttcccctcttcgtggtggtggggctctcctgcttgctctgaggaaatggagctgcagaacaggatgggggagagaagaagggcctctgtcctttcccagatatctgggctttttcctgatytctccgtagagttagacagttctgggtcttttcaatctgagagggcctagagcatgtctggggcttaggggtaaacttacggagtccccttattcccctgctcctgctgatgtctaatnccagccctgtgctctgcctgcagccccctgactcaggatgacagacaggtggaactgccagtgtagagggaattctaaggtaagattctgactttgatctccactcctaaaacttacctatacccttttccagtcacgttcacctgttggtgacaccaattcccctgaggcccccacactgactcccatgcctctctccagttccctttccatacatcgccagccaggtccagccaccctctcctttccaggtcctcagctatmcccctgcccctccattccatccacccccgctgaggccagggactattacctctgcattgggcttctagtgttgctgccacctgtgacctcagagcaactaaacccccctttttcaaatgtggcctttataaggtctttaccctcctggagaatcttcagtagctctgtgtggcagccactgcaagccctatattcttggcttggctgccaagccccttcgacagcagctgcttgccagatcgccacccccgcaccagttaaccctcctccccagctgaggtcagttctgcttccttgcttttaggatcatgttgacatagaacctgagtcttggaagggctctcaggggtcatttggccctggttcccaccccaaagggactgcccctctccatgtccccaacagggagccagccagctggctgtcacacactcccagatccagcccagctccctgcctagccacagcccatgccatcttccagtcagactgggagaaacgtcttcctcatgcgaggcaaaactggcttccctgccccctccatactgctcctccctcctgttctcatgaaaaccctcagatatttcaagtcaggtatccatgtcccctttgagaattctctaagctaagtatggccaagtccctcaaacgttccttatatgatatggttttcagacccctcaccatcctggacacactcgtttgtcaatgtccctctgaaaatgtgacgcccagccccggacacagtactccagatgttgtctgaccagctcagagagagtacagtgggactgttaccttccttgatatggacagtattcttctatttgtgcagattaagattgcattagtttttttcttaacaactgcatcatactgttgtcatatgttgagcctgtggtctattaaaacccctagttccatttcccataaacttctgtcaagccagaccatctctaccctgtacttggacaacttaacttttttaaccaaagtgcagtttatgttcacctttgttaaagccaccttgttggtttctgcccatcacctgaacctactgaagttgtgtgaaatcctaattctgtcatctccgtagccctcccagttgtgcctcctgcacattgatgagtgcctgctgttgtctttgcccatgttgttgatgtagctgtgaccctattgttcctcacccctgccccccgccaaccccagctggcccacctcttccccctcccacccaagcccacagccagcccatcaggaagccttcctggcttctccacaaccttctgactgctcttttcagtcatgcccctcctgctcttttgtatttggctaatagtatatcaatttgcacttatttggatgttgttttcatattttttaaaatcttattttatatgtnttgtacattccacatccctaagattgtaagccccttgagggcagggactgtcttccacttttttttgtgtttctttttccatcctgggttctactaagagagggcctctccacatttgccaaacatgcaataaatgttgactgactggcttcagggctgactcacggactgaccctggccagctgtctctaactgaccagcctctagctgaccagttaaccagctaactgactgactctgactgactggctgaccagctggctgggtgaatgactaaccaaccaactatcttggtaactgcctaactgaccagctgttgcttggggagcccattgagcaactgactagctgattgcctgactaattggctggttggctgactagctggggtgacccagtcaagtttccagtcacatcctttaccaagtgcaagccagtgccgcagggctctcccatgtgtggagtgacaggtctgggccccttctagagagatagggaatttggcaaatgctcaaaaccaggggaacctatttagacaagaaccagcagtaacaacatatctggaatcctggggtctaccttgtcagtggggtgggctaagatgggtgagtgggtcagctggggcactggcaagactgtgaaatgacccaggcctcctcagaactggttgctggtggctcagtgccacaacacccttcccacnggtcgtctgtccccaaacccctcgccgtggtcttggccctctgtcccacccctctacacgcccaccctcytttccccacttgcttattctcaggcccgtcccaagctttcctcttccccctcaagatttcacttggagagggaatccagggcaggggctacatccagatcccacttggcccggcaggtccagccctaaggtggtctccaggccaggcaccagtggccttggagagattgagtgccagcccctagagtgactgctgctgtgatttgagaagtgagagagagaaacatagaggcagagactragatagggactcagagccacagaaaatgcagacaccagcacctcagccctaagcagctagaagatggggcagcaggctggaactcgctcactgggtccttctcccctcctgggccctagctgggcctgtggcctggctgtacccagcatggctcatgtccagtttatngttccccttctttccctctagagcatgggaatgggcagggagccagaggctgtggttccatcttccctccttacccagtagggcctatggatgttagggagggaggctccacacaaggtccaaagtcaaactgttggatggggtccaggggatttctgctctgggaacaaarcgtcctgaggatgctgggcaagaggacaaggatgggggtggaaggcgagaggacaaggccctgactcccatggatgatgcgggaggcaaggccctcggcccatccaggaggggctgggttgcttaggggtcgcgtgccaaatgacagtgtgggaatttccttgtcctggcactgcctctagacttttcctctctggcccaagttgttcctcttcagctagctctgccctactgtcttgaacatcatatgtgatgcccctctgatgaaatgaaagattcttctttgctagtgttagcaggaatcaccctttgttcactggaccaaggccaatgagatgacctcgcctgaggaggggtccaaagacattcaagtgcccgcttcgctccttgtcagagccctctgcttgagcagtaacccctcttcccagccctgcccagacctctcccgggccccgttatcttccactgaggccctgattccccaggaggaggtaggaggtgaggccagttgggccagaggcctgggctggtgccagagaaagctgcctggtctctctgtggtgtctggaaaggccagggaagggaggaaaggaagtcctgcctgcagcaccgccagcagcccacaggaatgccacacctcccaatccatgtcctcaacgaccctccccgcattcccactctgctgactagcctttccttctctcccacagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcycagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagkgtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgancaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccackttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgccatgtgagtcgtgggaaagttgcttttggggtgtgggtggcaaacatcagggtgggtgggcagcagttgccggatgaaccccagctcagagaacctttttccacaaaacacaggggaggaaggttctctccaagtttcagtcttggtaccaaaacctcctgtattattgctgtcccaaacacattcatctgcatatctgctcgtattgggcagaaagtggccaaacatcaggcctggtcactggcccctgctcctgcccagcctagcccagcctgggaaaatggctggttgggctctgtccaagggccccggcggcctgcaaggataaggctccttgactgctgagccctgctgaccagggcagaggttgctggctaggtccttgcagactctgaggtgaatgaattctgtttccaggctgggaagtgagtgtggttagcaggggagagccaggagtccgtgtaagggccctcgttcgggctcgaccttcctactggagctggagaggagactgagggtgtggctttccatggggagaggggtgttaggcagggccagaggagttgaaggcccaaacatacaccctgggcaaagctatgacaagaggggcctccccatccctgagggagtggtagacagctttggattagtggttcccaacactggcttccgggagaatcacctggattgtttaaaaaaaatactgatccccgagccccaccctagatcaacaaaatcgaatcttaggggtgaggctcaggcaccagatgtcagaacttttaaaagacatctcaggtgattccaatgtgatccaggataagaagtatctagagctgcactgtcaggtagggtggctatttaagtttaaattaattagaatgaaataaaagtaaacattcagttccttacctgtactatccacatgtcaagggctcagtaactacatgtggctaccatgttggacagcacagaaatacaacatttgcatcattccagaaattctactggacagtgctaccccaaagattaggtccttggacttagggaccaaggatacagggccaagattggcatcaagcacatttgaccaggggctaggtgttcaggtgtctcagtcacccctttctgtgccctcacccctgccaccctgtcccttgtcatttcccttaagatggctcttccctttctatcaaaagagctacagaaaagatttttgaagaaacttacattttatccttcaaggcccctctgagaagccttcccagcctgactcaagctcctgaggcccacccaggttcaattccttcctcccctgtgcttctacagatttggaatttggagtctgtttgtctgtctgtcccaccaggccatggtcagtggcagacactgctacatccctccttttattaaagggggacatgcgcctagtgccttagcgcctaagagtatctggcacacagtaggtgctcagtaactgtgtgccaaaggttaatacttaaagcatgaacagaggcatcataatgcaaattctgaccagacgtaaggggtggccttttctagaggccttattggtattagcaaatgagattagtatctaataactactgttcaatggccaagcagaaggattttcagcagaggagtcttcctggcttctgacagaaatggggctagttagagcccttcctgatcactgggctgtggtggatggaatgtacacttcaaagcctctaagcaaggattggtgatgaggacagcaaagaccccttccccttagctgcctctctggaacccccagaaagacctgagaatctcggcaggcctttcctgggcttcatgtgctgcaggggctgcttgggaagcatcatacctatagagcaatattcgctttgaattgagaaccagagaactggctgagcgtggtggcttatacctgtaaccccagcgctttagggaggctgaggtgagaggatcacttgagcccaggagtttgagatcagcctgggcaacataatgagactccatttctacaaacaaaaactagccagatgcggtggcacacaccagtagtcccagctacatgggagactgagatgggaggatagcttgagccagaaggttgaggctgcagtcaacccagatcataccactgtacctcagcctgggaaatgaagcaagaccctgtctcaaaaacaccaaaacccaaaaaacaacagaaattgggttcttggcttgaatctctcactggctcttactgtttgaccttgagtaagtatttaacctctctgagcctcaggtttctcctcatctgtagaactagtttaagagtacaaaccaggtggctgggtgcagtggctcacacctgtaatcccagcactttgggaggccaaggcgggctgattacttgaggtcaggagttcaagaccagcctgaccaacatggtggaaccccatctctactaaaaatacaaaaattagccgggcatagtggtgcacgcctgtaacctcagctgcttgggaggctgaggcaggagaatcacttgaacccgggaggcagaagttgcagtgagccgagatcgtgccactgcactccagcctgggcaacagagcaagactccgtctcaaaaaaaaaaaggaagagtgcaaaccaggtatacctggactgcagttcaaataaaatgacaaacccaaaagcactttgtgggctccaaagggctgcccctgaatcaagtgtgtattgatactgtgcctgccagctggtccaacagtgcccaagccaaacagagagctcccctctgggcaagccctgggcaccagcatgctaccagggcctggctgttctcagaggaaggtggcagagctgggtgcttcccacagggatgagtagttagagatcttgttgctcagggatttctggctgacaagaagagccaggtaggagactggagtggaaagtggccttgggttgctacgggtgccggtgagcaggcagggtcaggaactctggcttggactatataagcagaggccacggccaaaccccaaaccactatccggccagaggcaggaaagtgaatcagaggagacgaggaagaagcctgaggttaacctcrtgcagactgtgggccgtggcaagaaaggagttggtgacaggactagatgcagggcctgggtgggtgtccaaagaccccttgaataaggcactaaagtcatttggtgaaggcagtggccagggagccctgaagaaaaaaagccacatttcccagtgagcacatgtcccctgccccagtgaaagcctcctctgccagagcagcacttttgtttgctggtttccctcttcaggctctaggattaggggagtgaccaggctctgctcctgaatgctgggactgctgagggagcaagtggaccacactagcttggaaagccccatggtgaagcggctggaccacaggaaagcccacaggttgacccccatggcaccatctagagtccatactgactcagctccactactgggtggctgagtcagaagaggctatggatcggggcagtggagaaggctgggtcaggcagttgtcgagtgaattcctggaggagggctaggggagaaccctaagttggactttagcctctctggtccacaggccccatccctgctctgaagtcttggacaccttcccccagccactctgctattttgtcctcttcatgtgtgtgcatctagtgaggtctgtgaaggcaagagcctcatccttatttattcatttacttccccattgattgccacacactgaggacaaaatggtaaataagagtcagtgaaggagacaggtattagtaaaacaatcacacaagtaaatatctagtcataaagtatgaatagaattaggaagatacctaacagggaacctgaccagggatgctggactctgcaggccttcaggaagattaagacaaaggaagccacataagggttacaggcagtgaggcatggtctgttcctcttccttgtccaagactgtcaacaagatcaaatggaaggctatttactatttactggtatgtatggggcactctgtaaaaatgcaatcacattctattctacaatagccctgtaagcaaggtgctaatatcctcatctgtagatgtagaaactaaggcttagagaaacttaactcagccaaggtcacagcagctggcaagtagcaatgcctggatttgaagccagatctggctgttttcaaatacagcatcataacatcacactctagcagacatttaacaaatgcttcttgcacaaaatggacagctcgtgccagcttggtgggctttgagggtccccagggccttagaattctccttcttcctcccctcaaaaggattgtgtagtctgaaactgggcaaaaggtgcttatgacagactcctgttttctcagtcttgctgctatccctaaatccaccaggaaagaagagggacctctcctgggtggtgtgtccactgcctgggcctctgaaaaaggcctctcttgactgtcagtccctccttctggcttctcttggcttgagtcctttgtgacccatgtgtttccttcctgcccaccctttggacctatcccaaccacctggttaattattgagccaggtgacacctggccgttgatcactccagctggcagcagctttgtcatcattcttattttgcctgattacratttcccggaagaaagggctagaaatttgttctcccacacccagccagatctccaggggaggttgtccaggcctgggctggggttgcatgggcaaggctggatcaggaccaccaagtgtgacatctgcaggctcaatatgctctagtgattctggggagacaggccaaagactaggggctgaggaatctcacgggtaggagcagggccctcacctggcctgtgatatttgggggatcttccaagaggtgtgactatcagagggcactattggtacgctttccatgttggttttcctgaaaagagctccatgcccacatgcaggaaactgtctctgtctactctcctgaagaagagtttcaagtttgaagctctttgggtatttgggcccaagtcctctgctatgttcagagtatttctctgtattaacaacaacaacaacaacaaatcctggggaagggggtaaaaatgtgacttccagaggtgatgcattatattattttaaatgtctagcttccaacaacaacaacaaacgtgaggcatgtaaagatacagagagtattccctatacacaggggggaaaaagcaatcaatagaaactgcttctgaggaagccccaacattagatttactagacaaatattttaaatgaggtattccaaagtgttcaaagactaaaagaaaacatgtataaagaactaaaagaagatataagaatgtctcaccaaatagaaaatatcaataaagataagaacatatagacaaggaacgcctataatcctagcaatttgggaggctaaggcaggtggatcatgaggtcaagagatcaagaccatcctggccaacatggtgaaaccctgtctctactaaaaatacaaaaattaactaggcgtggtggtgcatgcctgtagtcccagctactcaggaggctgaggcaggagaattgcttgaacctgggaggcagaggttgcagtgagccaagactgtgccactgcactccagcctggacaacagagtgagactctgtctaaaaaaaaaaaggagccaaatgtacaataactgaaatgagcatttcaccagaggggcttaatagtagatttgaacagccaaaagaaagaatctatgaacttgaagttaatctcaactgagattacccagtctgaggaagagaaataacaaagaaacaatgaagatcagaaaaaataaacagagccacagaggcctgtggaacatcttcaagcataccaacatgtacataatgggagtccaagaatgagaggagagacagaaaggaataaa

SEQ ID NO: 10751 - DNA, 99514 bp, Homo sapiens
  misc_feature (1)...(99514): n = A,T,C or G, or insertion/deletion polymorphism (see Tables 1-2)
acacctgtaatcccagcactttgggaggccgaggcaggtggatcacaaggtcagaagatcgagaccaacctggctaacatggtgaaaccccgtctctactaaaatacaaaaattagtcaggcttggtggtgtgcgcctgtagtcccagctgctggggaggctgaggcaggagaatgacgtgaacccaggaagcggagcttgcagtgagccaagatcgtgccactgcactttcagcctgggtgacagagtgagactctgtctcaaaaaaaaaaaaaaagaaagaaagaaatttttatcaagaggctagtaacttgatctgtttgatacaagccacatcggacccacacaaatatagtgctaattgtttggatatgctttgtccctgccaaaactcatgataaaatttgatccccaatgtgattgtgttggaaggtggggcctagtgggaggtgtttgggtcgtgagggaggatccctcttgaatagatcaatgtcctcccacgggggtgagtgagttcctgctctcacaggaatgtattagttcccccagagactgggttgttaaaaagagtctggcttccttggctttgctctctcgtctcctctcttaccatatgacctctttgcaatgcccactctccttccactttatgccatgaattgaagcagcatgaggtcctcaccagaggcagctgcccaagcttggacttttcatccaccagaattgtgggccaaataagccacttttctctataaattacccagcctcagatattctgttacagcaacacaaaatggactaaaacatgtgggtacttgatttataacaaagatagtacacagagcagaaatgggaaatagtctttctttcaataaatggtgctgtatcaatagggtaatgatatgggttacaaaaatcataaccaatactttataccatatactaaaataaattcaatgtggactacaaatataaatataaaaagtaaaacaataaagattctataagataacaaagagaatattttcataatctgggataggcaaaaattaaacagaaaacaaaaagtgctttaaaatagataaattaaactttaataaattagcgacttttggttatcaaaagacaccaccaacagagggaaagtagcaaaccacctgatgggagaagatatttacaatacatataatctcaaagtatccctacccagaatagatataaaagtcctactaatcaagaaaaaatatatatatcacaatagaaaagttgacaaaagtcattaacaggtactttacaaaagaaggttttcaaataatcattaaatacgtgaaaaattacttcattagtcattaggtaaattaaaattagaaccgctaaatatcatagaatggctaaaattaaaaacagactgacaataccaagtgttggtgaggcaatggagcaactagaactctcaggcacagcatacaggattaaaactggtatcccttggctgggtgtggtggctcacacctgtaatcctagcactttgggaggccaagacagccagattgcctgagctcaggagttcgagaccagcctgggcaacatggtgaaaccccatctctactaaaaatacaaaaaattagccaggtgtcgtggcgggtgcctgtagtcccagctactcaggaggctgaggcacaagaatcacttgaacctgggaggcggaggttgcagtgagctgagatcatgccactgcactccagcctaggcaacagggcgagactctatctcaaaaaagaaaaaaataaataaacaacagcaactggtatccccactttggggaactatttgggagtatggactaaagctaagtatatgcataccttacccagaaattccacttctgggaaaataactgaccaaaatgcttgcatatatgtaccaaaagatttacacaaaacttggaaacaatgaaaaactccatcaacaaactgaggtgtattcatatagtgaaatactacacagcatgaaaagtaacattgctgacccaggcaacaacatggatgaatctcaaaaacataatattgagcaaaagaaaaaagccaaattcaaaagcgtatatactgtctagtttttttgtttgttttttatttgcttgtttgtttgtttgtttgagacagagtctcactctgtcatgcaggctagaatatagtggcacaatctcggctcactgcaacctccacctcctagtagctgggactaacacaggcgtgcaccatcacatctggctaatttttgtatttttagtagagatggggtttcaccatcttagccaggctggtcttgaactcctgacctcaggcagtccacttgccttggcctcccaaagtgctgggattacaggtgtgagccatggtgcctagccttgacttctttcttactcatctgtgaagtgaggatgagagtcaaacctacctcactgggttaatatgtttcaagggcttcaaaagtccctgatacaattcagccctctgtaagttagccattttcagggtctgtgtggacttccccgagggatgaagagacagaaggtagattttagttcttgtgccaagactgtttaattagcatggtgattgccctttaaatcaaggaaacaaatgatggcatataatgttattgccacataataaagtccatcaggaccaaaatccaggagccaaaagacatcaagtgcatatatacaacagaggaaatcctggcttagctgggcattggctgtctaggtgctaatatgcttttctgtatatgggagaggaaaatcgttacgattattcagcaaccattttggagagctaaattccagcctccccaaagtgcttggagataaggggcaatacacttcaactttccagagtacatagtccagagttgtgcactcctagattaagtgatactgctcatccctttgaattattgcagcagcctttaagctagactcccatctgtgtccaattttttcctcttcaaccaatactgatcacctacactgtctcaggttctctactgggtgctaggggacaatgagaacaagctcacagggatggcgcactattaaagcactttgcaaattgtaaagtattgattcaatgctgttgctgtggggatgatcaggggtagtggcagttgttaaagcagttgttgaacagttctctgctgcctatggaatagaggcatggcagccaagtccaaaccaattcctgcctaatttcccatcccctattccctacatcagctttacagtcatccacaccgaacctatagcagtcccttcattttcacaccccaaggctcttaaatattccatttcctctatctgacatattttcttccttttgtctgcctgtaaaacccccacttaatcctttaggttccaatttcaccctcctgtaactcctcctaacaggcagtgttcatcccttccatgagcatttctcagtaaaggccaagatatatcagaatgacctaaaatcatcttcaaatcccaggcccatactgctcaccagaagttcagattcaataggtctggggtgcataatgattaagagctcaggctttgagtcaaaaaaactcaggttaagccccagctcagttgtttaccagctccatgagcttggccatgttacttaacttccctaagacagtttcctctgtgaaaagggaataggaaaaagaaagaatgactcgttgagacaaagtacataaaatagtacagtacctgacatctgggaagcactcaacaaattatcatcattgttattgaaaagagttccattttattctgattttgacagcctatccacttcttccccaccctaccccatgcctctccaggttgagaatcactgttgagcaattatcaaattgtattataatccaatgtgtatgtgcttgggtctcctactaccaggaaattcagaaactatgtcatagttgtagatccccaacatgtagcactgtatcaagaacagcgtcagtatttacaagctgtgtgaccttgttcaagtctgtctgcctcttttggcctcagttgatttggcataaaatggggagaataatgcttaccagataaggttgtcagaaatatcaagtgagatagtgaatttgaaattactttaaatgatgtgtaggagtgaattgctatgcttctgccatctggggtgaaaaggggctatggtccaggtttgtcactttatctatgccacatatctaggtaaaggggctctctcctttctctccttccctatctcatggagtatcagtttgatcctctttccttaaacattcgtagatgatttgtgcctaatagaagactttaaaatgacctgcaaagtggctcaagcctttccaaggagaaagggactattggtgcattggtgtaagttcagtttctctcagaatgctaaccactgagaacactgcagtaagcttgacagacaggatccttgctctggttgcgtttgaattctagttgagggaaagtgaatgatacacaggtaaacatataaataaaataatttcagagagtaataagtactacaaaaaaaagaagaaaagaaaaaatgcaacaggtaatgttatagagtgattgggggaggaagcattaggtaggtggccagagaaggcctctttgacaaggtgacatttgggctgaaattcaaatgacaagtattcagccatataaagatcaagatgatgagggtcccaagcaaataaaacagcaaataaaattaaaaaaaaaaactttaaaaataccttggtacaaaatggaggccattgtaggaggaattactgagacggggagagtgggtcatgaggaggcaggagggttgggcacggatgttgtacgcggagcttcgcagtctgtgattcaaaaaatagaaatcaggctgggtgcggtggctcatgcctgtaatcccagcactttgggaggctgaggcgggcggatcacgaggtcaggagattgagacaatcctggctaacatggtgaaacctcatctctactaaaaatacaaaatattagccgggtgtgatggcacgcgcctgtagtccccgctactctggaggctgaggcaggagaatcactcgaacccgggaggcagaggttgcagtgagctgagatcacgccttgcactccagcctgggcgacagagcaagactccgtttcaaaaaaaaaaaaaaaaagaaagaaaagaaatcaaatgagcaattacatgaagaaaaggaagttattttgccctctgcttctcatgtgtacattcattcagcagatataactcaacctctattgtgtgccagtcaccatgctaggagatgaagatacagagaaacataaaatatggaactagtttttattagcctggcaactgaggatagaggtgcatgagtaacacaatatgatgagaagtgtagtggagggttgtaaaggctgagggatcctagaggaggcggtgactgactgtgccttaggggccaggaaaatttgcatggaaaatgaggatgctttcacttgcagataaagcataagtagtaaggaagggagaaagtctcagccaaagggaagggcaggtgctaaggccctggggtgagcctgttcagagtaagtggtcctctgtcatgatgggcacatagcttgtcttgctagtgaaggatctcgtcaaaaagttagtttagagagctttctctgggacatggtaaaagacaacctggaatgaagtactagcggcagtcaggccagtgagtggggttggcaacagagcaggtaggtagacctgcatttggttgctggtcacagaaatggagagtgagagatatttctaagtcaggatgccctagtggcagacccccaagtcctcgaacttcagggcagaactgcctgggtgggaactctcccatgtctccttgatttcactgccacctctgctggcgtcctctctcatctccgccgccagcccccgcctcctttctcgggaagcttgggtctccctgggagcgggtctgcccttagggggaggcctctgggctctgtgccctgcagctcggcagycattcgaggcggacagaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacaggttcgtagaacgcgcgctcgctccctgtggctgagccgccctcctccgcgggagcggttggcggagagaccccggccacaggccccgcgctcgagagcttcctagaggcggcttcctccggcctctccccctccctggagctctcagccgccggcggctcttccggggcgaggcagagggcgcctcgggcttctcgctccagcaccatctcggggacagctcccgcgccgcaccgggtccctatcgggtcagcactgcagcggcggacagcggcggccgggcgggctcctccgcaccctccgccctggttccgcgcggctgctaaggaccgtccctcgcccccgcgggccgctcccaacgctagcaccgcggcggcggacagctctctccggcggcaccgcgaaccgcgaacaaagccgcgggtctggggcccccagcgcgcctaggggtggcgtgaggccgcatcgatcgggggatttcagcttctcccagagaggtgtcaccggcgagctaggcgggggcctagcacagccgcgcgtctccggcttgggtccgccgcccgccgaggcctggccgtgcaatggcggggcccagctaagagtgggcaagagggtagaggggaaacaggcacagaacggtcccggctccgctaggcgggctgggcctaggctgaggtcccggcggggaggaaggagtgcgccrccccgtcttccctccagacccccaccccatcccagctcagaatcgcggacttccaagagccctgcacagaagcccgcggctggcagctgcaatcactgactccggctgtccccggaacatccctagaaagtgtgaggctgagtttccgtagggggagggggctgagaagccgcggggaagcctcacgaacgggacagctccaggctccctctctccctcactccccgggttccgcccccacctccagagaaatcccagacggcagagaaggcagsggggagggggcgacccagacagcaggttgcgaactcggcttagacctgggaggttgcaattagcaagaaaaaaggttgagggcgtctgtgaagccgggaggttcccaaacagggaagccagttccgcggcaggaaagcatakgtggaagagaaaccttttctctgagagctgaggctgggagggccctcggatcacgtgacactctagatcactgattgtctccgcggaagacaaggcctagggggcaggggtgattcgcccaaggtcactcagcaatttagtagcaaagctgggcctaaaacccgggctctctaactcctgggcctgttgcataacattcatagagaagtcttttaaaatcccasatgcaaggagaatagcagagtggtttacttactagcatatgaccttgggcaagtgactmtctgagactatcttcagctattaaagaggaatgagaagatnaataatacccacttcgatgagaatttaatgagagagccatgtaatgagcttagtggcacatagtaaatgctcaaaaaatggtagatcccatgactgctatcatactttctgtaaacttgtactggggacctnttatataccaggcactggctgtgcactggggaggcagagaagtagcttgaggaggtcacaggccagaaaaggaaacaaacagttgcaatatgttatgataagtatcaaggcaactgggctgtgggatctcagaagcaggagtcacgaactgtaaggaaagacsaggaaaatgaccccaggcagacagagctgtgtgtcaaggccaagagatgtgaagtcccagccaccaaggcaatgtcactgtgccagagggtcctcaggatgtggactgaaagatgagagtggagagaaaggctggagccggtctccaaagagccttttatggatggaatccttcaaacatatttagaaaaatagaaagaatagtataataaccccccacatacccatcattcagcttcaacagttggccaattttgtttcatttatacccacacccactctcatcacacacacccacatccactctcatcacatgcgcacacactcacactgacttatttggaagcaaacccaagacatcacatcatttcatacagagggattttaacatcagtacaacttctgccatgcagatactggacagccttggaagtcactaactcaaatcatgacctttctacctcaattcattctgaacatttctgtcctttgcagaatgttttgagaagccacactatagtgatgagccacatgcattaaaagaaactgtttcagaaataaacaagggatgcatcaacactcaacaggttttaccatgccagaattgttcatgtccactacctacastgggctttagaccaattactaaagacaaatcaaactctacagagaaaaagcaagagcttctctttcaaagtaatctgaatcgtgagttcctaaggctagaaagcttagcattatggaaatcattgatttggaaatcatcaagcccaatagccacattttacaaatgaggaagagggggtaaaaaatggggagaaawtggcccaaagttccatggtgcagagaccagaaccgagatctttgaactcataaacttaagatcccattttcttctctagctcaaagaggctggaaggtggaaaaggaaggggggcaagaaatacccttctttgttctcaagaagatggcaatgtatgacagttggtcttgatctttgagatccctttgcaaatttcatatatatatatatatatatatatatatatatatatatatatagtaatcacagcttactgtatcctcaaactcctgggcttaaggggtcctccctcctcagcctcccaagtggttaggactacaggcatgcaccaccatgcccagctattttttttattttttttatttttattttttttgtagaaatggagtctcactatgttgcccaggctggtctcaaactcctgggctcaagtgatcctcttgtctcacctccctaaatgctgctgggattaaaggcatgaaccatcccacccagccccttccatatactttctaagtaacttgatcttggtggcaccttctttctggctgctgtgttaacctcccagctggccccttagttctcatgagcaaaaggctgcacagtcagaagcccagatctcatttttgtggatttttgccagccctgcttttcttaaccagatgcatatgaggccttccttttccgatttgccctgaatttggctgcacacctagctcacagacctcagctccttggaggtgctaaatgagtagtatttggctcaggctctggaaggactcagagctcttgtgccttttgagaacataaattctccccattactgatgaaatgtgatggccatgatgggtatgtgtgtcctgactgggctctggggctctgattctgccagtcaggctttccacttttcagggaagcccctgcctatcaaatggggagggcagtgtctcacaagtttccccaagtcntaggtagaaaattcagagcacacgcaaagagctcttagcatccttggtgaagggaagtcagccattaaaagccaataagagccaataaaagtccccttgaacccaggaggcgaagggtgcagtgagctgagatcatgccactgcactccagcctgggcaacaaggcaagactctgtctccagaaaaaaaaaaaaacaagtgccttgttctgggagtgtgattgcagtccagacatagacaagtgatcaagatagggcatcccagcttgtgaaattatcccagctatcagcttgggatgagactgacttagatgcagtatattacctgggcctagctgaactgcaatatgtaagatcccaaagggacttggtgagcatctcctcttccttcaagacgcttactcattgaatggctattctgtgtcgggcaccattccaagtgatggtgatacagcagaacaaggcatgctaatctctgttctcatggggcttacagacccacagtaggcacagtcattgataacaattgaaaagcaaatgtgaaaatagacagacagagaaggcctgtgtgaactagtgacatggaattgaggcctgaatgacaanagtcagtcatgtgacaacgtggggcagcacactccaggcagaggaaatygctctggcagaggccctaatgtgagcctggactgcatggggacagatgggaggtggagtgagtgaggggagagcagcagccgccaggggcagggagggggcagagaggagatcatgcaggcccttctaggccatggtcaggattgaggcttttattctaaatgtaatagatagtagccagatggctttaagcagaggagtgttaaaaaaaaaaaaaaaaaaaaactgggttttaaaaaaatgcctctgttgctgtgtggagagtggatgatatgggggtgctgggctgagcactgaggcaggaagggtgagacacagcctctcccacctggaggaggtcagcattcagctgaggagaccataggcaagcaagaacaacagtagcccacgctaagggctgccattgtgggaacagagacaagaagatttaagtcagcctgggaagcatctgggaaggcttcatggaggtgggcaatggatgtgggattgtatctgggaaaggagagtggtaaggctgctgcacaggtggaccaaggggcagcgtgtggtagctgtggagggcatggcccaggagctaggctgcctgggttcaaatcccagccctgccattgagaagctgtgtgggtttaggcaagttgtttacccttgtgtgactcgatgtcctcattcttaaagtggagacgatgagagtccaaagacttatttcaagggatttctgtgagagttaaacaagttaaaatatgtgcagcactcagacattcctggcactcagaaagtgccgtatgagtacgagtattctaaataaaaacggagcaaaatggagatgggcgagccgggagcacatgccaagaagtgtccactagagcccggctcggggcctcgaatcccagaccagagatgcccaccttgctctgtaagcaatgggagccattgaagacttttaagcaggggggttcagagtagagaggaagataaaatccaaaggcccagagagggaagggaactaacccacagtcacacagccagttactggcaggagtctctgtcctccagctcctccactgagttaacatctgtaggagaacaaaggcagtatatattttgtcccatcantgcatcctcagagtctagaataatgcctagggtattctcagaaaatatttgtggggtacattgctgaattggtagccagttgggccaggaaacatcagaaaccttgaatcctctagaagctcagtgctttcaggacaatggtgaaaccagtctcaggaaaataaaccaaacttccagaggtgttgacgtggggtctcaagcccttccaaatcctaggtcctcctgtgatcaaagacaccactgcccacactttccctgccgccccctcaatctgcaacaagcattgctgcatagggttcagaagttaatcttggtaaagtgcctggcagatgaaaactgttcctcagacattcagtgtggtaattgccaatgcggagaaaatgtatctccacgtttgcaagaggcaggcctttttgttccacaaaaaccagccattagaattcctgtctctgactcgtcggaagctgcgacagccaggagggcaagcagggtcttgcagttcaagcagcaaatggcaaaaggctccgaggaactcagccctggctctcacatcaggaacacctctgcagagtagggcatgrggccaggtgcttctccaacaggagagagcctcagccctgacccttcctagctggacgatcttgagcaagtcccaccatctataaaatgggggtaataccgccagggcccactgggtcattttgcacaatgacaggcacataccagatgctcaacaaatgtgcttccttccttcctttctttttttttattttccttttttttttgagacagagtctcgctctgtcacccagactggagtgcagtgtcatgatcttggttcactgcaacatccacctcccaggttcaagcaattctcctgcctcagcctccagagtagctgggattacaggcacccgccatcacaccagactaatttttgtatttttagtagagacagggtttcaccgtgttggccaggttggtctcgaactcctgacctcaggtgatccgtttgctgggatccgaagtgctgggattacaggcatgagccacccagagtgctcggcccaaatgtgctttcaattgtgacaataacactgtgggttagggttatcatcccatttcccaaatgtgaaaactgaagcccaaggaatggctcattgattcgtcaatacccactgggcagctgtatgagccaataactgttttagaagctggagagacagggaagacgaagacaaggaccatgcctctatggagctcactttctactgggagacagaagccaggcaagtaaacaaaatcatttcaccaagtcatataaatactaggaagaaagtaaaagagaggagtgtgccgaggaggatgaggctgtttaaatcagggaaggcttcaaggaagaggcattgggactggcatctgaatgagaagctgcctatgggacaagcgtggaggcagaagaaacagaacatgcagaggtcctagggcaaaaacaaacctgacaagattgcaggatagaaaccaagtgagcaaggaggagagtcacagacggtgacagcggaaaggctgtaaggcttgggttaggcaggaccttgaaggctgygggagtctctttgggagacagaggggtggcgtgatctaaattgtgatgaagtcacttccctcagtcactcagccagtaaggggtggatggggtgaagcccatgtcagagtgatcccctgggccctccttcaggccacagtccctgctgccatctctagagcaggtcagccaaggggcaggccaagtgatgcatctgcaggactcacctgctgggaaataaatccattggcgctggcrgccgtgtgggcgctgcagtgccttgcgggcagcatcctaatgccgggaggatgcagggggagggagacgacataaggccaccaggactggggtgaggccagtaagacacctgcctctggtgcacaatttaaggggatgctgaaaacttgattaagataaataactttttatgcaatttttttttaaattaatgcaaaaaaaccgtgatgaataaaatatcaaaattttaaatcaagacaggatacaaaagagcagggattagggtgaggaaggtgaaatgaattgtgcataagcagganctaatcttggcccgaagacatttgcttaactgcagggacactgcctgggccaagcactgttcccactaggagccagtatcaagagccagtctgctcatggtgaaccaaaaataagaaactgttcctggtgggggccccagagaacactgcctgccttggctgtggagacagaagcccagagaaaggatcacacatcaaggaggtgatactgggcctgtaccctaaggtgctgtgtaggatcagacccaccccttgtatgctttgggagcctagtaaggtgcattgcctctccagcctcaatttccccatctgtgaatccagaactaataaaacttagtcaccaggattcagtagggtactggttaaagtcctctagcgcctggctactcaatgtgtggtccacggaccggcaacatcaacatcagctgggagtttattagaaatgcacgatctcagctgcatctcagaggcattgaatcagaacctgtgttttaacaagaccccccggtgattgacncacccnggtgattgacacacacgtttaagtctgaaagcctggtcaactcttggcacataaaagatgctcattaaatgttagtgctactcccctgactacccaaccctgttagattctgacttcagacaagaggaaaaacccaagacgtaagaagagatcctgaggtggacacctcatgcattttaaaccagcaagttttgaagcgagggaccctggccaagctstttctatacttaactgtatgagccctccattttgttcacatgtaaaatggggataataattataggtagcttctatggttgttgtaatattaggaaaacactcagcacaatgcttggcacatagtaagcattcggtaaactcttgctgctgtggccgctgctggtggtgggtcaatgaatttcaatagagcatagaccatgtgatgaaatgaaatcaataacattcatattaattattctttgccatttgtaaagcatttcagttgacgccatttcagccaaccctaataacccttttgagtaagcataagatatatccatttttcagagaaaaaaatctagactcagggatgaggtgacttgtccactaggatttaaatccctggagtctgacactaaaatctgtgtcagcaacagagaatccgagcaataagcatggaaaatataaaaaatgggatgagacagcattagactgcagagatccctttttgttttgcagaagggaaaacggacacctgtggaggggaagaaacgtgtccaagatcattcacacagagcgtcagctctggggtcagaacccagctcccaaggctttccgtgtccagaccacctccctcacctggttggccagcctccacctgatgagccgggcaggctgcaagtggcaagttccctgggtgggtctagtggtcagggggcatcccagccccacctttccttccagcacagtcagaggagctcacgttgccaaggggagggctgcgaggttgccaggacatggtctgcaagcagtcaggtggtaggggaagcctttgctggaactggcactaggagctgccacagcgattttctcgtggctgggagaggacctccaactccacagcatgggtcagctgatgagagggttgactgccacagacgcccatgtcaccgctacacacacacccaagccagcaggctgagtcccattctccctcagctccacacctcatcaagccctgagtcctgatagctactcctcctatctttgccaccccaagccactgccttagcacagttccctgtccacagcctgttaagagcaccccagattccccaccttcatgctccctttctcatccttgagcccctgaggtgcctggaaggatctagagcgcagagctgagccctgcaatggctccccatcaccctcaaggtgaagcccaagctcctctaaggccccttctaaactggctctgacaacccgccagtcttttttttttttggccctgaggctccagccaagccaccttcctcccagttccctcagtaaaccatgcatcccccgtgtctttgcagatgctgttccttctgcctggaaagcccttcctgcctcactatccacttggcctctgcaaatccttagctccagactcaccttttcagagaagccctccagcttctctaaggtgatgaagagagaggcaccttagagaaacctgtgttagagggggtgacacactgtagcttaaggatctgctttcctgctcgtgtccccattcggctgtgaactttttttgtttttgagacagagtttcactcttgttgcccaggctggagtgcaatggtgccatcttggctcaccgcaacctctgcctcctgggttcaagtgattctcctgtctcagcctcccgagtagctgggattacaggcatgcgtcaccacgcccggttaattttgtatttttttttttttttagtagagatggggtttctccatgttggtcaggttggtctcaaactccccacctcaggcgatccatcacctcagcctcccaaagtgctgggattacaggtgtgagccactgcgaccagcctcagctatgaagtttttatgtctcactcttagagtaagacaagagaccttggcagagtcattctcctacttagttactcacgggtttccactgtgcgagatcaaggcctctctgggcctccgtgccatcctctgtgtggtaggggttatgacattggccttgccaggctagcgggagtgttaaggattgtgactgtgggggtttggcacacagtaaatacactgaaggtggtggcattgctgttttgtttacaccaacaccaccagtgcccagcacagaggcacagaaaactcaccagcaagtgcgtgctcaacgggcccctcgcctgcacaggagaatgactagtgtgtgaaaaagctctgtaaggaatgacgctccattctaagtcataataattctagtagttcacgcttttgattctccctgcctcctagacccaagtcatcccaacatgtgttctgcccactcttcattcatggaacaaaagtttactaagcacatactatgtgccagatgacgcgctagctgtttgggactgagcagtaggtagacattaaacacagaattgtaccacctctccttctttccttcccttcttaaaggccagcctcctgtccctgcacacaggtggccccacctaaggacagggaagatgccatttgctcccaggtgctcattccctgggcagacagcaggctgcagcccacaggcgcctaccctttctccctccccagcaagctggaaacaggaacatctgccctgtttttaatccagttgctagttttaaattcaaatattgtcagctccctgagagcagggatcatgcctgcccttttcactgcagttgtcaccagcatttagaacacagcctggcagagtcattcacccacttactcattcattcattcattcattchctcaacatatacttatcaagtcctgctaaatgccaggctctggggaaaccactgggctcrgccccaagaagctcctattccagcaaaggaagaggggagggaagtgggggtctgaggattgtgttaggaggtaaccrtgcctggagtgggctgatccctgtgggaatccctgattcactctatactgtctccctgatctgggccaaccgttcatgcctctcatccttagtcctcacctctgcaagtgagacaatagtatctgcttcctggagccactgagagcagggctatggttactaaaagaagaggaaatagagagctgggggaggaggcgacaggttgtcctgggaggacattgcagccccttcagttgctggggccttggtgccccgcccagtgggggcctggctgcagcagagagcaagagctggagagagaagagttccagctccacacctacccctgtgtgatcttaagcagaccatctccccctctccgcatcagtattttcatctatcaaatgaggatggaacatcgacctcactcatcctaaatatgtgataccaaatctagcaaacttgtcacgatgctcagtcaacaattatttactggcacctacaatctgcccggccccgtgcagagctctggaaacaaagtcatgtaacggccaacctttgccttttacggaatgcatggtgccccctagaatcaagcagaggaaggtaattaaaatttaaggagctatagtgtaaaaaaaaaatcttcacagacgtggtcttatttaacaacagcaatcataacaagcacttatatagcactgagtatatgaggccagtagtattaggcatcccattttacagatgaggacactgaggctcagagaggacatccccaaagctggaattcaaaaccagatatgattgatgataaatcctgtccctttacaccaatcagaaatcacatttaagtaagaaaagtatggtcaattgtactaccaccaaagtacggtcaatggtacagtgctacccgcaccagtgaacaagatgagtaactactatcagattgggtgaggtgggccaggagttgggtctgatgccaggcagggtcccatcccgcccagccctttgctggaatcaagagcagcagtggtggcctccggagaagtgagggcatgccttcactggggtctggggctccatgcccattcagcaagccaattccccaagaagctctctccttagccctcaacctcctctctcctcctccaggaaggtgtggtccctgccatgctatctgctctgctcagcgactgaaggtgcccgcatcccagctctgccaggaagcaaaggtaagggcactgctcagcactaaagccctggatagtgttcagggcatcccctcatccctggagccctgatgaagggggcacgtcttcccctctgtgattgccaagaacagtcctaagatggagtgagatggatcagttgggcagtgtgatggaatggtgtttaccttgcatgttcagagccgtttacaacagagaagcactttcttgtgcaatgccttattcagtgctccccaaaaaacctgaggtggatattattatccccagttacagatgagaaaactgaagctcagagagtgaaaggacttgcctaaagacacacagctggtaggtagctaaggctgaattccaagctttttcatgtccgtatcccaatggcctgtgcacattgtaggtgcttggtacatgtttgatgaatgaatgaatgaactgatgaactgcccaagatgaatggaaaggcagggctgggctggcacttggctctcttgtcactgtcagatcctgtgctttttctgctgagccacggcttcctgcactgatgagctcaacatcccccatgccaccccctccccagcccaggatcccaaccatcttatgggtggaggagtcaacctcagctcctcttccaggtggccggccaagctcggatcacacccggcatccctcatccacatcgcctcttccccaccacccacgaccagtaatccagtgtgcatagttgtaaacttgtttctttaaataaacagtcttgagtttcataccaaatagtctcttaagagaaggaacgtctccaggccacctcgtatttagcatacagtgagccacatatttgcacagagagagtgtatgtggatatagagatcgctcgatcgctatagatatcgttgctcatccagatgggagctatttatgatgctgagtcattcgcagagaatgccactgaggaattccaggctgggctccgagccccagcatcacagacctcatggctctctgccttgtcttcactgttcacaaatgagaggtgggaggggggcctcccatcacagggcagggacagaagggaacattttggccacaggaaatgaagatttcctcataactagttcctactgtaagtcattctcctccatccagagccttgcacccttagggatcatcttgtccaattccttcattgtgtaggagagaaaactgagacccagagtggggagggactggcccagtgtcacacagagagtcggggacagagctggtgctaaagcccagaccttctggctgctgtctggggtttccacattcccagcaaccttcttcaggttttgtctccaatgtcttggcatttcctctcactgaggagcttctcatcttccaaaatttggagatgtcactgagcacttgcacctttgggctcttgcaggacaagagctgactccagcttgtttgggtactccagccccatgcttagtgcaagacctgcacacactggctgctcaatacgtgtgtactgagtgttatataagaccaaactcagtaccaattcctggggaacccatttggaaaagcacccatctatctccaccctctctttcttgtctctaagccagttccctatccatgcaaaaatagactccctcccactcaccacccacctctgcccaattctataatgaatcaattttattaataggctttgggatggaaacttgacaaaggctttttgtgaaagtctcgctttatctccctacatagttcacttctcaaagaattctaataaactggtcaggtggaatttggtcttacataaaatattcattaatccactctttccctccatatagaatgtattggtttaagcattcagtgatctctagcctgtgttatagattctattcaattgttctaagaggcagtgggatgagatggaaagagcacgggctttggaatgagggccaagttgaagtctagctggccccttactggtttttctttcacattgattactctgaggattaaatgagataatatatgtaaggtggatggcacatagtaagtgctcgatgcaggtttgtgaataaatgaatgaatgattatgaatgattggttcaggacccatataaaccagatcttaaagctggaggagccagctgactctgcattctgagttaacaaagtcatactacccaggaagggtggtttgaaaagtcttgagaagcaaacttcaggattaggctgttggttggcctgtctccaggccagaaaggaggatctttctccagcccctggtgcaaggggttccctcagctcaagaaaaaatttgagtctggaatctgggttcaaaacagaaaactccttgaaaatcaagactgtgtcattttattggtggattctgcctttctctcaactagagcctggctcagagtgatgtcgaataggcagagaggtccacagcacatattcatgttgtgaagatgaggtgcattgacttgagttgatctgagttgacttggcttgaattgacttgagttgttctgagtttactggtggactcaactcttgggcccaccgagagagaagcttcctgaaacttggacttagctaagacctggctggtctcatagcacaggggagacttcacaggtgatgttctggggacattacagagtgtcccgaagatagaggcctttcagagaggaccagggccatagtcagcactgaagagctggatagcagtcttggctcagtcagggggcaccacatggctaaatgtcccttaggaatctttaaaatctattggaactctgccaggaccttttcatatttttaaggcaatagaagcctttcttactggcatagagggatctttttggggtacccacttcagtgggaggatggcctccaggttggaaggtcaactagactcagcaatggggagagaagacagggtgaggctgggaaccaggcagagtttcatactacagatgctgggaccattgtaggtgggtcctcccatggaagcgagggtttggggatctgagtgagatgtgattctaactctagacttatgtcaggcagtgtttgctgaagggaaaatgacccagaaagtacactgggaaatcaggcaagacctatagcctcaccatgcggagggcagccagcacagctcaggccccttggccagccccatcccaggccctgcccaccacagaatgcagccagcacctgagggagacaggaatgagaacaccagtgagcttcaggtgagcaggggctgctcacacgcttactgcacttgaccagtgtctgtctctcacacgggtctgggaacccaccaaaggaaatatgttgcgttcctatcatcccctttgtacyccctaaaaatctgggtacagattttagacatcagtgtttgatgagtgaataatcaggtcagagtaagatttagaaagccagtggaagatttcaagatggcaaaatggaaaatttcaagatttcaaggtggccaaggtccaaggtagagacgcctagccagaaaaaataacatagacccagaagctgcccctcaggaatttggctcatggaaaaataatgcactaaatggagccaagggacagggtggtgcaatgtgagctngaaataatgttcctcagcatcctgggcttctaagaaggttctcagggcccattatgggatgggtttggggaagagaaggcctcaaagaagaagccctagatcctccaaatccatttcaaccacaaaagcttcgcttttatctgttgtatatgttggatttcctcctaaatttttacttttaaagggttcttttgattttaaaaagtgcatttgggaaagtactggcattgaaagagcctatgcctttggaggtagactgggtccagatctcagctccatccctttccaccagtgggacttggggcaagtgtccctttgagcctccacattctcagccacgagccaccctcccagggctgtatgagcacagctaagcggctctggtacctcccagaggctggcacacgtgtgattgattgatgctgtacaagatgactttagctggtatacagatgaacatttattattttaatagctcgcaagtgatgcgtgttagaaatatatarccagcacactaaactgtgatttatgaaaataatatggcatttcctctgaaaataaaattgtgatctttttaaaaaggcaaatcaatttaaagagaaatactaagtaagtgatagggcagaaatcatgaakgtggcacaggaatgactgaaatttgggggaaattgagagaatctatgtaaacaccaatcacagtgtctgtcacttaagaagggctcaaaaagttagttcttatatccttctattttagctccctggggtggttgaacctagaaccatgctcaaaaaacaaaacaaaacaaaaacaaagcttcctgggacaaagtaggggcccaggcccagtcggtctggaacagtgtggggtgggcatgagacaggcagccatggatccagctctgatgggcagaagtggtcaagtgtggccagggagctggccacaggcacacagagcagtccgaggctgctgaggtagcatctcccacaaagtgggcacagaccatcggggatccatgagacaatttgaagagttattcaggcacaaattaaatagcactgggagagaatgactgcctttttggttgattacatcaaggagagagtctcaattgaaggttagcctctccttaaccagcttgatttcctttccaaggaagaggctcagacttcagccggcaacagtaactagctggaagtggataaacgatgttttattttccatttatttgtttttaaccatggccttctatttacagaacaggatactgcactcctgttcatgagaaggatcttatgttctctttccaaatatatgtattaaaggtcaaaaaatgaacctgttactcttgctaagtataaagtgagtaatagtaaatgcaagatgtacatgaggaaaacagagagaagtggtgtatgactgaggcaagagtcacctggcaaaggtgttgcaasggcttccatggctccagagcccatgctgggcccagaggcaggaatgtctccaggccccaccacagcctccggggcagtcctcaccctggggagggcaaaggaggccccatcctaagaaggagggagattgctgggcaggtgacccagagcctcctgcctgagccgggagtgcagagaccaggacagcagcctggccagcagtcagtgaggtcagggctaccaccagagggtggatctgaaacagaccctaggcctctggtttctggcaaggttgattacatccagaagggggtcttaattagaggctgtggtccagtggttgatcataacttggattatccagcgggggcaggaaggagctgagggacaggaagaggcagcccgtgtcagcctggtgttcaaggaatcaggtgtgaacctcaacagttcacagcagccttagagaggggctgggtgtgaattagggtacactgatagcaagcaacagagactaactctgtcagactcagacagaaaagggggttatcgaggttatcagatgggacccagaaccaaagggaaagctggacacagggctcaggaaaggaccagagccaaagctgcacaaggggtctggaagcaggacctgaggccggttttgtccaggtcccctctgggatgcatctcagccacagccgcttttttcctccttgcatcactcggctcatgagtcacagccccaggagggagacagctggcttggcgtgggtcccgtgtcctcctctcggccagcccaaagcatggcggcttgacaggactgcttccgagattgaacgtgagggaggggtggttcccacaaggaaaatcaaagggctgtcaccagaaggaggaggagtggattctgggcagctcaaaccagcaaatgtctaccagaaggatcccagggagtacgaggcactgtggtctcctaggtttcactctctgggaccatccctgaggcctcctttctcctaccctgaatggacaaacgtcaccatcccagtctgggagcagtggtctgctgtacctgagtaaggtggtgagctgctgcagtgagggtcctccgatgggctgggggccctaggggaagggtactgggcaagtctgatccttggccccagggctgaaaaggatctgctgggctgaggaagtctaatgagaaccgactcactcaggggctgcaaacccgctcgtcagcaggcttggcggagagcacatgcatggaggaactgtgacaggggacagacatgcttagctagcaggacagccgctgcccactccagggagtggagttaccactccaacagttaccacacaggcacggggccccagggttgatggttacacctgggctggtttgtttaaatgaaggcccaaatcaggagttctatgtgaaactcctccttttttagtattatcaattcacaggaaaacaattaaatgttgtgttgaccaaacaatatgtaccaccagtttgtgaccatgggaactaacttctactcatccactacaactaagatgagacatcacttcctccaggaagccttccatgacttgcccctccctctgccttgccaccaattctttggactcccacagaccctgtatttccttttgtcacagcattgaccctctgtgttacttggaggcacacaagttcgtttgtttttgtctgctgctttttgactgtaagctccttgaggagacccactgtctcttgttacatctatgcccagcatcatgcctgacacacatgaagggctgtggcattgatggaagggggctatagggactgcaggtctcaaggttatactgtggcaaccagttaatcctcaaatcctgttgtgacttaatacaacaaagatttgtttctccttaacatgatgtcttctgtggagccagcagctctccaggcagcatccttccaatcggtgactccgggatctaggccggctccgccactatgcagcagcggaagagagtgagtggagaactcacagtcactcttttttttttttgagacagagtctcactctgtcgccaggctggagtgcagtggtgcaatctcggctcactgcaacctccagcttctgggttcaagcgattctcctgcctcagcctcccaagtagttgggattacaggccygcatcaccatgcccagctaatttttgtatttttagtagaggcggggtttcaccgtgttagccaggatggtcttgatctcctgaccttgtgatctgcccgcctcagcctcccaaagtgctaggattacaggcttgagccaccgcacccagccaacagtcactcttaatacctcagcccagaagtgacactgattgattcttctcacaggccgttggccaaaactagtcacatgacctatctcaccatcaggggcgggaaagaattcactgagttcacgttcttgcagcacaagccctgacctgccgctggcagtgctggggagccaggggtccaaaaggaggacttgggctatgcrtggggcagaggcagccaggaaccagaggtgctcgagacacagaaacttgccagcatcactgagaaccagaggtgcctcatggctggtacatgaaagcacctcttaatttgcatgtttaactcaacacatcctaaaaagtgggaaaagagtggggagagaatttcattaacctgagctttccacctttccttatttttccaatcagtaaacactagcaaatgaaaatcaagttgatggaaaaatagaggtcaaatgccaatgggcaaactgttcagaaagaaattgccacctggtcccttcaacatcttacgtggtgtccatggtgacccaagagcgactgcagctgttggaagggctcagacgccagtgcactcggggataccgaccctcactgctctgacagccttggccagaccatggccganagcaagtcagtgggccccactccagggggctccaagacacttgccatgctttcttcaggctatatcacaacagcagatgtttctttgggatggaatcacaggatcttagatggctctagaaagagcagaagcttaggagccagaaagatctgggttcaaattccagttctttcctagtaagtcaycttcctacctagcaagacccttcaccgctctgagtttcagctttatcgcctgtctaatgggtacaaggataacacctacctccctgaacaactgcgcatagtctctgacatcacgtgtstaatgcntaatgtcctaacgcacagtatgacctcaactgatgtcactgtttttccttttcccccactggggtcagagggactgagtccaacctcccctgactgcagccagccagttcctatttgcacacctctgatgacaagaagctcactactcttcctactgcccccctcgccctacaagccctgagcatcttgctccattttttaattactcccacgatgtttgtgaagagagggtctgatgtccctagggactagggattgaggggaaggtgcctggctcacttccccacctggctgactaatcacagtctttgccctcaggagttgtgcgggggaactgagtatagtgaggatgaaggaggtgaggggatcagggtggaggaatgtgtatccatttctggttcacaaaaggaaacagagaaacccatcacacatgggagacaggatcaggactggggacatgtgtcccatagaaaagaaatctcaggaagactgccacaggacaatgatggaggttcaacctagggttaagtgtggggagccacagaggggaaaacaggagcctcaaataagagcaaactttccttcattcattctgcaagcactccctgtttctccaccctgcctggccccaggctgagcataagcgcaagaaatgaatccgtggccttgaccttgggagagtgggcaggcatgtagatgataacatggaaaccatttgagtattgctgagataaaggaaagttcaatgggggctgtgggagctcagagtgggggtagctggcccactagggaggggaaggatgaggaggcaaacagaaagtcgggagaaaagggataccagctagaggggcaccatgggcaaaggcatagaggtgaaaatcagcctgtgtgtggaaaacccacccctttctctagtgcttgagcagggagtggtgacaggtgggctgatccagcagaaaagggccttgcagacagccacagagcagagaccctgtcccaggctaggaggaagccatggaagggcgagttgtttttcatttttgttttttcaggaaaaaaaaattactgaactataacctatgttcataaagttctcctaagtttacagctcagtgagttttcacaaagtgaacacgcccacgtaaccttccccagctcgagacacagaaacttgccatcacggaagctccctttgctcccctttccagtccccacctccctgcaaaaggagctgctgtcccaaccttttttttttttttttttttttttttttgagacagagtcttgctctgtcacctgggctggagtgtagtgatgcgatctcggttcactgcaacctctgtctcccgggttcaagcgattctcctgcctcagcctcccaagtagctgggactacaggcatgcgccactatgcccagctaattttgtatttttagtagagatggggtttcaccatgttggttggccaggatggtctcaatctcttgatctcatgatcggcccacctcagcctcccaaagtgctgggattacaggcgtgagccaccgcgcccggccccgacttctaatttcatagattcattggctgtttttgaacttcatataaatgaaatcacgccgtgttggacccctgctcagcgacgttggagagtctcttgagttgttgcatgtggttgtcattcattctcattgctggagtaaatctcatcgtgggactagaccaaaatgcagttctagtgttgatagccacttgggttgttttcagctttaractcttgggagaagcgctgccatgaagattcttgcacgtgtctttggaaaaacacatgtacacatttctagggggtttatgccaaggagtggagttgctgcatcacacgagatgcgggttcagctctagcagatactgtcaaatgtttcttccaaaatgatagtagcaatttacattccctactgtagctacttggtggaagtttcaggagctccaaaccctcaccaacatttggtattttccgtcttttccatttcagcgattctggtggatgtggagtggtgccgttggaatttttatttccccaaagacgagtaggttaaacaccttttcatatgcttcctagccatttggacatcctctttcccaaagtgtctattcaaggctctggacagggagggtcaagggccgcctttcattttagaaagttatctctggcagccaagtggagtgtctgggattggaagtgggtgtcctggaacctctggctgataccaggggcatctcttaggtaccaggtttcatcggcttcctctgccttcttcactcctcacagtcaccctttgacctcacaggtcaaaagtgttatcagtatttcacagatgaaatggccaggctcagagaggtgaagggcctgcccaaggtctcacagagggtgcggagaggacagctgggatgttctcagcctgaagcaggtagcccagggaggaatagaacagaagggaacaaaaggaaggtgaagaagcagctacaaggacatctatctcactccttattttgcagaaaaggaaattatccacctgtctccccagttctctccccttccttcccctctctctgcatcacaccaaaagtccctacagaggtcagcagccatctggaggtgagtgtccccagcctgagactgtgttggaggcccagtgatgtgcagggagccaatttggtcagctcctgtctctgccaccacccaccgtgtggccctggactggtcacgtcacctccctgagccttaggctctttacctgtttcaataatcccttcctctgggccttgtggggagaaatcactgagggaaactgatgcagtgcccagcagggcgcctggcgtcatgagcccttagtttacttggcacacactcattccttcccccgacacttctgtgactagcggggctccrtgttctgcccaggccccctctccctgggtagcagggtcagcctcttcacgtctcatgcagccacaacaggccactggtgggttcctcactgcctgaaagcaggtgtggtgggccaggcatggcattccctcccgcatcaccttgtctccctgcagctgcccccactcaggctgacagccacacaatgagtcccagaagggcctttctcgtctcaaggactctcagctcagagcccagacgcctttattttaggagctgtggttagtaaagtgcttcatcaacgccacctccaagcagccccccgccccctaccacacacagcccgtgtgactgtctcacccgccctgtccttccactccttaatccgtgctgcatttcatgagcatctccaggcactgtgctaggcaccaagaggcccaccagctccctcccttcatggagtttcctctgcattgagagaaacagacaataaacaaatatatggacatggtaaacaggatgccttcggatggtgctcagggccgtggagatgatggagaaagctataacagagagggacaggcagtcggccgctcggtcccagagcagagtcaggaactcccaggcctgctgctggggatggtgcgtccttctctggtttgggctcttcctggagggagcagtgacactgcagacctcctgggggttgtcctgggatttggcaaaagatcctggctgctcctgacccctggcacttcctccatccaccagcttctcccctcccgccccataggatttcttcctcccaatcctactggatcctgagcaaactgagtcctttcctgatggtttccccatccccaggggcaagggcaactgaaccccacacagggccagcagagaccctcagctctacgcaagcaggacactctttctcccttctcrggcctccaccttctctccctccttcacccccttcctgactcagtctctctgtctctgtgcctcatctcgcttttcccctctccaacttcctgttactctccttctcctaaatttcttttccttcttttcctttttcttttttttcttgaaatggagtttcgctgtcgtcacccaggctggagtgcaatggcgcgatctcggctcattgcaacctctgcctcctgggttcaagtgattctcccgccttagcctcctgagtagctgggattacaggcacctgtcaccatgcccggctaatttttgtatttttagtagagacgggatttcaccatgctggccatgctagtcatgaattcctgacctccagtgatctgcccgccttggcctcccaaagtgctgggattacaggcgtgagccaccacgcccggccctaaatttacttcttattgggacactcatttccttcaaataaatatatgtatttttaaatgcactgagcccctaccgggtgcaggcataaggtgaggagcttgggtctaatcaaagatgagtaagacatggacttccctgcaagagagatgagtcatgtacctaaataagtgaaatggggaggctgaaagtggccagtgtgataaaggagacactgatgggggctgcagagtaggagggttcctgagggcttcaaggaagaggtgatgtttttagtcaccttgaaatacgatcatgcaatgaaacgtgggctgactctgggcctctcctgtggacagttgtttaaggaccagctcatttgcctggaacgtagggaatttgaatgtcatctttctttcactttatagttctctgattctgactcacttccttaccgatctcaccaccttctccttcattttctctttcatctgtactttttttcttccccacctgtcccttcacagaccataagacgtacttttgagttttgtcctcaatttcgttttccttccatccttttctctcaagtctaagtcccactctctagcatccttccttcctaacctccaaggtgccctggtagaccacgtggactttgatgtctaacagaccagggtctcagcccagtgactcaactctctaagccttcatttcatcatctggaaacagcctcctagggctattgtacaaaccaatgagacaaaggatgtggaaacgcttcctactgtaaatgagagtctttaccgttaacgaggctctttagacttaagtgacagaaacccaactcaagatggcctnaagggaaaagggaaagtctgatgttgctaggtcagacacacatggccccagggcttcagacagtgaccacaacactctatctttctacatctctccactgccatcccccatgttgggcaggccttcctttgcagagtgggaacacagccatctccttcctatcagctgagcaactccagtgaaaatcgggcacccattccagtggtgtcagcaaagctctgtgattgaacgtcagtggactcagccctaacccattcccatagccaggcctgggtcccacgctatcacacggacccgttaatgatgggatcctcccacccaacccataaggaccatgagtgggaaaggggaacatcttcccagagaggggccatttcacagttacaaaaagaaggggaaatggctgttacgaatcaagctccttgagcaacggagacaagaaacacagggaaaggaacaggctcacgccttcttagccctcaggtgtcatctcctcaaaaaaaagtcttctctaatcccttaaggatgtgttgggtgcttcacctgtgctctagcagcaccttatgcttcccctattatcatatttttcgtgtttattatactattctatttgcttgtctgtctccttcacaggactttaagtatcgtcaggacaaagtcagtgcctgtcttgcctgttgctgtacacccaatgttgacaaatgccagacccttagtaaatgatggatggagggatggatggatggatggatggatgagtggtgagatggatggaaaacagacagctggatgggtgaatgcatggatggtaggatagatgagggtaggtgaatgaatgagtgagtggtggagcgtatgaacgatggacgattggttggataatgagtggatgaagggatgaataaatagatagatggatggatgaatggttcagagataactggtgagatcagtttggaatgggcttagcctgaactgcctgtaaacacaaacagagctgcccctcaagttgttgatagatgaaccccaagttcgggagagaggtctgggctggaaacagaggtttaggagctattaatacagagactataatggagtggatcaaggttacaggggaggcagcaaagtggggggagccaaaatcagacagcacytaagtgacacttgaacccagggctgtgtgatgatgtcagagcttgctttccttccttcattttatggcagcttggccactacttgaggtgacagcacagagttaatgtatctccctctcccctccctccccctcctcaaaccactcagccagaagggagcagctgcctgggaggacagagagacagattatgtaaactgtgattgccacccacaggaggaggaggagactgaataggtattgaaatgcgctttcaataatgcatgtcctcctccgcacaggcctggggcttgctggggaggagaggatccttaaagggaccgatcctcctgtccccaacacccacaggccccctgccagccatacaggtcccctgtgcacaattggagggctctatggacatccactccaggggtccccaacctttcaccctcaaggacgcctttttttctttccctcttgacttcagtggatttgactttttaaagattctgtttcccaaacatgctgcatttaagtcatgattaattcattttccccattttttattaatcaaagacacttaactgccagtcagagctttgatcagcaagaggtaagccacgaggtgaggtgatgtcattccaacccaaagctaagaaatatagcaagcaatattgttaggcaggccggccttgctgccagaaagtgccctcccttcttctaaccccagagatagaagagccccaggctggggaccagggaccctgcccaagtctctctcatttcccaaaggaggaaaccaaggcccagaaaggcaaatggacttgcccaaggccacaggatcagtgagacctaaaggccaaggtctggcctctgcagtttcaaatgacctanaacttggcagtgaaacaggccaagcaggggacctgaaagtcaagaggagggcaggagaaagagaagccatgagagccagcaccttcattgtgctcctactacgcaccagacccactagaaagtgtctaccaccttgttctcacacaacaactcggaaggctgagattgacattcccgttgcacagaggaagaaattgagcatcaaagaggatccgtggttttacatcatccactcagctgggaagtgaaggatcaggattccagcaggtgtgtccaaccgaccgtgaaactttttccacctcactggcctggctgtgatggaggcgaggagatcattcagaccagattggcatttctgtttgccactcaccagtgtgtgaatttagctaatgatctcacccctctgagcccccattccctcctctgaggaactgggatagcatctgatggcttgagtgatggtggaggataagaaaacagggttaaagaaaatggggcacagaaactagggtacagagaagctttaacttggcgaactggaccgggtacagtggctcgcacctgtaatcccagcactttgggaggccaagacaggcagatcatgaggtcaggagatcaagaccatcctggccaacatggtaaaccctgtctctactaaaaatacaaaaattagctggggatggtggcatgcacctgtagtcccagctacttgggaggctgaggcagaattgcttgaacccaggaggcagaggttcagtgagccaagatcgcaccactgcactccagcctggcgacagagcgagactctgtctcaaaaacaaacaaaaagaaaaaaaaaaaggaaagaaaatggggcacaatacttagaaatggcatcctctcgctctattccctccttttctagtgaaaaacttccaagctggcagaagccagagtgtgagatctgattgcttctgtctctggggatctcctgggttgtagttcaggaaaactttaccctgttcttccactgctttcagttaaagggactgttttcctctggtccagtaattctaagacaagggttgagagtgggacgagagtctctgcctgtagcttgaatgctctcctggycaccaccatctgcttccacatctggttttattgctgggcgggagatagcttgaccattcccatcacactcctggaaactccgttgatttccccaaggcagccaaagaagctggagtggaaatctcagctcccagcagctagagagggtgaccctgctggacttgccacagttgctcctcctggaccaggcggaggtggagtaattgactctctggtttcccctggaagtggttttaaatgaataagtgcaaaaaaaaaaaaaaaaaaaaaaaaaagcctggtaactggggtggggcactaagcaatttcttgggcaggaattcagcagatcggatgcttgtgccagtggtgtgggctgggctgagactcagggatgcacagggcttggtgcagacagggtgggagcactgactagcggcaccacgaggttagagggctgcgataaaggtgtgtgaagggcactgcaagaacccagggtgggcgccactgactgagtgggtaggatagtatgggtgaggtgagcttctcagaagacggacctttgagctgagcctggtaagaaatggggaatttcagatagtgtagacagatgcaaagatgggaccacatgagagcattctaaggaggagtccaggttgtttgaatacaaggggatggacaaaaggtagggcaggagcgcaaggctgggccagatgttcgaaggccttgaatgctattcccagtgcgaaaggactccacgctttggtcatggccacagcatgagcatacctggggtggggctagtgtttaagaaagatctctatgagaatcaaactggaagcagatgttcccaagcaaaagcgataggccagcaggaatcagacggaccctcaactgggctggagagatgtttgtggcgggtgaatgggttggatttggtggctgattggatgtgggaaggagacgaagaaaggaatctcccaggatggcacttgctttggggcccctactggcccctctaccctgctcagggtggggagagaggacccaccaatgcctaggccaacccaggttcccagggaagcttggacagggagggcttcccaacacccactccctcaaaactgaagagaaaacttactacttgtattcttgagctggtcaacacactcagttgcaagtgagcaaaatccaacttaaagtgacttcagcaaaagggggaatgtgtttggtgtgtgtaatgagaagctctagggatgctgctttcccctacagttggatcacgcagctcgaatgaggagagtaaacctcattctctctccctgtcttggctcagctttcctctgtgtccaggccagctctcgtcacagggtggtttctgctgctccagacttacatccccacagctcagcagctgcagcaacaggagactccaacagccccatcaaaagttccagaactgagtctcattggccccttttgggtcacatgcccttccctgcaccaatcactctagccagagggtggactacactgattggcctaaaccgtggtcatgtgccctctatgggagaacaggctggggcctcaccctcaactaaacctcactgaaggtgactgggggaggagcagcttccccagaggaaatggggataccctttctaaaataagggaaattgttgcttgattgcttttctacagcagctgagggcaatgcagagtggcccctcttctttccagcatctgacacccatattatggtttcatacccaggcctcttcaacatacctttaaagtccaagagatgatggccgggtgcagtccctcacgcctgtaatcccagcactgtgggaggccggggtggttggatcacctgaggtcaggagttcgagaccagcctagccaatatggcaaaaccctgtctctactaaaaatacaaaattagctgggtgtggtggtcagtgccgagcacctgtaatccagctactccggaggctgaggcaggagaatcgcttgaacacaggaggcagaggttgcagtgagctgagatcacgccactgcactccagcctgagtgacagtgagactccgtctcaataaataaataaataaataaagtccaagagatgaaccagcagggagatgcacttgaccttgtgcacatttacaaaaaaaccaactgcaactattcattcatagacccatctgcctcctgcgtgccctggccagccctgcctatcgagggtgatagaaagacccagactctgcccccaaggagtttacagtcagtggagtctattttaggtataactcctggataatttagtagagtcagacttactctccaaaaaatacacttcactgcatatgtttttctggtattcggatgcttttatttgcttttagattaactgcctcacatgaaaatcatgaattgaaaagacctttaaaaattcaccatttacttctgagtcaattttgtcttcactgataaaaaatacctaatatctattgcacatcctcactgaggcagcctctgggagtttcacgatttattctctggaaatccggatctgggtcctgagaaagtgtggtggtcccttcatggactaagagggtgagggtctggaaactgttctattggaacagcgagctacagaatgatggtctggacgaaagaagactcgggggcatgtgctctctattacccagcatctgtatgtggaagcaacgcacgttagagggtagagagtagaagtgattgggaatagattttttagctcaatatgaaagagaaatatttagagaccagagctattgcaaaacaaatagactgccgtataagctagtgagctcctcattcctggaagcgtgtaaacagggactcttaggtggaaagttagaccaaatgacctcagcctcttccaactagaagattcctcaactatgggctgaacagtgtttgagttttggctcaaacactatttttctctgtggccttgggtgaggcgctgtccctctctgagcctcagtgacctagatagcccccacagcgtcttcctcttctaaatactttgccttgctcatgtcagatattcacacctgcctctgcacactcaggcaatttctgccccgtgcatatttcgaggctccagagcctgagcaaaccagcccaccaaacccacaggtgtgaggcagcttctgtctgtgccttctgttcctagagaggctgtgattcatggccatgggggatgcctcccccatctgacaggtggagaagtgaggtctgggggaggaaactaaccactggagccagacgcactccccgcaaacacacctgactgggcctctcccacctcaccatctccctgtccccattattggccctcaatccacaaaggaccctgggaataggcctctccccaccacgtcaggtgaagggcagccactgaagcggatgcagaccccaacatcttggacctgagaagtgcatttcccacagatctctccataggcagccttaaggctttttgcgtttgatttttacaacagccctgcaagggaggcattaccgtccccaacttctggggaggaaactgcggctcagcgaggccagcaattgtctgaaaccagctggtaaataagctgcagagagggcactggaccaggcccacctgctcagccatgctccctccctggggtcgcgcagaagctcacctcgggaagaaggccccgctcccccaggaagggcccccttgccaggacagtcatccagagccacacctgaccccagttcctgctgtcactctttgctaaaagatggaggggactaggtgggcctcgagctccaccttccctcgnacttctgctgggtcttttggagaagccacttgccctctctgagcctctgcttcctacctaaggattccatcaatctaagtctctgcacccctatatctccatctgagtggggaataaaacttccggccacacagagtcacaaagcatcctctaccccttgtctgccctgatatgaccctgtaatgtggagagcagaagacccactgcacaaatgaagaaactgagagactttaacttgtgcccaagatcacacagttaggaagacacaaagccagagatgcggtcctgacccttactactcaggcagtgcctgcccaggactctcacgcagacctagctggggccacagaattcacaaggatgcggggtaagctgatgacacacttgtcagtgggccccaccagccaccaggtcctccctccctcccagggcctcactgaagccaatttctgcaccatcagagccgctgaaccttctgctgttggtggaagccagtcacaggtcactgcctagcggtctctctcatccaccagcgtggctgcggccctccgtgctctctggggttctgaaaacagaactgtgtggtgccaggtgatccagaagagaagcagtgagagctggaagggcacatgaagggcagtgtgggcagagggacaggcagggagggcactgccgccacagagctgscctggttccctgcccccgggggagcacagcccagcaagagggaaatgatggcatcttttgtggctgaattttcacaactcatgagagaggaagagatgattagccccatttttcagctgaaatcattgatgctcagacatgaagcaacttgcccagggttacacagccagggagcagcagagcccaggtatgaaccatcatgcctgtctccttccccgcccccggaggtgcgtgatgcccccacagaggagagtgaagcgaggcagccctcctttaggagggggagttttaggggtgaagcaccccacccccagctgtccagccacccttagcctcttcctctttgccacaggccatgcggcactaacaaggactctggtggtctcttcgagggaccctcatacatagctctgcaggcaggcaagggatgagcacaatccagtctctggagtcctcactccccagagctttcctggaaacagcaggaagctatttttaaagcagcatccgcaggcagtaacctgggagatgagtctccctccagatcctcacccctgtgggctgggggcagcgttcaccctgctcacagctcagccaagaagcccagatctgggaaggagagcagggaacatgtcacctgccaagggaagcaggtgggtctgctccaaacaagcctcgattttaccaactggaaggggccttagagcccaagggaaacgtgcgtgtgttcgtgctcacacagttgtgtcagtgcgattgtgagcatggctgggggtgcgcgtgtgtgctcatggcagctgagtgtctccatatcctatgcaggcgtgacatttaggcataagtgcgtctctgtgtctgtgaaagccagtgtgctgatgtcagcttgcctctgtgtgtgtgtgtgtgtctcggtacatctgaatctatttgttcctgtgtgcatgtgtgtgggtgtaagtatgcatcagtgtttacgtgtgtctgtcagtctcccagaaaccctggaaatacatgggcagaatgttagaagtaggaagagcattcgctctctccagctccctcccttctctccccactgctcaagtcacagaaggggaaatcgtagctcagagaggggaagggacttgctcaaggccagtcagccgcagagagaactggaacccagatttgcttcctggctcccagggcccgtctactcagtcaccccattcaggctccattcccaaggccaaaagctgctccctcctgccctgacgcaggtgagaaccaacagggcccatcttctccctgggctttgacttggctgctgagaggggaaaagtgtctgatgcaagtgtctctgttatgggctctgagcagaacattgactatgattcaacaaaccatagtctgctattggggcagagcatgtacaaagcctaccagctgcccagccctggtcccgcagatatcccaagagaggccaggcatggcccctgccctcaagatacccacagctcagcaggaggtcagataggtcaaccaagaactatgacatgggattaaacatgcctaacggaggcatgcagagaattccaaagcagcacagaggcagaggcaactgattctgccgagaggatcaaacaaagctagtgaggagatgggcgacatttgagttggggtttaagagagaaataggtatgtcagacattgaaagagaaagggccttctaagctgggggcacgagttatgccaaggcaacttatccacttctgacactgttctaaagaggtccagctcttccctggtctaccctaggactctgctggctctgccctccatgtctcttgtctgtgctcctattatttccaccatctgggatttattcattcctttagcaaatatgtcctagccaccaaaaaggttcctggccctgaaagtggtacaggagataaagctgtaattttgagcatagtctccatgtctgacngcaggagatgggggtagttaatcatcaaccagtcacagctcctcatttcctatgtgcctggccctgtgctcagtgccatgaggaatggagaagaccatgaaagctcattgagcaccatgcttgcaacaacacagagagttaagtcttgaaggccccatttctggaaaagaaagttgaagctcagagagatgacctgacttacctgaggttgcacacagtgctgagagccaaaccagctccgtgtgatgagtgtgggttctttctgccaggctgggctgcctgccttcacaaccagaaacatgggcgttggaaactgctgcttctgctgttcttttgcctataattgtctccttaacgggcctgtgacgctttcagttatgttcttttgtaaatgccagacaagcttggggacccaaggcagtagggagattgtctgccaaagaaagtagaatcaaacctccccttccaaggaatcttccaaacccagcaggtttgaggttaaaattggagagggcaggaatctcaggggtcaagactgggcccctatgtgccttccaagaaagcacctcttcctgaatctgatgctcagaccaaaagaagggaacatgcatggagaggacccaggcaggccccacacatgaagcccttagcactctgcttgcctctttaatgtgagctaagaaaaaaggattaggctgggcgtggtggctcatgcctgtgatcccagcacttcgggaggccgaggtgggcagatctacctgaggtcagaagttcaagaccaagctggccaacatggtaaaaccccgtctctactacaaatacaaaaattagctaggcatagtggcaggcacctataatcccagctactcgggaggctgaggcaggagaatcacttgaacccagcaggcggatgttgcaatgagctgagatcgcgccaccgtgctccagcctagatgacaaaagtgaaactccatctcaaaaaaaaaagagaaaagaaaagaaaggaaaagaaaaaaggattaatctgcattgcatggcctccacaaagctttgggattttttgaaatctcttttgttacggaggcttcataatctaccttgtgattaggaattgccaccctgattttgcagatgagaagggctggctgcttgggatacagagatgaagagagtacagtccctgaccccaragaactcgtggtgaagaaacacaaacgcacagaaggcctctagggtgctcaagtctgtaatacaaagaagcatggggggctgtacaagggacacaggggactcgtttccaagttggaaagtcaagaaaagctttctgaaggagcagacatctaagctgagaccagaggaagaaagttagccaggcaaatggaaatgggggggcctggtatgcaataggtcaaaggctccagcccaaagcctagatcccactccaggactctttgagaaacactgtttgacacatccactgggcaggtatggtttggaagaatttagcagttaggatctggggtggggatgggaggctggagagggattccacagccaaaatcagtcagtccccagackgaggggactctctccgccccttcctgccatagccaggccccttctttgaaaactttgcccagaccgcaggctcggctgctacctaccttctgttgcctgcctctggttttcctccctcacatcccctttcctggtgagctggggacccatctaacctggaggcccaggttcctgcagggcacttagtttccatgcatggctccagcccccatgggctcagcgttcctccctgaaacatcctctctggctgctgttttagcgcaagattttgcttcagggtaaatcctacrtttcccaaaccaacggcatcttggcrtgtaactgagatgcacagggaatccctggatttgaagtcaggaaggcctgcctctggatgccagctctgccactgatgtagcttggcaagttcctacgtgtctctggaccttgatgtccacaaatgtaaaatggggtaatgacaccaactgcacagaattactgtgaagattcaaatgaaaccctgcatgcgaaaactgctcagaaacggtccagagatgtgtagatacaggcaggtactactgctgtgaccctggtcacagaaatgtccattcactcagcaagtgtttatccagggcccgggtgccaggctctgcactcagagctggaatctaacaatggactaagtagacgcagagtctgccctcaaggacctcacagtctgggaaagagacagacatggacaacttcaacgtaacgcaattcatgcttgggtgggaggaagcacagtgggcggggtagcagggggagtcaccttaaacctaggccagcctgggaaatgcagaaaagttttgtggagctgggtgtggtggctcaagcctgtaatcccagcactttggcaggccgaagtggacagatcacgaggtcaggagacatcaagaccatcctggctaacacggtgaaacctggtctctactaaaaatacaaaaaattagccaggcatcatggcgggagtctgtagtcccagctactcaggaggctgaggcaggagaatcgcttgaacctgggagacggaggttgcagtgagctgagatcgcaccactgcactccagcctgggcgacagagcgagatcctgtctcaaaaacaaacaaacaaacaaaaaacaaacaaacgaaagttttgtggaagcaaaatcccagtggagcaagccaggacagggtcggggaagagtgctccagagagggacaacaggaggggcaaaggccagggggcaggaccacagggttgatggggacatggcaaagagagggagctgaggctgtgaaggcaagcaggatacatcaattttaagatatgtttgaagttcatggtattttgttaatttatcttaaacagattgcaaacaatgtgttgattttttttgaaaaagtaaaaactgccacaccatcacatacgtttagatcatattacagttaccggagcctggagcagctaaaacaagaaaaaggttggaaaacacaacattgrgaaatagttcaatcaatgcataagacaggaatagtcagcaaaacagctccctttttaaaaaagtaatttatagcatcaaaaatctgaatcatgcctcactggtaaattctaccaaatatttaaggaagaaataataccaattctacacaaaatatttctagaaaataggagggaaccttcccaaatcattttaagaggccaggtaaattagcttgatacagaaaccagacaaaggtattacaagaaaaccacaggccaatatccctcatgaacacggatgcaaaaatcctcacaaaatattagcaaatggaatccaaccatctgcaccttatttccagatgctcacagctgagctcttcccagtgctgaaatcraagtttttgttgaaatcaaattatttatttaagtgagttagtaagagaagtcttggttgtaagtggtttttatttatttatttatttatttcttttttttttttttttttttttttttgagacaggatctcgctctgtcgcccaggctggagtgcagtggtgtgatcttggttcactgcagcctccacatcccgggttcaagtgattctcctgcctcagcctcctgagtaactgggactacaggtgtgcaccatcacgcctagctaagtttcatatttttagtagagatggggtttccccatgttggccgggctggtctcaaactcctgacctcaagtgatccatctgcctcagcctcacaacatgctgggattacaggcatgagtcaccgcgcccagccgcaaatggcttttaaaatctcaactgactaggccaggagcggtggctcacgcctgtaattccagcactttgggaggccaaggcgggcagatcacgaggtcaggagatcgaaaccatcctggctaacacggtgaaaccccgtctctactaaaaatacaaaaaattagctgggcgtggtggcgggcacctgtggtcccagctacttgggaggccgaggcaggagaatggcatgaacccgggaggcggagcttgcagtgagccgagatcgtgccactgcactccagcctgggcgacagagcgagactccgtctcaaaataaataaataaaataaaataaaataaaataaaatctcaactgacttaagtaaaaagaataaggtgaagcactggttcgtgctcctggtcactcaggtgactggaacgaggctcttactcaagtccacagggagccagctgcctgcacccctcagctctactctcctggggttgtcccattgtctcaggcaggttctccagcggggtggcgagaggttgctattctcaccaggtgtttgtccaaccagctgcaagtcatctggaaagaggggccctctttctggggaagcccagaattgaggttcagccagggtgggttacacaagggttttgcataagcattccgtcttcaactaccccgtcctctgtccaaaagatagaggccttggcacagaaaacaggataaaaacagtagtaatcattctcaatccatgcctccctttacagtctatgaagctccagcagccatcgtcccagctgatccttgccctgcaaggcaggcagagcaagtgccaatgtcacacccactttacagataaagaacatgaggcccagagtgcaggcagtggcacaagtggtgcagccgaagctgtgttcagwtcagagctgcaagatgccacatcccagggcagtttcagttctcaagaaaacctctctagaagaaactagaccctaacttgggtatcccaaaggagtcagggggaaaggaagcacggggccaaggcttggtcaccactggtctcattcactcccttctccacacctgcaaggtggtctcactgacctgaggctctgagaggagctgtgacctggtcaaggtcacagggctaggaaaggaaattcagaccccaagctgtgctttcccctgaccttcacttagctctgaagaaaggcctcggggcaaccccacggggcgtctctgcacggctccccgcagcaggcagcaggggctaattggaaactggagccttgaaaccttcccgccctcccctcttcacctggagccaaggccatctgttcccttttgtcttcaggctgcaggggaagatgaaactaaatttaaatactaataatacttaacatttgtctggaaagtgttttgcacactaattgctgattaatcctccccaggccccagagagatctccctgtctttgtgtccccattctgcagacagactggtggctttcagacagaaaggagctggaccagaaggctggaagatggattcggggcgtactgtgcaagacctttgccagagcctgagcaatttccatctctactcagctggatgggcgtggtgaataaattcattcagttcattgttgctccacagctaacaataaagctgggagctgggtccaaatggtgacttggctgtctaccagctgcttggccatgggcaacccccaccccctctgagccttggtttccgtatctgtaaaatgtacatgatgctccctgttggttgggtcagcctccccagtgttaccaagccacggggccggacactgggatgctacattgaaccaaacagagaaggtcccagcttccatgcaacttgcagtctagtcagagagggagataatagttaaaaataagcaaataagcaaggtaattacagctcgtgatggtaaggctgttagaaaacaattttgtaaatgtattttttaaactgtgatatacctcaaagattcttctgggtggtagagtcctatttttgttgcaacatttatctagaaatcagagatgtgttccccaagaaatggttgcaaaagacggaaacatagaccgggaaattttgccaacgtaagggagcgtcctaatgggtcctggggcagacagggcgccgtcagctgcccacccttacattcctgcatggagggcagctgtagctagcatttctcacccctcctgtctttttttttttttttttttgagatggagtcttgctctgttgcccaggctggagtgcagtggcacgatctcggctcactgcaagctccacctcctgggttcacgccattctcctgcctcagcctcccgtgtagcagggactacaggcgcccaccaccaagcccggctaatttttttgtatttttagtagagatggggtttcaccgtgttagccaggatggtctcgatctcctgacctcgtgatccaaccgcctcggcctcccaaaagtgcgcgtgagccaccgcgcccggccccccttctgtctttcatctttatacttccccaggggtttctgggctgccccctcacccaagcctcagagccaggtctttcttatggagttggaggctgtgaccacatggttttccagcttttctagttctttgaagtcctaagattctacatcaggtctcataggccaccgcagggaatgaggggacccaggcaggggtctccaggccccccaccactcacgcagccagtgcatcttcactctaactttcttacccatttggcttccaaatcaaatgcaactaaaaatagaatcccatttctataaaatgcttgaaaaatagctttcttcagggagatgacttggagttgggacaccaagatttaaatcctggctctgtctcctaagagcaagtaacccagagcaggccggcactgtgaaatgaggttgctgtctgaccagagaacacaaggaaggtcgtcctggcaacaaacccagtgtaatgcttggggcactccataagcattttttaaaaatgtttttagagacaagagtcacacgatgttgcccaggctggctttgaactcctggactcaagcattcttcccaccttagctcttgagtagctgggattataggcacgagccaccacattcagctttaagcatgtttttctttttaatttttcctcaaaaaagaatgatacaacttttattttccatgaatttttgtttttttgttttgtttgtttgtttgtttgtttttttgagaaggagtctcrctctgtcacccaggctagagtacagtggcgtgatctcggctcactgcaacctccgtctcccaggttcaagcgattctcctgcctcagcctcccaagtagctgggattacgggcatgcaccaccatgcccggctaatgtttgtattttaatagagatggggtttcaccatgttggccaggctggtctcgaactcctgacctcaggtgatccgcccacctcagcctctcaaaagtgctaggattacaggcgtgagccacctcatccggcctcaaccttaaacaattttaaggtgatatgtttggtaatgtatctgtgatctttaaaaggtgtagagttttgggaatgtacaacatacaaggtaaaaccaagattacattaaacattattttatcctctgcactaattttgcagtgaggcacaaatggcaagtacactattaaatgacatttactgtcaaaattaggaacttcattggaattactctgaaaaacttaagccactgtaacttgacacantgacacatttttccattttaggacatccaattatatataaatctctggactattacattcaaactcatttgtactgccaaatgtggcattttaaagaagtttctagaaaacaattgcaatcactgttgtttggggggaaggttatcaccctgtacataagagattaaattaaaataaaatgtaaacatatagtatattatagtgacaggtcgttcttaccactcagaaaggccaaatttatccatttctttttcgaacaaaggtgatttttttttctacagaacatatcctttgacataaaacaattacaatacatgcccattcttttttaaaggaaagtcttcagagatcttcaaagcataaaacatatgtttttttttcaaagactgacagaaatgcttaataatcactaaaatgccaacctcagcaactaaaaattagtgattcactatactgaaattaaaatagctttaacaagctagttataggtgttttacagataacagrtgtgataaaacaagagttggagaagttttaatttgcgtcttttcttcaggtatttaacaagatagaatagagctgggttgcaatatcttaactccaccaccaggtggaccttgcctgagaaggccaaaagaaggcaaaacaaagtcacaacttagattttcaagcctatggcttctaaaagtcggtgtatcccattcattttaaaacagtagatgcctccttctttcacttaagaactcaatgtcaagtcttcctttcatggaggacgaaaaatcagcaccatccctctcagggcaaaatagagaaagcccactcaagcactgttttcctaatgcaaaggcatgaagttctttgcaggattgacagggtctcacctcttctgtattaggctggtgccagggaaaagggcaggcatggagaggaagcaagaagactgtcttgcaaaaatgtcaaggaaacatcccctgtttgcacacatgtgggaaagcgagtgggccagcacatggtgtgacaagacttttttttatagcatgctcagctcaaagagcttcctctgtgctgggcacacaggtgtcctctgcaagccacacagcagcctgactatcctcatctcacagaggaaaccaggrcccaggaaagtgggtaattcaccagcctcccacaccacagttggggaaactgagatttgaactgagaactctctaactatgaagggctgtgccaggaatgttttaaggtagaaacaaggaaagcattgaccttcatgcttcaatccaagacacagagaccttgaggtgagtctaagacagtgattgctggaggctccagttcccatacataccctctggtgagcttctcagcatacatctcagcccactccagttccccacaccaccacatacatccccccaaaacctgcaaacccaacacggagacagacactcagatgcatagtcagaactcatgcccacacagaagggcagtttgtgcaagctcccagcaggtgcacacacaggcttacgtgggcaccagcacanaacaaagcacaaaggtgcacctgggagagtcacgcttgtgaagaggacattacacacaggagaagtgcacatcagaaacagcctgaagctagaatagaggcaaccagagcagggnacgtggggtacacctgccccactcctcaactaccctaaaacatgcactcctgctgctagcaagaaccctatgtctgagacctagattccagggaccccccaagtctcttccacactgcaggctcagaggatcaaggtcccttaccagcagggacacatgagtgcctctcacacagaggcatcctctcaagtggctctcagatgtgtaggagggccatgtctcccttctttgccttagatcagattggcacagtggttagaagcagagactgaatgggaatcccagctctcctcctgcctgggtgggagtgaccttggacaagtcttcttttctataagcctcaaatttctcggcaaaatgagggtatgatactcaccttgtaaggttttagtaagaaatgagataaagtgtaaacatccaataagaactgaatagatgttgattaccttttcttggaccccactctcctagcactcgctgctcaatgcagcagacagacagacaccattcaatcagccacaagcattcctcccataggccctcccttccaggggctaagaattgcagcgaagacagagatctaagcagataatgactgtccagcatggagggccatgaaggaggacacactgctggtatggtgggagcccagaggaggagacagcaaagcagtggcacagcaggctgcccagagctgtgggtgccagcaggatgggggccataaggccacatttcaaccgaaaacagcaggtggtaatcatttcctcaatgactcccactattgacacttactgagcacctactgtgtactagacattttacatgtccctgtgagtgaaccagtgctctaatcatacagcaaagatgctattattatctcctcctaaagaaaaggaaaccaggggagtaggcatgacctgctcaaggttacagagatcagggtgaagcctgactgcaaaccccacactcttccctgatgatcccagctctcagctcctttagcaaacggccccgcttcctgattgtgccttcctcctcgagttcactgggaagacacatggtaccgtggtgacccacatcaccatctctgcagagtccagcaccccntggaaggacggccatggggcctgcactccagggttcccctaatcctcctcccctggccccagccaggccctctacctctgaggcccttctcacccacctgcacttgcaggacagctgctcggtggccccagcacaggcctgcgcctctgggtattaggcagcctctcctgagccctggcatctgccaaccctgcccttcttagactctttggctaaacacccaactcgtgacaaccatttcacagagggagaaactgaggaaagaaagaccaggggccctagaggtgagggccggcacccatgctctgaagagaacatcccaccaagtttcccctctaggccctggcgcaactgtgagtctagagacccctctccctacctcatccttgggaatcagcagccatagctttaaacagctcatccccccaggctgagctaggattacagcaggcttgccagtgaaggaggttaccagcgagatgagtcagccagccagtcagggtcagcgggtaggggagggccagtcggtcaggcagacagcagcagccacccagggtccagagccagtctctgaggcagccagacggggtcagctagtcagacaacaggctggcctggctcacagcctcctccagcccctctctcgagctctgccttccccacaagcctttgatggggcctcaaagcagtagccagaaagccccaagctgtaaacactggctcccaaggcacacacactgtggtctcacgcatgcacacacctgcatgtgcttactgtgtgaatgtccccccaacacacacacacagcgctgtgcatgcctaggcacgcatacaccaggcacacatgtgtgcatgcttactatgtcatgttgcacacaacacatgctcacagtcacgcacacacatactcaccaaggcacactcgtggcctccttcctgctcacatctttgtaaatgaacgcaggatctcccctgctgatggggcccctgaacaagggaaatccaatccctaccatcacctaaagggctgagaaagccttgggtcggggaggccactcctcaccagcaaagggtgagtgagggagcaggcagggcctggggtcaggcccagggtctcgctccatgtgagccaggctgtgagccaagtgggtgccttcaaaattaggtgctggctcctctcacctgggttcctccaactgaggggaaagcctcaggagagaaggtcgttgttacctgctatagccccgggccaggtggctgggcaagccagctgtagggagggttcccaggagcacagagctctgggcaggtcccagccccacctctgagacctcctttcaccccctacacagtgttctctgattcactgcctcctcatttggggccttgcccatgtggggcagatttgagggcagaagacctgtgtgcctacccagaaatgacccttgagcccaccccagcatcacctcacctataggacaaggttagtgatcttcattaaaaggggtggggtttctgtgcaatgctatctagggaccatcttgaggatggaaggcactgcccaggtgggaatcaccaatgcccagccagaggccaaggaacacgccaagaggaacagccagaggctgcctggcagttttgaatgttagcagcgggatggagacaggggctcattcccagaaatggaggcacccagaaaggcaagaagtttctgtttcttcatcaggaaaatcagtgcctaccacacagaattggtcacgcattcattcaacaaacctttactgagctgctactgtgtaccaggcactgcggttagaggggccaayagggacagacaagagcctgctctcttgaggcttctgtctggtgggagaagacagacagtcaacaaggggacagatggaaaaaataaaacagagattgtcagctgtgacaaggagggtggcttgttgtataagcaaagtcagagagggtctctcttgggaggcagcctgaatttgtctggccacctgaaaaagaaaccaccagccatatgaagaacagagagaacagccatggggccgagggagcagcaagtgcgaagggccggaggctggcggagcttgctgcaactccacgaacagagggatcctgtgaagtggaaataacgtgaatgagttttaaaaagcagggcgtggattyaaaaagtgcctttgcagggggaggaagggaccagatgatgtaggacattgtgaggacgaccaaacagcacgtttgtaaactccaagggctgggaagatgagtctttgtcgagggctggattgtatttctggaaagcacatttcaatgcaggagcctctagggtggatggaagacaccagaatagctacagaacagaggctctgtgagcttttggctgcccctctgcccagaacattccctaacaaggaccagttcttagaaggggaagccccaggcaggcccagatggtgacccaagagagccttccgtgcccatggaagcacttgcctgcagcttctgtggccaacagatcactctcctgtatgttttctcattttctcttcacaaccactctgtgtgggagtcaacagcagacaccttttccaaaccagaaagctccttaaaagggaatcacacatgtccctcctgtacttacaaccctacaaggatccactattcttggactaaaacccacagcccactctgggacccgcaaggccccacatcacctggctcctgcggcctctccggcctcatttcctcaactctgcccctgctcccacactgcagccacatggcctttggtctattgctccaaagcaccaccaggctctttcctgccacaggccctttgcacctgcttttgctctccttggcagattatcccatcaggcaaaggtcactccccctcatgagggccactccccctagagtaactgcccccatctgcgtcactgtgtgttattttcttcatattttcttcagagcattgcctgaaattatcttgtctttgcatgcttaggtagtatctttgctcctactggactgtgagtctcttaagggcggggactcattggtgctggttccacgggcctggcacactgcctggcacagagaaagagcccgagggatatttgtgggataaatggatgagtgatgtgcccaaggtcacgtggctgtcagataacagaggcagaacttacacccaggcctttgggctgctaagggcaaagttttctcctagaatcccaggactttgagggaaacccaggatgggtgggcctgggtcccaggaaaggggagtcatttgtgttcctcctggcttccacccctctggcttcatccccagcaatctgaaagatgcagatggcctgtcccctcacctcctgaaatcaatcagggcgagaccttagtgagggcactaaggtctgaccctcctgcccacaccgcacctgtggccttttccttccttcattttgaggcttggctggcaggtctccacttctggccatgcacacacacaaacacacacacccgcacccccctgcctggccaagtcctccccaagggtgggggtgaggcccagcactagccattctgcaccccctgattcctggtctgtgastccacaggacaggcatggcagatcagttctccctgccctgtaggttcccagggctcaagggcacctgtggtcagccccgcagtaggatgaagagtcaagagggctgcgtggagagtcagaggacctagactctagctctctccacctccctctgcctgtatgaccttgggcaggtcacttccatcccctgaggctcaatttcctcatctgtaaaatgaaaacagggtggatttaatggtctctgaggaatcttctaggttgaaagataaagattttttgggatgctggacatttattgaacaccaactgcataccatccccagatactgggcatttattgaacactactgtataccacagcaaatccatgactacacccagactcagagggacaaagaggcttgctcaagttgtccgagctagcaggtggcagaactgggatttgaccctggcctgcctgatttctcttccccaactgttctaggagcctttgctgcctcagccccccaactcaatgccactcccccatgcctgtaagctggacttctgtcttctctgtctgaaaagtttgcttttgcactgaatccctcccgggctgctggagtgtgatttgctgcctgacagctggaagtcaaagcagcaaggctaactccatcctgcaggcctagccaagctcaggggccctgaaagtttccaggggcagttagaccaagctgggcaaycttgggcacgttgatcaagctctctgaacctcggcctcctcatatgtagtgcagggaggctacttctcctatttaggaggcgttgaratgaatcaacaaggtggtggcaccaaggaagcaaaagggagacccccgcctggagtctgggtgtgtaaataaagaggcgtggggccaaggagggctttaggggcctcgtcccaggcgacgtgaggccaccgcaggaagtttctgagcaggggagtgctgtgaggcgaggagtattttaagaagattcttctggcagcacaggccaggttgagttggaggagccgcgtgggggagtgcgagcggcgcccatgcctggaaaactttgcaaatgaggccccctcttggagcccttcaggatccaaggcaatctgagaagcaggggctgggtccgaggtctcacccccgacacaggttgcatctacaacctcagggccatcagcatccccagagcaactcagacaggctcctagtccatcacgacgtgccttcgctcamagcatgcgtggcccactcagagccgccgctaaagctaggatttgaagctgggtctgtaggacatcaagtccagcgctcttccatcagagttacacatactccaggaaccttgcctgagcctcagatgggcatcttactgccctcaactcagcccagggcaggattagagagaacgggaggtcctgcttagctgcagactcaacaactcctgcagggggcatgagaaggcggctgcagaacctgcccagaccacacacaggctccactacrtggtgcnagtcacaacagagttaaccctggcttccccgattctgctagtcaggcagccaccatggcagaggcaccaagagacactgcctgggacccccagcccctctcctccaatccacatgtctgtcagtccccccgtgaggttcaagctttctcagctgccggcgagttttatggcctctgatgctgacagtgctgttccaagtctctcacctaacagcttcatcacagggctaatggtcactgctattcattcaacaaacaatctgtgatgcttgctttgtgccaggccctggggccaaagagatgtttagacacagccctgcctcaacagccccaggctggcagcaaagagacactgcaggagatgggagatagtctgtccagccaggaaactcctagaagtctccccagagcccatcatacctataaggagatctgaggggggcggggggcagggaagccagacacagccattggtaggggagaggaaggagtgtccccagcatgtacaaaggctgaggcatgatgaaaggccccaaaaaggagggacagactgctgcagaggggcccatctacccaagggggtcaggaagcatccctggaccaagcgatgctgagctgagttttgtgtaggagtacaagtcaaccaggggacaggaggaggacaaggcattccaagaaagggagaagcaagtgcaacacaggcaagggagaacagggtgtcttctggcaattgcaaggtgctgttcagtgtgactgaaggagagggcacgagggaggcatgggcagagtaagactcagaggactcaggggctatttcaggtgctgggacagagccacaggaagggtgggtgagagtcctactcctagagaaaagtcattctagttgaggagatgcaataaacacatttaaatgaataaagataattccagacagtggcaagtactacaaaaaccattaaatagagtagtgcaataggaagtgaggtcctgttttaaatatagcaatcagaggggttgctttggggaagggacattcaagccagaatgtgaataccaagaaggagcctgccaggcaaagatgagcatgtttcaggcagcagagagcatgtgcaaaggtcctgaggcaggaacaagcttggcaacccggggaaggcagggagtccgtgtggctgaagcagagtgagccggggagagcagaaggaaaggagggcatagaggagacggctcagtttgcatgggcttcagaggcccagagagtgactggattgcattctacctgtgctggtttcttctaagccaatggagactttcaaacagaggtgtgtcgtgatctaacttacacttctcaggatccctcctctgctgtgggaggctgtgctggtgtgtgtttttaacaccagccagtgctgccgtgtgtgcaggaccgatgtccacacttcacaggtggaaacagagcacaaaacagtcagtttgcttgtttgggtggcactgacctgtccattgtcaccagccagcagctcaaagggatgtccggctacccttgggtgaggacagggtagtgtgctctctgattccaaagggacacctgatggtgagtttcgcaacactggacgtccgtgtatactttcctgggactgatgtcacaaagaaccagaatcttccttaggccaagaaacatggacccctcatctcatacacaggacctcatgcatgcagccgaaccccacactggatgttagaggcacaaagacttgaccttgaggggctcccagcatggctggggagatagcacataagcagagactctccctgcacaagggggtgctaccacgctggacaggggaccacactggctgggggagccttctcagggagagaagaggagaggctcctggagagaagccctctgccgcaggtcctcgttggggtcatcatgggagaagccgggctttggagctggactcacctgagcctctcggtgttatagctcccctgctgcgtgagctccaacagggccctggaccccaccctggctccatctccccttggaagcaccttccttgccttgctccagccattggggtcatggcatgtggcctctcaccaggtgggctktcagcaaacatgagtcccttcctcaaatattaatggaattgtccctttgggggaacgaccgtgtgactctgagcatgagaagtgtggttttgggtaccatctgtttcccactgaatcaggggctccctgtgctccaaaggagccacatacacagaagtcatccttgggaatgtgtggtctgtgcagcgggccacaccacggcatcaaggcacatgagggcaatggcgcaggccgagtgaggaacctgctgttgatgctgatcaaaatactggagtttgcaagtgacagtttttttgtttttttttttaagcaaattagggttgattcaaagatttccctgtaacaacgtcacattcaggatgatctagcatcagccagatatggggccctggggtctgaggtcacccatgcagggcccagcaagggggtggtatttgggccgtgccttgaagaaaaggaagggctggctgtatggaaaacgcaagtctggcaggaggatgagtgggcgggagacagaggcaggaaagctgcacaggcgcagggagcctccagaggttcctttcggctggccagagcagactagagccgcactgggaaggaccctgaccactaaggtcaaggtctagtctagactctggccaacacacctgcacttcctcggaacacccccttgatgttccacatcaaaaggtgcatgatcaaataagttctagaaatgccacatgctgcttcacctctcggaaaatcatcatccacaggagcacagcaaaggccctgagaagtcctgcaggggaagtctgtctgattccatttagcccagcaatccccactcatttgaccgagggcaccctcatccccagaacccccactaatatctgcaagatccactttgaaaaatgccaccatagaaaggggtgaattgctgagcaggggcagagcgatgtgttcagagctgggctcactgagtcggaaccaggtgagggctgggagtgacgaaggggctgagggagccaggctgaggcagagacacaactaggaggctgtgtgtggtgcagagtggggctgggaaggcctgaggaaccagaggcaggagggaggtggtaggggcagagagacaagagatctcagggggtgagtagtccagatttggcatccaagcagaccagggatttgagcttaaggaaccacagagatggtagagccgctgcctgaggtggttctggtgggagataaataagtgtggctcagggcatcttgcgtgtgaggagcctgtggacaggtggctgtaccacactagagacaaagcccactttcttgtctcttcaaaggtaccctcaggttgaaaggtggccccctttggtttgagctggggagccccttaatgaaacacaccagcaccattcattcattcctccagtaaacagctgtcaggtccagttggggccaggttgaagggccacggtgaagcctgcacaaaggcccagtgaggctggggctgactgcccagggcaggtgccatgtgtcctgggtcataaacagtcacacaaggagaaagggcatcccaggcagaggcacgtgcagcttgaggtgctgaaaagggtgtggagaagaaacacgtgactggagggagatttcccccacaagaagtcacttcatggcccagacctcagctttcccacctgtgaaatgggcgtaataacttccactgtggggtcctctgcaaggcccacagaggaatggctgcggaagctccctcatccacactccaggccctactaggccttatgccagccatgggggccaccaagatgaatgagtctcaagaccaaagtgggcttctttgtgccactggcacaggatatctgctttttgccctccagggtttaggaggtggttattgctggaatcaacgccggggctgtcctcagctcccagggactaggttccagatgtgtgcatctggcagccgtgctttggtcctggcttgagtgtgaggatccgtgggccgctcaagaagaggcagatgtattttgacaagcctgccacagcttctgcagcatcctgagtcaaaataagcccttctcttgggcagcccctgggacgggctatttctgcaccgtgtttcttttttctacacagggggctgaacagcaatgatnccagctaaaaacagaagctgccccagctggagcccacaatattcccctcaatgacagaaacctcagcgcacagcctgtcaggaactcaggaagtctttcgtgtgggctcaaactcagataatttcccctgagggtaggcagtccaactccaggaacactctgatagccttccaaccccaggtggttacgaataataaaaataagtcctcacaggaatacaaaaatttaccaatgacaaagtattttcttgcctaaacagtaacttgttgaggggattctattattcccattttaacaatgagcaaacggaggttttgagagttgacctgcctctggagggatggaggagagaagatttgagcccatagctgttgaactgtcttggtagaaagaaagagcctgcaaaagagaaaatggaattgcggcagaggtggcttcaaacagtttctcggtttgaccagatcagcaccaaacggctagagttcttgctttctgtgccaggcaccatgcaaaggcacgtacattcacacactgcatctcatttaatcttccgaacagccccggaaatggggattgctgttgcctttttctggatagggaaactgaggatcagagagacaaagtgtcttcttcccatttggctacaagtaacgcaggttcaacctggggtcttgtgcatccagcaaccatgcagaaaagtcctttgcctccctggtactggaagagctgaggccaaggaccagctaggtgggatgggaagtagggctgaccccagagaaagcagggcgggcaggtgaaggtgtctcgcggtgttttccaaacccagggaagcattggcatctccgtgactgtaggtggttctgtgggtaccactctcgatagcaagtcatatactgaggaatctttcaacactccagtcatgtctgtgaggaagtctcagtacgtcctcagcagtctctaatgttagccccctccctgtccatgaccagagggctagcctcagactgagggcccaggcccaacagcgtggggcaagacagtacacgggtttccttttcactgcatttatgtgcattgttaccttctgttaatancaagtgatactagttttctggtttaaagtgcccatgtgaggtttcttttttaaataaatgcaccaaagcrttttatttttgcaagtgaatgaaatgagagaaatgttaagtaaatagcataggtggtttggagacgtggcaaataccatagaggtgctactccaccagtcaagccggggacacactggctcctcaattctgggccagccctggcaacagcctcacacggtgcccctggaaacagctgtgaggacccctgagaaactggccccagcgcccctcctccgagagctgcccggcctcttgtctttcagggttgtacagaggctgtcaggagctccaggcctcagtcccaccctgtcacctgctgaaagagctgggtaccaggtcttatttgtctctgggccccagttccagcacaggctcccacaggcttgctggcaaatatctgtctattgtgccctgagatatgctggggacaaggggcagagtctctcggaggtaaaattatgaaaatagcaacttgaacccataagaggagacggtacaaagtcagcaactgtctgcaccggccccttctctcatggacatccaaattcaagcccttcttgtgatgcaataggaaagggcggttctggaaccacacggccagagcacagatctcaggggcctctgacgactgagggccttgagcaagcggctgcacttccctccccagcttccccctctgtggagtgcgattgctgcaatgcccactttctaggtctgttgagaggctccctgagttcatgcagatgaagagcttacagcacccctggcccatggcaccccattcatggtacctgttcctccatggcaggcactggctagcaattcccagatgttatctcaagcctggcatcagcctggsaaagtgggctcagagaggcgcagtgccttgctctagatcacacagccagaaagtgctggggctgggtaggagcccaggttctccagcttcatgcccggtgccctgtccccngcacccctgagcccctacccatgtgtccttgtcctgaggcccccacttctcacagctcctccttcctttgaccagctcttttctccttttatcttccacagtgagaactcttttccttttgaccagggacagccaggccttcgtttgctggatcaatcttaaagctccctgctgaccccagccttcctgccacccttgctgcctgccatcccagcctaggtttcctccataaagtcactggggaagcaaggactcttgattgcatgacacagaaccctaactcaaactggggaggcgcaaatagtccacgcaacctttctgagcctcagtttgcccttcagtgtaatggggtcataatgctacatgcagtacaattgatgtaaggatgaaaggaagctatgcatgtcaaagccttagaaccgtgcctggcaggtggtgagcactcattatcagcgtactatttgtattattattactactgttattagcactactcaaggcatgcggggtcagagacactgccccatcttcaaagaactcactgttaagaaggaaaagcctaaatatgtatacaaagataagtaaacatcccaagatcacagcagcctacgagacagcagagccagagtgaattttgcagtgtcagagtgatacaacactgcagtcaaacaggtgtaccatgatccagcgccacagtgggagcgaaaaaattacacaatccattgattccacaaacatttaccaggtacccgccatgggccaggcgctgtgccaaggcatcggggctgcaacaatggccagacagacgtcatctctgcctctgggggactcccacccagcagaagagataaacccagaacaaataattattgaagttcagtggagctcagaagaaaaattatattaggccataaaatgtctaccagaaaacagagcttagtctgagggtgtagccagcaaggcttctttcctgaggacctggggattaaagggcatgacagtcggcagggagagcagctggatgagagcaggagagtagacattacacacagtatttaggggtgacatctgccttctaccataaggcagagcagtcgaggttcagtccagagtcgaaatgtgtggagtctaatcccagctctaccatgtgctagccgtgacctctcagccaatataakacacctcttttagccctagttccttcatctgcrtaatgatcacaatgtcagtaccccactggattaagtgaaataacacatgtgaactacttagcacaatgccagtcaatcctattttagatgcaagtgatagaaaaacaaatgtaaatggtttaaggccaaaggagttatatttgttcatgtaactgataagttcaagggtagatctctggatttcaggaagggcttgatccaggagctcaaaaaatgtgaccgaggttcagcctctctctgtctatcagcacctcttctggcgtggctttcctttgcggcaggctctttccacactgtgaccctgcagcttcaggctcatgctttcccagctcagtaagtccaacagaaagagaggttttctaatattttcaggacgagccccaggatcgagtctcactggaccatcttggatcacatgttcatccctaaatcctaggcctggattacatgccaatctctagagcttgagggaaaggagattcaattccatccaaaccacatggccagagaacgggaaagagtggttccccaaggtaatattaaggtgctatacggaagaaaggctaccagagaaaataggacaacctgcgtctaccatagcaaccacacagagacacaggatgaccatggacagtgcagaataatccctcagtgccacctcatcctacatccagccatggagtgagcctcatctcccatgcagacatcctggttccagaaggacagataggttaagagagcaaattcttggactaaacagcctagaagcaaccctggtatagcaccttctagttgtgcgaccttggcaagtttcctaacctctctctgcctctctccttctctgtaaaatgggcataacaatagtacttacctcataaggtggttgtgtggctgaaatgaggtagtataaagctcatgtaaacccattttcgttaagcacccaactgtgtgcctcacattcagctgagacttctgtacagtcctcatctaatcttcaccacagacatgggtttttgtacccctgcacttctgatgaggaaactgaggctcagagaggtgcagtgacttgcctacagtcacccagctagtgaatggccaagctggagcccagccccaggctttcaaatgcaacatctgagctcccgccacgctccgcgcagagccaagccgaggaatctgacaacccagcagcccaagtggaaagacagagcaggtttccaaggagaaggaggagaggtgttgggaacatgcagttatttacaggatgccgtgtgggctgcggcatgcgagagggagctgtcctgaggtgaggagggagcgggagagactgggtcctcagtttcctcatctacagacagagatgacgatggcagcctctcaccaagagtgggctgatgaaaggacgtggcaaatgtgcagggcctgcgcacagcgggttctcaggaaggtggggggtggggaggaccagctggggtgtgattggttggctgttgtcttcatcagtaggaccagagcctgacccagggactgtgggcctcagctttcccagaaatgaggaaggaacttgcctggatccttcactgcggaccttggttctccaaaaatggcaattcgctaaggaaactgagctgacaaatgcagtcagagaatttagaactggggactgaagaactgaactagggactcatgacagattctacctgcttattaaaacctccaaatggcccccatctcagtctgatagcatccaggcctctcactagggctgatgaggtcccaaacaacctgggactcagttcccattacattccctgccacctgggctccattctgtcctgggaacaagccaagctcactcccagctcaagggagcatccttcaggccacactttctgccccagatcttcagcatgggcctcatccaatttttcaggtcaggctcagatgtcacctctaggagccatactgggacatccctgtcctgtctttctttctcatatcaactggctttatttctgcagcgcactcaccactctgaattatctttccattcacagatgctccttgacttacaatgggtttatgtcccaataaacccatcgtaagttgaaaatactttaaggtgaaaatgcatttaatacactgaacctactgagcatcattgctgaacctagtctaccttaaacgtgctcagacacttacgttagcccagttgtgcaaagtcaactaccacaaagctgctttataataaagcgttggatatatcatgtaatttattgaatgttgtactgaaagtggaaaacagagtggttgtatgggtacctgaggtacggattctactgaatgtgtattgctttcacaccactacaaactcaaaaaaatcataagtggaaccattgtaagttgggagccattgtatctgttaattgcctgtccactcccaccagaaactccccattaggcagggccctcctctgccttattcacccagtattccagctcagagacatgcctggcccagagcacgtgctcagggagcagtgttaagtgagcacgaaggtgctggtctctgccagacatgggcatgatggttgattccagctgctggtagctgtgtgcctcccagcagcgccagggcctgtgcatacactgtctcagcccagcaacgtgcctgcaaggaaagtgtcaacatcccactttgcaaatgaggaaacttaggctcagagtggaaagctgacttgcccaaagtcacacagtgagggcctggcaaagtctggatacaaacccaatgccccttcctgccattccccggggaaaagagctctgaagaacagtacataataggaggtaagagaactccttcggtgagaccctcctggagccccaaagtgctcaatactgaggactgggaatcgtgagctggtgcctgtggtggacatgaccagagcacaaccatacccacttacccctcttctgagcacaagcgacaccacccttcccagccccctgcagcgggcaggcccaaggcactaggcctggccaatgaatggtgagcagaaatgtggctattggtgaatccacgaagaccctggcagggagcatgggccactttatctggcccatttgaggagagctacatcaaggcatgggcagcgtgaacagatgccacaaggatggctcagcccccgggggccagtgtcagtggggagccattagcacctccaacctgaggggcgaaggaggagcagctgccaagcctagagagggtacaagcaggaaatgtacacaatatattacaccaaaaatatcccagtgacaaaatgacatgatgatggggccaaagcatggaaggatcttgcgaagttataggcaccggctgcaaaatgcaaaaaagcctccaccttcagctgagagacactctgattgtgctcttttccttgcctctaatccctgccagtacctctttgataaaacccaagaaagctgaagaccaagggagcctgttgattggtctatgtggggcagcctcctggccacagggcagcagtggaaggraaagggcagaaccggagaaagaaacaagatagyccgaaggatcactttccagcatggaaaccttggtgacacacagctccctcttgctaccagagaagccacgtgatctgatggcatcacaagacgatggagcctccatgagcctcaccaacctagcatacagggtccctcctccaactacagcctggcatggtctgaccatcacagtgggaaccaaaacaaaactaagcaaaaacaacaacaagctaaggagacacatctgagaggctattgcaaagaaaaaagcatctttgggaaaacatttaaaacttgatgacttggaatcaggaggcgtagccagggcagagaggccttgaaattatgcagtccaaanacactctgaaagtcaccttgggaaggcctgtgggaccaagaataagaggcctttcaaatgcatcaaatggaaagaggccagataaagaactggcaagatgcttgatgatcatagctctgagatgaaaaagagatatcgagaagatctgaggaagccacagccccagtcccaactgaggaggaccccagggaaatccctgctcccaaatggtctcttggaagtaagggcaccaaaggcactgctcttgcaggcaaatgttccaactccagttgacaaactagatgcagacaaattgccaggaacagatggcacctgcccaagaatgccgacgccactcaaaggtgaaattgcagagctgttggccaaaagtatgtgcatctttgagggggtgtggagatatgaactgtggatatgatgtttggactttggcaaatctttaagcaagcaccaccattgtgaattccctctctttcagtcaacgtgaccatggggaccagcttgtagtaggtcaagatgcagcttagagacaaaggaagatcagcttcttctttgaatgtgagaatattaaatggtggggcttcccaggatttggacctgcctgataagaagttttctgaaggaggggacacacagctccaaagttacagattccagcaggtcccttccaggtggccgagacagaaacctaattcagagcaactgaagtaaaaaggcagcatttattggctcacataactgaaaagtgcatgagcagagccgggacctgggccctcacacactgtcatcaggaatttgtctcctgcccttcgctcagctgtgtgcttctctgcattggcatcaccctcgggcaggccctccccaggtggtggcaaaccagtcaccagctgctcagtcccacattctgccagccctgctaatcccatacatacagcctccttttggtcaggcactgtggctcatgcctgtaatcccagcacattgggaggtcaaggcaggaggatcacttgagcccaggagttcaagaccagcctgtagccccagctactgcagatgctgaagcagaggatctcttgagcccaggaggttttaggcggcagtgagccatgattgtgccattgctctccagttctgtctcaaaaaaaataaagaaaggaaggaaggaaggaagaaagagaaagaaagagagagaaagaaagagagagagagaaagaagaaagaaagaaagaaagaaaagaaagaaagaaagaaaaagaaagaaagaaagaaagaaagatagatagaaagaaagaaagaaaaagaagggagggagggagggagggaaggaaggaaggaaggaaggaaggaaggaaggaaggaaggaaggaaggaaggaagggtctctttcctgttggttccagctaaagtcccagggctgactctcattggcttagcttgtgtcacttgccatcctagagccaatcaccatggccaggtggctatccagcactctaattagctggctatggatctaatgcccacccatggcagtaggacatagagtcaaccccacccaaaccacaaagactgagggtggaagaagacaggaactccaggcaacactagacaggtcaaaaatgtattatgaccacagcaaattacaccagaaacatcccaatgacataatgccatagtgatagggtgagagcatggaaggatctcatggggttatgtgtgtgggtgagaaatacaaaaaaaaaaaaaaagcttcagaagaggcaagtgcaagatttaaacaaggatgccagagctattattatgctctgtgatccagaaagtggcctcagtctgcaaatcctgcccctgagatggggacctcaaaggccatgggccaagacaagttatttcaaccccaagtaggtggggcaatgccaggcatgtattctacctctggaaatatttgttgaccatccacaatcaaaaaagccttgggcttgatgttggggattcagggatgagcaaggcatgcacttgctctcaagcagcttaggatccagcagcaggagacaaccaaacatagggtaaaaagggcgccccagaggtgtggagggctctgcagcagggagcactatgtgggagaagagttgaggtaaacaggttgacaaaggaagcagaagtcagatcaagaggggccctagtaggtttggacccgatgctgcaggtaatggtgagtcactgaaggcctttgagcacaggagtgacccaagcagggtgacgcttcaccgccttaatagagccagacaaaggcccagtggagagtcacagagaggatcaaagggctggcaataggcctagaagggagacggcagagggaaggctagaaagctggaggcggggagagccttgatcaaagtcaggcaggggagcacagcggcttcctgacgctggacccaggtggggacagagcggccctgtgaagtcaaagagaatgttgctttgttcagctctcactgggaaaggtgagtgttgcacagatgcaccccaatgtcatttatataaccatgaccccctcaagagggggtgtaggctggaaactgggactaactctctaacaaagaggttctggcagagtcctgagtaacagtcataaaggaaagcagagggccacctgggtgtctggggacgttccttaatcattcattaaacagccacttcctgagggcctgttttgggcctggcccttctctgggctctgagcccagagacatgaagccagcatgcccctgtcttattctgtcatagcccagcacctgctgaaagcaccctgcccctgggtgtgtttgctcaagcagtgcccacttctcctactagaagagacagaaatttgtgtattttctcaccatgtatccccagcaacaagatgagtccctggcatacagtagatgctcagtatgtgtttgctaagtaaaggactccctcctcttcagtgagtcccatcctccaagagctcacaatctagtagggaagtcagccaagaaagcaaccttaagtataaagcttagtgctacaatgaaggggtccacatgggtgcatgggtagttccacatgggtggttccatcctgtttcccaaattagattttttttaatgctctagctgtgccatgatggtcaaagcaaaggtttgccaagtgcacagagcagacaaaggcattccacccagagcaaacagcacgggcaaaagttcagaaacatggttgaggttgtggcatatccaagaactgtaaatcatctggtgttgatggggcacaagtggctactatgagactgcagaaagcagtcagagtctgatcaccaagggccttcaaggccagtttaaagggcttggactttatactgaaggcaatgggaaggcattaaaggatttgtattagttaggctccttttggatccttaaagtgtctttaaacaagaaacaaagggaagagacaaaagtataagacccagaatggagtctctctggccctctctgctcatgtgccctcaattgatctctggggactgggggaccagatgtgctgatcagtccagcccagttcatgtgatctgccacccatgggtccaaatgaaatacacaggtgggctcctccaaagctgatgccacacgaggaaggagttggccaaaaagctgtgactacggcgtgttttaaggagaggagtgatgcagtcaactctgtgttttagaaagctctgattctcctacaggtctggaagccagttagaaagtaaagaagaaggtaagagcagaggcaggagaagtggtcccaggctggtggtgagaacagggctgagccaagctgactggaagtgcacaaaggcctaccccagagggaatttcttatgtaagtccttagggcacagctctgagccctgacctacagctccgtcacttttggtcaccttgagacctagaacacccagccccatcaaggatcagcccatggygaggtcgccatatagggtgccctagcaagatcacccaaactctgggactagttgccttgaagctgcagacccagggtcagcttctagaaacccccaatctccctcaggaaatgtggccacctggagagagacaccaagttcagatgctgttgctgctgcttcttggctgtgttatcctgaacaagggcttaacctctctgagtctgaatatccctctctgaatacaaagtggagataatgatatttaaggtaacggaggcgagggcctggggattaaatcagataaagattatgaatcaccttcccccatgagaggctcagtcgatgaaaatcccttcctcttctgccctttaagcttttccctggcttcatcttcccaagacttccccaatccttttcttgtttgccaaataaaagggagttttgttttattttgtttttttgccaggaagaaacaactggaggttgagtggcccagagcagccatttttaaatttgtgggtggaaaattcctcctgttcttgggcctgaagtctaagtcccctctggactttcctcacacagttcccattttggaggacacaaatatcctaggccttcatgtgcaggagaggcagggaggaagccaagaaaaggggtaaaaagaagaagaaccatctcccccattttcctctaagctttaaattcttttctttctcattccaacttaaatacatgcaggaagattatgaggcagagttctttgaccaagaggatcataaaaggaggttttgtctagtggttagtctgccctgaactccagaagagaatgctatgccttgcctgggtgttggagagaaagagggaattaatacttgctgaggctatgctgctatttcctaagcattgtttgattagagccacacaaccaccctggaaggtagagatcactcccccatttcaccaatgggacacagtctcagggaaaagccacacaccatgggaaggggcagagaattagtgagatttaactccctgtctttacgtggccagtgcccatggctgccaccaccatgaaacctctgagatgacttggatggccccagagctttcatgcatcaggagcagggggtaccagccacccctgccccttccctgctttgagcctccaattccatctggcttgcaagctgtgtgtgtttgattctcttcctcagagctccctcttcactaagacagcacttaacatgttgtatggtcattgactgtttgcgggcatctgtctcccacttgcttctgagtgcttcaaatcacagagtctcggatctgaaaggatctggagagtgtgaactggtccgtgtgttagctcttagtgaagcatttgcatctctcactgtggaacgaagtgggggaagagaaactctggaacttcttgtacacctttgcctaggagagctcctggggtgctgtaggctctccatatatgttagataagagaatgagtgagtgaaaaatgcttgctacatagggttgtcatatggcttaaagggttgacatccgtaatgtccctaaagcaatgcttggcacactggaggtgtttaggacgtgtggagctgggcgctgagttatacctaaaaaagaatacttacctagagtgagaagtttcattaacttgttatgtgaccttgagaaagtcctttcccctttctcaccctctgtttccccatycgtaaactgaggacactgggttagatgaccagaaatttctctcttcatcactgatttctttaatgcatgcctcattgcctcccttcatccaaccctcccccaaccacatactcacatgcacgcatgtgcgcrcrvacacacacacacacactcgtctattaatctccagtagcattcctctgccccttggcactctttctctttctttcatttcctcgaccagaggccccataagcttattaacctctgttgtccatgttcaaccaatatccttgctttaacaagacagcaataatgtccttttgaattcatttttatcaacaagcaagatctgttttgtgggccagagtgtgctggttctaaatggaaagtagaagtcatttccagctcacttactccataaatgcaggggttctgccgactgcctctgcaccaagatggaaagaacatctatcttcacaaatgtaggcgacaccatagaggcagtcgttcaagggacaagggaaaaagctttccattccaaaaggaacaggaaggctggaaactaaaaattcctcctagaacgggaacaaaatcacactccagggtcacttccaacttcacaattcttgacactgagattcatagaatttaagattctaaagttgtgagtgaatgtgtgtaattggttgatctgaagcttccatgaatcctaaaatattctatggctccacgatccagtttttctgtaagatgagggtccaggatcttatgattctctgactctattgacccagggcaagggtttttcaaccagtcgatgtgtcagaaacacctgcggagctgggcaaaagatgcaaattcctgggcttccgtgtcagagattttggtttgtgccatgtgggatgaagcacaagaatctgcaattttttaacaagtcccccactccagtggttctgagtaggagtgggctactctttgacatatagtgttgtagggagcctataattctgtgattctaaatgtgattctaaaatggtcttttgcatgattctagtatcctgcaactctgttattctatttccctgtggctaaggaggattctaatgtgtaaaaattgtctttctgagcatgcatgggtttcactggtggagaggaaaagggaccaagcgtcctgagggtggacagacactcaggagggggaccctctcgagagcatggaaagcaaactttgatgctacactgattgtgcctgggcaagtccagagctgggactcagaaatgaggatgcttggctggggtcattggctagctctagggagaggccatcagagaagagttcttaatggacgggtatatccaaacacatctcaaagagttgaaaggactgaggttggaggagaggagacagaagtcataaatgagagttggaaaaagaaccagaggcaagagaggaaagatttactaccaaaatattcttcctttgataggatgggggcaaggagactgcagactgatttgcagacatgaaaatgcaaggtttcaggaaagcacaggatgaggggarctaaccawgtggggatatacagggctacagtgtgggctgggagacgactgctttgacatgctaatgagtgcctgaatctgggagggtgggacgggatgaaggctggcagaggacctctgaggagctgctgggcagatgctgggctgggagagaggctctgagttaggggcagggctttgggatagggaggggctcccccagggaatttccacatggactccatgcacgaccaatgagtcagagttcatatgttgagcctggtaccctctttctgagaaaagtgaagaatgaacccaggtatcatggctcctgcctgcaatcccagagctttgggaggctaagacaggattgcttgaggccaggagttcaagactagcctgggcaacatagtgagaacttgtctccacagaaaataaaaaaaataaaaatcagcaggcttggtggtgcacccctgtagtcccagctactcaagaggctgaggtggatcacttgagctcaggacttcagggctgcagtgagctatgattgtaccactgcactccagcctgggcaacagagcaagaccctgtatctaaaaaaataaaataagaatgaaaggtgctggggcttttgcagcttcccaggtgggatagaagccagcaagttggattaatcagggtgcctctagtgggggcagaatagacaaggaggggtcagtcactatctgtgacacattttgcctgcatacctgcccagtggtaatgacacactcctggctgcacacacacacccttactgccctacacaatagcagtgacacatgttccagcccattgtggcacactcatatctgcagccttaccactgatggttacacaggactacaccatttcatactgatggtaacaccctatcacctggggcattactggctgacagcaacactcagacatacaccaatatacagaaatggtgacacgtccccagagcctttgtgtctggcacagtctatgtaaatggtgccctctgtggttgtgcagtacacaacctgcacagctctatgtggtactcttgccttacagccaaatgcccagacaatgccattgacttattctactctaataacaccccacgtaggtctataccatcacacaccaacaacacgctgacataggagtcacatcccatcaggagggaaacaccaccacacaccgagagtcagagacgcacgcctgccctgccacacgctgatgatgacacacagcgcctgtgtcactgcacatgagtgctgccactctcccacctgcacagtcccacactgctgggcactcaaatacaccattgcacacttatgggtttgccctcacaccatgccattccatgttaaaggaggtacactgggaccctcacagtgatggcacccggccattgtcagtgacaagagggaaggcactcatcagatgagcaaggtggcctagagcccttctctgtgtaccacccccgcagttctgtttcctcgggcacacggccaacctcccaaaccaagaccaactctgcccctccaggcttaggctagaatgacaggatgtgaagccagtgtctggagcatttgaatgtctccctgcacccaccaacgtaactcccagcaagctcaggaccagccagcgagctccagatcagagctggtgcctggcatttcctagacaccccctcacctcccacatggcatccaggatgccctctgggctgaggcaattgcagggaagaaatgggctgacctttggacaggcaccttacgcaagctctctcactgatcaccacgtttatggtctgtgacagttgtcattcctcacacattgttcctcgatcctcacacaaagtactaacattagctctcttgattggcttcctactgaacattcaaggcatatacataacatcttacaaatctgttcaaatctgaacccctcctcctgcccccagggctcataaataaaagtggaaattcagctccagtcaggataagtcacctgaagcagagccacatctatattttaccaggtgactcttagaagctgtctacagagcaggctcggcaagaacctgcggctgggcctgtttgcactcccgctggattagagatgcaggagatgaaggaaatgctggcaacccacatgacatgaggaccccgatctgggtgtgaattcgtggcaggtttttttttttttcttttagtgagaaactggagaacagggaagactataaatgccaatgtaaaaaaaaatctgcagagcaaaagttacatttccataggctgtgggatgtgtcaggagagaagcagccccacgtgctggaaggaccacagaactcagtgtcaggcaagcctggtctggaaccctggctctgccaaagattcattttatctccctgggcctcaactttcccatcttgaacataagtgcttgtgtaaattaaatgagaaaatgtaaattatataaagcaccaaagttaacacctgagacataatgaaagctcaaatattcactattagtagtagtattttaatcattaggaaagacttatgatattcagcaactttttcaataatagtagggccttcgggaagcatgtcaaggctggtaacactgaatagggagcaggtactcatctcttcgtcacctttaatggctaaagtgtcatgatttaccccttattgtgcaacaaaatgaagtcaccaaaacttggctgagctgccttcctattcgccagtgagattttctgcagtgagacacagttcatgtcagcttaggcagttttttatagactcaaagatgcttgggttcaaagggggctttagccatcagctggaccagcctcccacacacctgccatcttccagagatagagaacccataaccccacacagggcagtctatcctatggctggacagctcctatggagagccagttcttcctctcagagcttctgcctgcttcctttacctttcccccattgccctaattctatcgccagcaatagaaaaagcaatagtactactcttccgctacaacagttattcatccattcaagcacttccttagcatctactttgccaggcacgttactaagcgggggaattataaattaagcaggaattgccagcccttaaagggttaatgccccctccgtgttctttcttccaggtgaaagatcctcaaatccttcaacctgccctcatttgacctgatttccaggtgcccaccaccaaactagccccttctcgagcttgacatactcacgtttgtcaaagtccatcttaaagtgtggtgtccataactgagctcagtattttccttaagcctcaactagatttgtagcccagctcagttgatgtccatgtcaaaagcaataccagttgtggaaaaactccaattgtaaccagagtgctgccagccaggtcccatttactgagaatattcttgaagcacatgaagaaagaggggacggrgaggactgtgcacttgaaatgacatgatgtcagatctccctgcccagaattcccctcaggcattagtggaaagtctaagtcactctaatcaaagagcctccctgccactgccatccccctcttagtatctgccctaggaaagggaagaaaaataaagaataagcattctatgctgatggcccaacacagtgctaaacatggaactcagccctaaaggaggggccttccttacacaagcctgtaaggggagaacagacatagacttcagaaggtgattctccaggtgacgaggatgggttcaccaatggcctctgactggtgggggggtctcctgctttaaggcctctgctgtgatcgtgtgtgaagggataagttctccctcantggaacaaaatcacatttctgcagctcttgttgccccttccttggaaggaagccatccccttagaaggagaagccatctccactctgacataccttgatggatgtgaaactcctgcagatctttcacaggccttgtgcaaggcccctcctctcygaagccattttcctacacatcgggctggagtaattgggagccgaaagatggcaggcagaataaaaaggctcattaggtgagagtaataaaacaaaacaaaamaaaaatgagtgcaaggggaagaggaaaggctgggggtgggagcagatgttgtcctgcctcttggaagtccttttactttcttgggcataggaggaaaagaaatggccttctagaataaattttgccagaggagtccttattcttcacaggatatcagatctcaaagggattggcgagtggcttgcctaaggtccactgcagttttgcatcagtcttctctttctgggtgcgcagtggaggttcctgacccactgcgagggtcttgcccacacgctccatcagtgtttcctgagtgctcctgtggctggacactgtgctggggggctgcaaagatgacctggccaaggtccagtcctggagctgctcacaggcaagaggcaaaccaacaggtggaacgggggtcgctgaggcaagggcttgtctgggagtggcaggagccgcaagaagtgcaaccactctgcctggagaaaccaaggagggctttcccaaggaggtgaactttgagctttgctttaaagaacccttcctccaccccttgcccccaccactcctcaggagcagcaagcttgtgggcctggagctgtggccaggatgtctggttgcagggaggcggcaggggcgtctgcgagggggaggagaacagtgtaaggtggaggagagaggggaggggagcgagaaaagagggggaggaatggagggagaaggagacgggagggagggagagagggagagaaggaggggacgaggggggagggagggagagaaagagagagaggagagagagagagagagagagacagagagagagagagagagagagagagagagagagagagagagagagagagagagagagagatttgaatttcccatctggaaggggagcggtagaacgtcagggcccggctgaggggcgtgattggagggcgccttcggcagccgcccgcggcagaagccgcggctccagctcgcctggcggaattgcacgcggcggcgggagctggaatagcagaaggaaccacctcgtggagtcgggccggagccctgcagtggctcagacggttgcagggaccgccaggtcggtgctggccgagggccgggagggcggagctgggctgtgggcaacagggtcccggctctcgcctcgaggccttggggcagctcgggaagctggggagcacggctttcggggggacagctccccaaggctgcctgggcaccggatggggactgagaggcggtaraggggacactcccgggtgcgctctccgtggtgctgaaaggacagctccttgcgaggggccgcgagcaggcagctagctgcgaactaagaggaagcgtgggccctagccggagactccgggcagagcccgaacggccggggtcccggagccaggaccgccccggctgcggcggagactcaagtctgaacccagagaacaactttgagctcgcgggagtgggggacgtcgatctaagctacttctggctgtgcttaacccgaagcccgccggagcacgcttcgccccggaggagggagtcgcccccaggggtacagtgcgcactcccggagtgagtcagagggcggcggcaggggggcggacagaccgcaggtggaggggaggagaacgtagacattgacaggggatgggggaccaaggggactatttgtccctttccgggaggagccgccgcttggacagcgcacgcccgccgcctggagtcttcgggaacgaccccttctgtgctctcgttctcgtcggcctcaatctgcccccttccccagcaaagtttgaaaccgggccgggtcttggggtkggagctatgtgtgttgggggaaggggcgctctccgtggcccaccgggagatccaggacagagctgctgggggtgtgggtctccgcgggggtccgggagaggggcgccggggttcctgtcctctcttctggccgggaaacgggaacccccggccacttccgcttttcagccggagtcggctccctacctcctcccatcctccgctgcccctcccctcccccatgcgtctcccatcccgggccacggggtggggacggggcggggggagggggtggagtgacatcccctgtctctgccactgcctttggcgtagtcccctgccagaagcaaatgagtgttgaattgagttgcggtgaatatagcccagacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggtacggaaacctggtgctacgacggcatccctcgccgcccccggcctcccctcccccagcgcagcatcccccacccacccccactcccacccacccccaccctcaccccccttcccgcgcagggatagaccaaggcttcccgcagaatcgctaaggagcgcctcctggcggcctggcccaaatcctcaactgccggcaacctgctggacctcagcactcccgcaggcatatggcaaaacatacacacacacacaccctgcacacacgcacgcactcacacgatgtctaagtccagagttgcacacacggggtcatactttcaacgcacacaccctcatgcactcgttgacacgttaaattcaacccggcacacacgtcctcaggatctaccatgtaccaggacatgtagccaattctggggacaggagaaatgaaacaagatactggtcctgtcctgagaggagctcagagtaaccaggaagggcaagacaaagaaagacaaacagacaaagagagcatgtactggaggcaggcaatactgcccccagaaagtgccacaggtctccaaaggggaagatgccctcacatcttgccaaggagatccgtgaaattgcatggagggagtgctgtttgagagagatcttcagaaatcaatgctgctgatgatgataatgatgactgcgatgatgttagataatatgtacctactttgtgccaacactgggctgagcactttatttgcatcacctcattcaatgctcactacaagccttgggaataggtgttgtygtctccatttcatagatgagaaaacattgagtcatttgctcaaggttacttagtaagtgatggagccaggatttgaactrgcagagatgagggtaagaggttccaaggctgtgggaatagcatgcacaaatgcccaggcattctcagaaagattatctgttgggaaataatacgtgctaagcagagccctgtgcaagaggtggcacacgagcagcaaggaagacgggtgctagactgtgcaggccttgaaggtcagcacaaggactcgtatcagtttaacaaggccatggggagccattgcagggtgtgtatgcatgagaaaatctgccctttaggaagattaattggatggccacgtggaggctggatgagagctgagggagagacagttagaggttatggataaatccagaatctctaggtcctgaaccaaggcattagcagcagtcacagagtggagggtggggatgtaggcagcattgcaaagctacagcgtctggacttctccctggaattctccctcggcacccccatcccaatcttaactcaccaattccttgcatgatctgttatccagcttctacctccccagcccaactgaatgctgtgagaccactgctgggactcccttgttccctgccacagccccagcacccagaacagtgtctggcagaaagtaggtactcaaggaatatttgtagtatgagcaactgagtgaatgaatgaatgaataatgaggaatttgctgtctctagagttttcagttgaggtgattgggacaaggcatactagagaaaaagatgggtgtgtggggaaagccaggatgagactgatctttggacagacagaatttgagattatccatgtgacaacatccagcagagagttaaatgtgcaggtgtnggggaggggaggcagagagagggaggtatctgtggctaaagaagtgcactaaaccaataggggtggacgagattcccaagggagacagaggggcaggagaggcaggaggggagagtttgtttggagaccatcttcactttaaaggaaaggaaaggagtcagcaaagaagagagagaagacctatctgagaagtaggatgaagaccacaagagtgctgtgtcatggaattcaggaggagattccagaaagctggaaaaggtggggggagggagtcagcagcagcatgtgattcagcagagggatggaggaggatgacggccgtgaagaccctcttgaatctggcaatgggaaagcctctggcgactgattaccgcagtttcagggctcctgcagaggcagcagagctctggtctcacagagaggtagggcttgactgggaggtgaagatgtggagataccatgtggagatcacttcatcacaaagtgagaggggtgggattaagggaaacgcagaatttagggaaggagttagagaagggagggaataaaagcaacatatggagagggatggaagatgtgaggaagagggagtggtgaggtacaaagagagggaatccagggcacaggtagatgaattggcttcagccaggagagggcttcttcctcaggagctagaaggaggggaggttacaggagctcccactcactgacattaattgttttgattattacaaccatttactgagcacccagcatgtgcaaacacatcccatagagtatttctaaaatttcaaagtgccattataattctcattttatagagaagatcaagtatcaatgaggttaggtcaattactcactattgcacagcttaaaaagtggcagattcaagatctgagtcaggcatgcctaacctcagagctcagaccccttatactttcgcccgtgaagtggagggaaagtcacctgctgagaaggaagaggcagtagcattttgggccttaagaaaaggagaattggttgggagagtgtagacagagtgaacaggagactgcttaacagctcagaggtccatgctgggatcaggcagcaggatttttgggcagactngggaatttcagataaagaatcccagcaggctgaagaagagctacttagagccacagggatgtaagcattgagaagactcagtggtgagtagaggtactttgcaaactggtggaggggtggcagtggtaaacaatgtctgatgaatgcatgctggcaagcagaggtggccggagaaggtgatagtttggtgatacagaaatggcatgttaagtttgaggggtgcccacagacatccaggaaagggtatccaggagaaggtaaatgtgtttttttacttatttattgcttaytttcctacgcatgtgtgcatatacccccacactcacatacacacatacatacctcagaatgtaatctgcatgaaggcaaggctttgtctgtcctgtttcctataaatccccagtgcctaacacattgactggcatatagtaggtgctcaattaatacttgctggatgagtgaatatagaggtctaggtgtcatcagtgtcagtggtcattaaaacccctagaatggatgagttctcccagggaaagattagaaagtaaaaagaggcaggggctgaggtcagagttatggggaagagacaggaggaagaagaggagtcagaaaaggcaaaggaagagaagaaaagaggagaggagaggaaacagtaaggggaagcagggataggaaagaactgagtcacagaaccaagagagaaggaggtttgagggtacagtggggttgtcagcagttcaaatgctgcagactgcttcaacagaggcatgggagaaagggcctggaagatcatctgatccaggagagagacgtgtcagaatcacccagcaagttagggatgaggctgcaactaaagcccgggtgccctgcctaccaatttggaacatctcaaattagagccctgcatctcccactgccacctggtaattccttgagctctatgtaaacacagagtaggaacccaagagtttctgaaatcacttgattattaaattgttcatttcctgttcttagaaatgaagttttttcacaatgtattaaatcgaacgaaaacatcttgactgagctgagcaacctgcaaactcagaattcggggttaggagggtgggttctcttgcatttctgagaaagcatggaaagcctgttcctttttggcttgttccacaaatatgtagtcggcaacggctgacattttatgagttcctgcaacaccccaggcacttgaccggtatcattcattctccttcaaacgtccattcaagggcaaccttaatactcccccattttgcagggagcaaactgaagcttgcccagggacccccagccagtaagtatagctgcctggattttgaaccaggtgtgtctgatgccaaagcccctgggctgttttgtgttttgctttttttttttttttttcctacacatcatgactttctcttcccaaaacaacctatcagatgagatggtctgatcacgtagataagctcttgggccccatatcatgaaataatctcagtctaccgatatgacttctcatcttgagagaaatgaagaaaatctatcaaagaacaaccagtgaccctgaactcagccaggctgcaatatccagccttgaacccaacaaggttgcaacatctgccaccctttcccaggaaccctttttcttccttgcaaggctgtgtgggacaaaaggccttggggagcaggcctggcctcagcttaccatgaagctacttcacactttggatagctcacggatgtcccctctacacttgaaaagagatctgtgtctgttaaagaacagtggaactgaatggttaaaatacaaagaaaatctcaagttagagcactagggtwcagcttctcagggatgtagggggaagatggtaaggaggccaagggggaaggctcttcctcccccaccacctccactggaagagttccacttttacatattttgcatattgagaatcccattaagattttatttggagaacccttctgaggcaaaaacataataaaaaatataataaaaactgaaagccggtgatttaggaagaggagtagggtgctaatgtctgccgagtgcctgcaaggcccgtgctaggtagtttaaaagccctaagcccccagaagattataatgtctccaacactcccacgtgaaattcaaaataaaaatcgatattaagctataaaacataaaaattacacgtacattacaataaaaataacgtattttccatttgtctaatttcaaaagtcaggatctgtttatccaagctggctgttctcatttgctcagctgcctccgattggctggggcagtaacaccggctggtcttttgatgggctgatccagtggcccaggctgggccccctccaatctccgccggagccggggaaaggtggcattgccatttctctcttagagaggaggaaactggggactcgagcaggttagggccttgctgaaggtcccatggcaaataaggaaatgacggtggcgttggaaaccagatctgcctgactccaagttccaggctctttccaatgctcctggcttcaatcaaatctgaacaatagggtcaagatgaaggctttaaaatagggaccaaaccgctttcaaaaagctatttggcagcacctacgtgtctgcccagtaaatcgctctcttccatctcctttctcctccagcagggcattgggtcttgacctcagagcgatgggtgcctggtgtctgaaccagggtgaggctgctgtctgyctagctcccccgccctgcctgtgcagaggcctctcccatctgactcccaattctcttctgcaggttgtcacatcttcccaagccaggccagccaggagcgctgcatgcaaattctgccgtgggctaaggcacgctaaccagagccggcggcatggacttcgtcatgaagcaggcccttggaggtgaggtccagcgcccctccgcgtgtcctcagccggtcccacccttgtgggaggtggcctcggcccacccggcccctctctccccagccctgacccctagctgaccccgccctctccttcccaccccttcctcgtaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataaggtcagctccgcccgcccgcccgtcctggggagggccacaagcgggtaaaaccggtccagctaaagcccctgctggggctcccctggatcccagctctcaccttcgccctagttctgagcctcactcttctcatcagcaaaacgggtatcacaaggtcacctccctcangggatccttttggggattaaataagagaatgcgcgtagtaggtactccaagagggtggaccctacggtccaccatttcgtactgcagatctttgggaccaaaaatgagtgcagttctgaatttgggaatgttcgaaaaataccacagtgtcctaagcactttgtgctgtcagctgtcactcccagcgggtctggggctgccaccctactccagacagtccagtgcatgtctgttagtgcgtgcaataaataaaggctagaagtagtcttccattggttcaagtcagattcgtcaccaaaatttggctcaaaatatatgggcaaacgccatgtgttcagatctttgggggtttcaacacagcaggaagttctgatgggcaggtgttaattttaaaggaaaccccacgtatggtctctcccactgaggaccaggcaccatcctacagggaagacacccttatccccactttactaatgacaggactgaggcttgggaggcactcctggccacctcagccagtgctgcatgatcatgagactcctgctgtctccttgcccaccccgcttcatgcgcgtctctgccctccccctccccagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgyaccccactcccaagtagcytgaaaaagggaggacagtctttccccagcaggggtcaggggggcccctcaggaagcctaaggtcgtgctagtgtggtgacccccatacattcctccctgctccccactgccaggagraccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacaccyccattggtgtggccaagctgcccccattcctatccacccctctccccaccccgtcctgtccatgcgcttccagggccccacggtccccaggaggacgcttcctggccaaagccccaagcctttggtgagaagccayttcccacttgacagaaggcgtccatccattcatctcaytggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaattgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcracagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcagyatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggmtcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcsagacaccatcccaggtgtgtgtaagagagagagagagaacagggaggatacagaagtattgcagcccagatcccctatcagggggacagctggtgggcaaagcagccaccccacagccttgtggctagagtacagtggggtrgaccctccagccccaatagccctagtacccagctggcagggttgcccacccctgctgtccacctgctccatcctctagggttccacaggcccctgaccgcacagggaggctggggccagcctggtctcccaggcctgaggacatgcctcccaccaaatgtcccctgctccagtcccactcctgtcaccccacgctctgcactggggagaaaacgggaggtgctcgtgctggccctgggtgggagcggggagtcctggtgagaccccggtgagatggaccatcctgcccscgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagcagctctctgtctgtgctcttctgtccatcggcaccaccagagacaaacaggggcaccaactcaccagggaggaggcaacccacaaagctcgaggccccagaaaatcttcaattttaccctggcttctggccaggacaccatggagatgactccagaaatcaaccgcagccagagttgggactgggcttggggttccaggatcactctgcttccctgccttccagaatcaattcttcagccccaggggctgagtgttccccatggaccacccccccaccccccgcacacacacaccatctctgacaccccttcccccgagcccctctgggtgccacttcctgagaatgctgtcaagtcgcacggtgggcagcaacctgtcctcattcattccccagacactgagggagacctactccccacgggccacgtgcagaagcctggggtcccaaagaaaggacaccactcagcattcctcccagacacaggcacttcccaggccttggtgaggagtcagaactgttccggaaccccctccacccttaccctcaccctaataccctgccttagttaggtcccaatcctctcagcttggctgggcccttcccatggccacgcaatggtctcccagcccccacccctctccttccatgcaccctcttctgccaccctgcgcctgcctccaaggcgcatccaaaatgcagacttcaccatgtcactccctgcccagagccctctaaaggcctacaggaaggcgcctgcctataggataacatccagattgtccaaatggccctgtgtgatgtggcctcaacctactgatcagacccacacccacctctgtgctccaagtgccccagtccccatctataccatcttcttggtgtttgcatattctgtccccggtgcctgagatgaatggtgcccttactctccttggtgctctaaggagcttggagctccctcaagctccagctcaaacatcacttcctctgcgaagcccactctgatccagcccgtctccctgaccagagcagaggctgttgtgctcacagccacatagcatcatgtctgagtgttcagacagcgctggatgtgcttacggctctgtcacccagcagagtgatcttgagtaagccacttaacccctctgagtgtttgctcgcaagtgaaatgggatgataagcattgctccgatctccacgcttgttgtgaagagtaaatggggtcctgcacatgctttgagcaccacacgccaagcattcagtgaatggagctttgcaatttctgttgaaagagatgtcgctgcacctgtatccctcactaacttgggagctttatgagggcagggctggcctgtgctctgatccctctgcaacacccagcatagggtctggcccacagtgtgttgccagggaccccaatgctgattcagggcccaagatatcaatctttgcaccatctacttggtagccacagtcactcttcttttggctctttgtacttactaggcaatgaggggaggggtgcagaccctgatcccccaccttctatgtcctgacatcaccctcctgcctgttctcccagatccgcccatacccctgggttagtgcactgtaggtagcagggcccctggactctctgagtcagatggagctcagtgtgcaatgggaggccgtgctagtgatcaatggctacataacaaattattacaaactcagcagcttaaaacaacacatgtgtattatctccatttctgtgggtcaggagtcccagcacagcttaccagggtccttctgcttcaggacctctcacagggctgcagtcaaggtgcaggccagggttggggtctcatcagaaggctcagctaggcatgactcacttccaagctcacatgattactggcaggcttcagttcctgttggattgcgggcttcagttcttggctgactgttggctggaggccatcccctagcccttgccaggtgggcctctcccactggggcagctcaccacagggcagcttgcttcaccaaagcgtgcaagccacaaaggcaacagagagagtctgctagcaagatgtaagccacgttgttatataaactaatcatggaggtgactcccccgtcacccttgccatcttctattggctagaggtaagtcacaggactcacccacactcttgggcaggagactgcacagggtgtgaataccaggacaggggattattgggggcatcttagaggctgcccaccatagagactgaggcaactccccctttcctacaaagcactggagtagagcagggccttggagaagccagagctccaaacctcttcagccacagggtcccaggcggtggaggaaatgtctcagagctggagcagcagccaatggcaggctctcctggagcctctacaagactacggtcattcccagagcccccaggctgggctctgagggcctcctaagggtggggactggagagaaagagaacaaaagggcttgtggcttccctgagagtccatctgtgtgctctgcccagcaccccaggcactgtcctcctaagactcagggcgcacctccagaaacaacccagcctgggacactcagatagctgccctcagcttccatctcctctccactccactcagtggatcgcaaggtcagtaaatgccagcatcctctcattttcagtcctgaatgtcttctcctaagagtcttaatcctctccggtaaaatgagtattcactgggcttccaccatgtgctagacaccaagaataccaatcatacagccctccctccaggaacctacgtgctgaaggaggagataatggagaaacagaacagctgcccaccacagcatgagcagtgccaccggtgaacttgggatcgtgctgcaggctccctggaggggtttacatctgagatgagtcttcaatgagtaggaatcagcctggtggagaaggagggcacatccaggagagggactggcatgaacaaaggcatggagcagacaaaagtagtttaacctgggcaatgggagtgggggatggagaaacagagggtatctgcgtgaattcattgagctctccgtgaaaggctgagaggtcggggacttcaacctgggtgccaggacgtggagcttggactctacctgcaggcaatgggaagtcactgaagggtattgagcagagatatgccatgatcagatgtgcagattgaggaagatcagctggggctgtgaggaaggtgaaccccaaaatgtagccatgtcttgactattgacttcactacaggatcaaagcacaggaaatcaagaaacctgggatgggaaggggatgtaaagtcaaatccatcctcccatgcaattcaggaaaacctcctgtgtcatcttaggtagagggcgcactcctgcttacattctccacagtgttgggaagctcattctaggcagacagctcccctctttctcctaaaccaaaagctgccaggaagcagggggttaatgaagcctcctccagcatctctttaattgactgcaaaatcctgcttccagaccactcacttagcacttgtaattaattggggcttcttgcctgatctgagagatgatgcgataccccctgaggacaatgttttctcagctgggattctccagctggagacaacgctacacacccagcgtctccacaggcactagtctgggtatgagtgcaggctccagccctttccctctgggtgagctcaggcagggcacttccccgtcggagcacagagccagcacattgcacagactcagtgggtgggtcagagctggtgtcaccatctccgtgggctccagacccagggcatccactctatcctgggacaggaccaggggtcttcagctcttggccacatcaactccctgctgctctcattgtgagaggcacttgccatggccctgtctgcatgagggtcaagacagcccatgtcaaagtacataagacaggggagaaaaagggaaggcaagggaacccctactcaccaaccacctgctgtatgccacacatgggggctgattactttaaagcctcctgctctcctcatcccaacaggaatctgtgaagtcagtattctccccactttacatatgagaaagctgaggctcacaggtaaaagcgtgaaatggaaatggacacaggctttggactcagacaaacctggccttcaatctgattccttgtatctgatcctgggcaagtgatccaacagccctgaacctgggttttatctatttttaaaaattattatgtattataatacatacataataatacataataaaaattactatatatactaatgcccaccatgaccaccagggtcattgagggaactgaataaaatgcccatagatcccctagcacagtgccaggcacatagcaggtacctaaaaaataatagcgactgggcgtggtggttcatgcctgtaatcccagcactttgggaggtcgaggcaggtggatcacctgaggtcaggcattcgagaccagcctgcacaacatggtgaaatcctgtctctactaaaattacaaaattagccgggcatggtggcgcatgcctgtaatcccagctacttgggtggctgaggcaggagaatctcttgaacctgggaggtggaggttgcagtgagccaagatcgcaccactgcactccaggctgggcaacaagagcaaaactccatctcaaaaaaaaaaaaaaaaaaaaagacagccattgctactaaatgctactattactatagcaagactgatgaagaaaagtaactagaggaggaaaggaaaggagggagaagaaatgaaaaggataaggagaataatttgttatgacaaaaatcctccagtcatccaaatagtaaattgggaagcctggatttaaaaaaccaacctgtcttttgtcttttcatgtaacacaagacaggtgagagccaagggctgaagtgagttaggggacagagggaataactgactccttcaggaagcgctcttgaattttagctcaaaagacacttagcaatttgcagtagttacctgttactccataataaattaccccaaaatattagttgagtgtggtggtgcacacttgtagtcctagctactcaggaggctgaggtgggagcattgcttcaggaggctgagctgcagtgagctatgatcatgccactgcactctgacctgggcaacagagtgagatcctatttctataaaaataaataaataaatcaccctaaaacttagtggcttcaagcaataaacatttattttctgtccatttctgtgggtcaggaattctggagtggcctaagtagttctggattggggtctgtcatgaagctacaatcaagatgtcagccagtcctgcagtctcatctgaaggcttgactgggctggaggatccacctccaaggtggctcagtcacgggactggcagctggtgctggctattggcaggaggcctcttttccagagcctcttcatagaacttctttagcatccttgcaatatggcagctagcctcccccagagtgagtaatccaagagagcaaggtggaagctgcaatgtctttcatgacctagcctcagacacataccataccttctgcagtattttattagccacaccaaccagctgtgattcaatgtgagcggatgctacacagggcatgaatactgggagggaagctccctggggagtgcccccactccgcgccccccccccaccccttgcaggttgtctacctcacaatgcagacctcagcacacctgcagctctttctttagtctctagttaataaacactccttcattcatccatccattgagaaaacatctcctcattcctttctgccatcagcaagtgccttcctaccaagggcctcctcacagccaaacccaggctaagcactgcctttcagacccaaatctgacatggtcaccagagcctgtagtcggga
